United States Patent 8,541,208 (PROCESS FOR THE PRODUCTION OF FINE CHEMICALS) - sequence listing, part 11

SEQ ID NO: 49510 - protein, 306 aa, Nitrosomonas europaea; identical to SEQ ID NO: 21613

SEQ ID NO: 49511 - DNA, 885 bp, Enterococcus faecalis; identical to SEQ ID NO: 21614
  CDS (1)..(885)

SEQ ID NO: 49512 - protein, 294 aa, Enterococcus faecalis; identical to SEQ ID NO: 21615

SEQ ID NO: 49513 - DNA, 828 bp, Coxiella burnetii; identical to SEQ ID NO: 21616
  CDS (1)..(828)

SEQ ID NO: 49514 - protein, 275 aa, Coxiella burnetii; identical to SEQ ID NO: 21617

SEQ ID NO: 49515 - DNA, 912 bp, Tropheryma whipplei; identical to SEQ ID NO: 21618
  CDS (1)..(912)

SEQ ID NO: 49516 - protein, 303 aa, Tropheryma whipplei; identical to SEQ ID NO: 21619

SEQ ID NO: 49517 - DNA, 903 bp, Myxococcus xanthus; identical to SEQ ID NO: 21620
  CDS (1)..(903)

SEQ ID NO: 49518 - protein, 300 aa, Myxococcus xanthus; identical to SEQ ID NO: 21621

SEQ ID NO: 49519 - DNA, 939 bp, Streptococcus pyogenes; identical to SEQ ID NO: 21622
  CDS (1)..(939)

SEQ ID NO: 49520 - protein, 312 aa, Streptococcus pyogenes; identical to SEQ ID NO: 21623

SEQ ID NO: 49521 - DNA, 969 bp, Vibrio parahaemolyticus; identical to SEQ ID NO: 21624
  CDS (1)..(969)

SEQ ID NO: 49522 - protein, 322 aa, Vibrio parahaemolyticus; identical to SEQ ID NO: 21625

SEQ ID NO: 49523 - DNA, 1035 bp, Pseudomonas syringae; identical to SEQ ID NO: 21626
  CDS (1)..(1035)

SEQ ID NO: 49524 - protein, 344 aa, Pseudomonas syringae; identical to SEQ ID NO: 21627

SEQ ID NO: 49525 - DNA, 924 bp, Clostridium tetani; identical to SEQ ID NO: 21628
  CDS (1)..(924)

SEQ ID NO: 49526 - protein, 307 aa, Clostridium tetani; identical to SEQ ID NO: 21629

SEQ ID NO: 49527 - DNA, 969 bp, Bradyrhizobium japonicum; identical to SEQ ID NO: 21630
  CDS (1)..(969)

SEQ ID NO: 49528 - protein, 322 aa, Bradyrhizobium japonicum; identical to SEQ ID NO: 21631

SEQ ID NO: 49529 - DNA, 936 bp, Streptococcus mutans; identical to SEQ ID NO: 21632
  CDS (1)..(936)

SEQ ID NO: 49530 - protein, 311 aa, Streptococcus mutans; identical to SEQ ID NO: 21633

SEQ ID NO: 49531 - DNA, 930 bp, Streptococcus agalactiae; identical to SEQ ID NO: 21634
  CDS (1)..(930)

SEQ ID NO: 49532 - protein, 309 aa, Streptococcus agalactiae; identical to SEQ ID NO: 21635

SEQ ID NO: 49533 - DNA, 966 bp, Shewanella oneidensis; identical to SEQ ID NO: 21636
  CDS (1)..(966)

SEQ ID NO: 49534 - protein, 321 aa, Shewanella oneidensis; identical to SEQ ID NO: 21637

SEQ ID NO: 49535 - DNA, 894 bp, Oceanobacillus iheyensis; identical to SEQ ID NO: 21638
  CDS (1)..(894)

SEQ ID NO: 49536 - protein, 297 aa, Oceanobacillus iheyensis; identical to SEQ ID NO: 21639

SEQ ID NO: 49537 - DNA, 903 bp, Corynebacterium efficiens; identical to SEQ ID NO: 21640
  CDS (1)..(903)

SEQ ID NO: 49538 - protein, 300 aa, Corynebacterium efficiens; identical to SEQ ID NO: 21641

SEQ ID NO: 49539 - DNA, 855 bp, Chlorobium tepidum; identical to SEQ ID NO: 21642
  CDS (1)..(855)

SEQ ID NO: 49540 - protein, 284 aa, Chlorobium tepidum; identical to SEQ ID NO: 21643

SEQ ID NO: 49541 - DNA, 903 bp, Corynebacterium glutamicum; identical to SEQ ID NO: 21644
  CDS (1)..(903)

SEQ ID NO: 49542 - protein, 300 aa, Corynebacterium glutamicum; identical to SEQ ID NO: 21645

SEQ ID NO: 49543 - DNA, 951 bp, Xanthomonas campestris; identical to SEQ ID NO: 21646
  CDS (1)..(951)

SEQ ID NO: 49544 - protein, 316 aa, Xanthomonas campestris; identical to SEQ ID NO: 21647

SEQ ID NO: 49545 - DNA, 951 bp, Xanthomonas axonopodis; identical to SEQ ID NO: 21648
  CDS (1)..(951)

SEQ ID NO: 49546 - protein, 316 aa, Xanthomonas axonopodis; identical to SEQ ID NO: 21649

SEQ ID NO: 49547 - DNA, 888 bp, Thermoanaerobacter tengcongensis; identical to SEQ ID NO: 21650
  CDS (1)..(888)

SEQ ID NO: 49548 - protein, 295 aa, Thermoanaerobacter tengcongensis; identical to SEQ ID NO: 21651

SEQ ID NO: 49549 - DNA, 933 bp, Clostridium perfringens; identical to SEQ ID NO: 21652
  CDS (1)..(933)

SEQ ID NO: 49550 - protein, 310 aa, Clostridium perfringens; identical to SEQ ID NO: 21653

SEQ ID NO: 49551 - DNA, 954 bp, Aeromonas hydrophila; identical to SEQ ID NO: 21654
  CDS (1)..(954)

SEQ ID NO: 49552 - protein, 317 aa, Aeromonas hydrophila; identical to SEQ ID NO: 21655

SEQ ID NO: 49553 - DNA, 936 bp, Pasteurella multocida; identical to SEQ ID NO: 21656
  CDS (1)..(936)

SEQ ID NO: 49554 - protein, 311 aa, Pasteurella multocida; identical to SEQ ID NO: 21657

SEQ ID NO: 49555 - DNA, 918 bp, Streptomyces coelicolor; identical to SEQ ID NO: 21658
  CDS (1)..(918)

SEQ ID NO: 49556 - protein, 305 aa, Streptomyces coelicolor; identical to SEQ ID NO: 21659

SEQ ID NO: 49557 - DNA, 876 bp, Cytophaga johnsonae; identical to SEQ ID NO: 21660
  CDS (1)..(876)

SEQ ID NO: 49558 - protein, 291 aa, Cytophaga johnsonae; identical to SEQ ID NO: 21661

SEQ ID NO: 49559 - DNA, 21 bp, Primer
atgaataagcgcgatgcaatc

SEQ ID NO: 49560 - DNA, 24 bp, Primer
ttattcaggcgtaaagtggcgtaa

SEQ ID NO: 49561 - protein, 45 aa, consensus; identical to SEQ ID NO: 22568
  MISC_FEATURE (1)..(45): consensus for the disclosure of xaa see table XV

SEQ ID NO: 49562 - DNA, 864 bp, Escherichia coli; identical to SEQ ID NO: 46787
  CDS (1)..(864)

SEQ ID NO: 49563 - protein, 287 aa, Escherichia coli; identical to SEQ ID NO: 46788

SEQ ID NO: 49564 - DNA, 891 bp, Mesorhizobium loti MAFF303099; identical to SEQ ID NO: 46789
  CDS (1)..(891)

SEQ ID NO: 49565 - protein, 296 aa, Mesorhizobium loti MAFF303099; identical to SEQ ID NO: 46790

SEQ ID NO: 49566 - DNA, 867 bp, Borrelia burgdorferi B31; identical to SEQ ID NO: 46791
  CDS (1)..(867)

SEQ ID NO: 49567 - protein, 288 aa, Borrelia burgdorferi B31; identical to SEQ ID NO: 46792

SEQ ID NO: 49568 - DNA, 879 bp, Thermotoga maritima MSB8; identical to SEQ ID NO: 46793
  CDS (1)..(879)

SEQ ID NO: 49569 - protein, 292 aa, Thermotoga maritima MSB8; identical to SEQ ID NO: 46794

SEQ ID NO: 49570 - DNA, 885 bp, Bacillus halodurans C-125; identical to SEQ ID NO: 46795
  CDS (1)..(885)

SEQ ID NO: 49571 - protein, 294 aa, Bacillus halodurans C-125; identical to SEQ ID NO: 46796

SEQ ID NO: 49572 - DNA, 864 bp, Pasteurella multocida subsp. multocida str. Pm70; identical to SEQ ID NO: 46797
  CDS (1)..(864)

SEQ ID NO: 49573 - protein, 287 aa, Pasteurella multocida subsp. multocida str. Pm70; identical to SEQ ID NO: 46798

SEQ ID NO: 49574 - DNA, 864 bp, Pseudomonas aeruginosa PAO1; identical to SEQ ID NO: 46799
  CDS (1)..(864)

SEQ ID NO: 49575 - protein, 287 aa, Pseudomonas aeruginosa PAO1; identical to SEQ ID NO: 46800

SEQ ID NO: 49576 - DNA, 885 bp, Neisseria meningitidis Z2491; identical to SEQ ID NO: 46801
  CDS (1)..(885)

SEQ ID NO: 49577 - protein, 294 aa, Neisseria meningitidis Z2491; identical to SEQ ID NO: 46802

SEQ ID NO: 49578 - DNA, 879 bp, Clostridium acetobutylicum ATCC 824; identical to SEQ ID NO: 46803
  CDS (1)..(879)

SEQ ID NO: 49579 - protein, 292 aa, Clostridium acetobutylicum ATCC 824; identical to SEQ ID NO: 46804

SEQ ID NO: 49580 - DNA, 888 bp, Sinorhizobium meliloti 1021; identical to SEQ ID NO: 46805
  CDS (1)..(888)

SEQ ID NO: 49581 - protein, 295 aa, Sinorhizobium meliloti 1021; identical to SEQ ID NO: 46806

SEQ ID NO: 49582 - DNA, 876 bp, Bacillus subtilis subsp. subtilis str. 168; identical to SEQ ID NO: 46807
  CDS (1)..(876)

SEQ ID NO: 49583 - protein, 291 aa, Bacillus subtilis subsp. subtilis str. 168; identical to SEQ ID NO: 46808

SEQ ID NO: 49584 - DNA, 882 bp, Caulobacter crescentus CB15; identical to SEQ ID NO: 46809
  CDS (1)..(882)

SEQ ID NO: 49585 - protein, 293 aa, Caulobacter crescentus CB15; identical to SEQ ID NO: 46810

SEQ ID NO: 49586 - DNA, 864 bp, Salmonella typhimurium LT2; identical to SEQ ID NO: 46811
  CDS (1)..(864)

SEQ ID NO: 49587 - protein, 287 aa, Salmonella typhimurium LT2; identical to SEQ ID NO: 46812

SEQ ID NO: 49588 - DNA, 876 bp, Listeria innocua Clip11262; identical to SEQ ID NO: 46813
  CDS (1)..(876)

SEQ ID NO: 49589 - protein, 291 aa, Listeria innocua Clip11262; identical to SEQ ID NO: 46814

SEQ ID NO: 49590 - DNA, 888 bp, Agrobacterium tumefaciens str. C58; identical to SEQ ID NO: 46815
  CDS (1)..(888)

SEQ ID NO: 49591 - protein, 295 aa, Agrobacterium tumefaciens str. C58; identical to SEQ ID NO: 46816

SEQ ID NO: 49592 - DNA, 945 bp, Brucella melitensis 16M; identical to SEQ ID NO: 46817
  CDS (1)..(945)

SEQ ID NO: 49593 - protein, 314 aa, Brucella melitensis 16M; identical to SEQ ID NO: 46818

SEQ ID NO: 49594 - DNA, 885 bp, Clostridium perfringens str. 13; identical to SEQ ID NO: 46819
  CDS (1)..(885)

SEQ ID NO: 49595 - protein, 294 aa, Clostridium perfringens str. 13; identical to SEQ ID NO: 46820

SEQ ID NO: 49596 - DNA, 879 bp, Fusobacterium nucleatum subsp. nucleatum ATCC 25586; identical to SEQ ID NO: 46821
  CDS (1)..(879)

SEQ ID NO: 49597 - protein, 292 aa, Fusobacterium nucleatum subsp. nucleatum ATCC 25586; identical to SEQ ID NO: 46822

SEQ ID NO: 49598 - DNA, 873 bp, Thermoanaerobacter tengcongensis MB4; identical to SEQ ID NO: 46823
  CDS (1)..(873)

SEQ ID NO: 49599 - protein, 290 aa, Thermoanaerobacter tengcongensis MB4; identical to SEQ ID NO: 46824

SEQ ID NO: 49600 - DNA, 888 bp, Chlorobium tepidum TLS; identical to SEQ ID NO: 46825
  CDS (1)..(888)

SEQ ID NO: 49601 - protein, 295 aa, Chlorobium tepidum TLS; identical to SEQ ID NO: 46826

SEQ ID NO: 49602 - DNA, 864 bp, Yersinia pestis KIM; identical to SEQ ID NO: 46827
  CDS (1)..(864)

SEQ ID NO: 49603 - protein, 287 aa, Yersinia pestis KIM; identical to SEQ ID NO: 46828

SEQ ID NO: 49604 - DNA, 900 bp, Brucella suis 1330; identical to SEQ ID NO: 46829
  CDS (1)..(900)

SEQ ID NO: 49605 - protein, 299 aa, Brucella suis 1330; identical to SEQ ID NO: 46830

SEQ ID NO: 49606 - DNA, 864 bp, Shewanella oneidensis MR-1; identical to SEQ ID NO: 46831
  CDS (1)..(864)

SEQ ID NO: 49607 - protein, 287 aa, Shewanella oneidensis MR-1; identical to SEQ ID NO: 46832

SEQ ID NO: 49608 - DNA, 951 bp, Pseudomonas putida KT2440; identical to SEQ ID NO: 46833
  CDS (1)..(951)

SEQ ID NO: 49609 - protein, 316 aa, Pseudomonas putida KT2440; identical to SEQ ID NO: 46834

SEQ ID NO: 49610 - DNA, 888 bp, Bradyrhizobium japonicum USDA 110; identical to SEQ ID NO: 46835
  CDS (1)..(888)

SEQ ID NO: 49611 - protein, 295 aa, Bradyrhizobium japonicum USDA 110; identical to SEQ ID NO: 46836

SEQ ID NO: 49612 - DNA, 864 bp, Xylella fastidiosa Temecula1; identical to SEQ ID NO: 46837
  CDS (1)..(864)

SEQ ID NO: 49613 - protein, 287 aa, Xylella fastidiosa Temecula1; identical to SEQ ID NO: 46838

SEQ ID NO: 49614 - DNA, 888 bp, Clostridium tetani E88; identical to SEQ ID NO: 46839
  CDS (1)..(888)

SEQ ID NO: 49615 - protein, 295 aa, Clostridium tetani E88; identical to SEQ ID NO: 46840

SEQ ID NO: 49616 - DNA, 867 bp, Vibrio parahaemolyticus RIMD 2210633; identical to SEQ ID NO: 46841
  CDS (1)..(867)

SEQ ID NO: 49617 - protein, 288 aa, Vibrio parahaemolyticus RIMD 2210633; identical to SEQ ID NO: 46842

SEQ ID NO: 49618 - DNA, 867 bp, Bacteroides thetaiotaomicron VPI-5482; identical to SEQ ID NO: 46843
  CDS (1)..(867)

SEQ ID NO: 49619 - protein, 288 aa, Bacteroides thetaiotaomicron VPI-5482; identical to SEQ ID NO: 46844

SEQ ID NO: 49620 - DNA, 885 bp, Enterococcus faecalis V583; identical to SEQ ID NO: 46845
  CDS (1)..(885)

SEQ ID NO: 49621 - protein, 294 aa, Enterococcus faecalis V583; identical to SEQ ID NO: 46846

SEQ ID NO: 49622 - DNA, 864 bp, Coxiella burnetii RSA 493; identical to SEQ ID NO: 46847
  CDS (1)..(864)

SEQ ID NO: 49623 - protein, 287 aa, Coxiella burnetii RSA 493; identical to SEQ ID NO: 46848

SEQ ID NO: 49624 - DNA, 876 bp, Bacillus cereus ATCC 14579; identical to SEQ ID NO: 46849
  CDS (1)..(876)

SEQ ID NO: 49625 - protein, 291 aa, Bacillus cereus ATCC 14579; identical to SEQ ID NO: 46850

SEQ ID NO: 49626 - DNA, 867 bp, Nitrosomonas europaea ATCC 19718; identical to SEQ ID NO: 46851
  CDS (1)..(867)

SEQ ID NO: 49627 - protein, 288 aa, Nitrosomonas europaea ATCC 19718; identical to SEQ ID NO: 46852

SEQ ID NO: 49628 - DNA, 1029 bp, Rhodopirellula baltica SH 1; identical to SEQ ID NO: 46853
  CDS (1)..(1029)

SEQ ID NO: 49629 - protein, 342 aa, Rhodopirellula baltica SH 1; identical to SEQ ID NO: 46854

SEQ ID NO: 49630 - DNA, 864 bp, Wigglesworthia glossinidia endosymbiont of Glossina brevipalpis; identical to SEQ ID NO: 46855
  CDS (1)..(864)

SEQ ID NO: 49631 - protein, 287 aa, Wigglesworthia glossinidia endosymbiont of Glossina brevipalpis; identical to SEQ ID NO: 46856

SEQ ID NO: 49632 - DNA, 873 bp, Candidatus Blochmannia floridanus; identical to SEQ ID NO: 46857
  CDS (1)..(873)

SEQ ID NO: 49633 - protein, 290 aa, Candidatus Blochmannia floridanus; identical to SEQ ID NO: 46858

SEQ ID NO: 49634 - DNA, 927 bp, Bordetella bronchiseptica RB50; identical to SEQ ID NO: 46859
  CDS (1)..(927)

SEQ ID NO: 49635 - protein, 308 aa, Bordetella bronchiseptica RB50; identical to SEQ ID NO: 46860

SEQ ID NO: 49636 - DNA, 867 bp, Chromobacterium violaceum ATCC 12472; identical to SEQ ID NO: 46861
  CDS (1)..(867)

SEQ ID NO: 49637 - protein, 288 aa, Chromobacterium violaceum ATCC 12472; identical to SEQ ID NO: 46862

SEQ ID NO: 49638 - DNA, 891 bp, Porphyromonas gingivalis W83; identical to SEQ ID NO: 46863
  CDS (1)..(891)

SEQ ID NO: 49639 - protein, 296 aa, Porphyromonas gingivalis W83; identical to SEQ ID NO: 46864

SEQ ID NO: 49640 - DNA, 864 bp, Photorhabdus luminescens subsp. laumondii TTO1; identical to SEQ ID NO: 46865
  CDS (1)..(864)

SEQ ID NO: 49641 - protein, 287 aa, Photorhabdus luminescens subsp. laumondii TTO1; identical to SEQ ID NO: 46866

SEQ ID NO: 49642 - DNA, 888 bp, Rhodopseudomonas palustris CGA009; identical to SEQ ID NO: 46867
  CDS (1)..(888)

SEQ ID NO: 49643 - protein, 295 aa, Rhodopseudomonas palustris CGA009; identical to SEQ ID NO: 46868

SEQ ID NO: 49644 - DNA, 879 bp, Bdellovibrio bacteriovorus HD100; identical to SEQ ID NO: 46869
  CDS (1)..(879)

SEQ ID NO: 49645 - protein, 292 aa, Bdellovibrio bacteriovorus HD100; identical to SEQ ID NO: 46870

SEQ ID NO: 49646 - DNA, 867 bp, Treponema denticola ATCC 35405; identical to SEQ ID NO: 46871
  CDS (1)..(867)

SEQ ID NO: 49647 - protein, 288 aa, Treponema denticola ATCC 35405; identical to SEQ ID NO: 46872

SEQ ID NO: 49648 - DNA, 885 bp, Parachlamydia sp. UWE25; identical to SEQ ID NO: 46873
  CDS (1)..(885)

SEQ ID NO: 49649 - protein, 294 aa, Parachlamydia sp. UWE25; identical to SEQ ID NO: 46874

SEQ ID NO: 49650 - DNA, 882 bp, Desulfovibrio vulgaris subsp. vulgaris str. Hildenborough; identical to SEQ ID NO: 46875
  CDS (1)..(882)

SEQ ID NO: 49651 - protein, 293 aa, Desulfovibrio vulgaris subsp. vulgaris str. Hildenborough; identical to SEQ ID NO: 46876

SEQ ID NO: 49652 - DNA, 864 bp, Erwinia carotovora subsp. atroseptica SCRI1043; identical to SEQ ID NO: 46877
  CDS (1)..(864)

SEQ ID NO: 49653 - protein, 287 aa, Erwinia carotovora subsp. atroseptica SCRI1043; identical to SEQ ID NO: 46878

SEQ ID NO: 49654 - DNA, 894 bp, Desulfotalea psychrophila LSv54; identical to SEQ ID NO: 46879
  CDS (1)..(894)

SEQ ID NO: 49655 - protein, 297 aa, Desulfotalea psychrophila LSv54; identical to SEQ ID NO: 46880

SEQ ID NO: 49656 - DNA, 870 bp, Borrelia garinii PBi; identical to SEQ ID NO: 46881
  CDS (1)..(870)

SEQ ID NO: 49657 - protein, 289 aa, Borrelia garinii PBi; identical to SEQ ID NO: 46882

SEQ ID NO: 49658 - DNA, 879 bp, Symbiobacterium thermophilum IAM 14863; identical to SEQ ID NO: 46883
  CDS (1)..(879)

SEQ ID NO: 49659 - protein, 292 aa, Symbiobacterium thermophilum IAM 14863; identical to SEQ ID NO: 46884

SEQ ID NO: 49660 - DNA, 864 bp, Mannheimia succiniciproducens MBEL55E; identical to SEQ ID NO: 46885
  CDS (1)..(864)

SEQ ID NO: 49661 - protein, 287 aa, Mannheimia succiniciproducens MBEL55E; identical to SEQ ID NO: 46886

SEQ ID NO: 49662 - DNA, 876 bp, Bacillus licheniformis ATCC 14580; identical to SEQ ID NO: 46887
  CDS (1)..(876)

SEQ ID NO: 49663 - protein, 291 aa, Bacillus licheniformis ATCC 14580; identical to SEQ ID NO: 46888

SEQ ID NO: 49664 - DNA, 870 bp, Methylococcus capsulatus str. Bath; identical to SEQ ID NO: 46889
  CDS (1)..(870)

SEQ ID NO: 49665 - protein, 289 aa, Methylococcus capsulatus str. Bath; identical to SEQ ID NO: 46890

SEQ ID NO: 49666 - DNA, 867 bp, Legionella pneumophila str. Paris; identical to SEQ ID NO: 46891
  CDS (1)..(867)

SEQ ID NO: 49667 - protein, 288 aa, Legionella pneumophila str. Paris; identical to SEQ ID NO: 46892

SEQ ID NO: 49668 - DNA, 864 bp, Photobacterium profundum SS9; identical to SEQ ID NO: 46893
  CDS (1)..(864)

SEQ ID NO: 49669 - protein, 287 aa, Photobacterium profundum SS9; identical to SEQ ID NO: 46894

SEQ ID NO: 49670 - DNA, 876 bp, Geobacillus kaustophilus HTA426; identical to SEQ ID NO: 46895
  CDS (1)..(876)

SEQ ID NO: 49671 - protein, 291 aa, Geobacillus kaustophilus HTA426; identical to SEQ ID NO: 46896

SEQ ID NO: 49672 - DNA, 864 bp, Idiomarina loihiensis L2TR; identical to SEQ ID NO: 46897
  CDS (1)..(864)

SEQ ID NO: 49673 - protein, 287 aa, Idiomarina loihiensis L2TR; identical to SEQ ID NO: 46898

SEQ ID NO: 49674 - DNA, 867 bp, Azoarcus sp. EbN1; identical to SEQ ID NO: 46899
  CDS (1)..(867)

SEQ ID NO: 49675 - protein, 288 aa, Azoarcus sp. EbN1; identical to SEQ ID NO: 46900

SEQ ID NO: 49676 - DNA, 891 bp, Silicibacter pomeroyi DSS-3; identical to SEQ ID NO: 46901
  CDS (1)..(891)

SEQ ID NO: 49677 - protein, 296 aa, Silicibacter pomeroyi DSS-3; identical to SEQ ID NO: 46902

SEQ ID NO: 49678 - DNA, 891 bp, Rhodobacter sphaeroides 2.4.1; identical to SEQ ID NO: 46903
  CDS (1)..(891)

SEQ ID NO: 49679 - protein, 296 aa, Rhodobacter sphaeroides 2.4.1; identical to SEQ ID NO: 46904

SEQ ID NO: 49680 - DNA, 870 bp, Desulfitobacterium hafniense DCB-2; identical to SEQ ID NO: 46905
  CDS (1)..(870)

SEQ ID NO: 49681 - protein, 289 aa, Desulfitobacterium hafniense DCB-2; identical to SEQ ID NO: 46906

SEQ ID NO: 49682 - DNA, 864 bp, Actinobacillus pleuropneumoniae serovar 1 str. 4074; identical to SEQ ID NO: 46907
  CDS (1)..(864)

SEQ ID NO: 49683 - protein, 287 aa, Actinobacillus pleuropneumoniae serovar 1 str. 4074; identical to SEQ ID NO: 46908

SEQ ID NO: 49684 - DNA, 855 bp, Dechloromonas aromatica RCB; identical to SEQ ID NO: 46909
  CDS (1)..(855)

SEQ ID NO: 49685 - protein, 284 aa, Dechloromonas aromatica RCB; identical to SEQ ID NO: 46910

SEQ ID NO: 49686 - DNA, 867 bp, Methylobacillus flagellatus KT; identical to SEQ ID NO: 46911
  CDS (1)..(867)

SEQ ID NO: 49687 - protein, 288 aa, Methylobacillus flagellatus KT; identical to SEQ ID NO: 46912

SEQ ID NO: 49688 - DNA, 900 bp, Magnetospirillum magnetotacticum MS-1; identical to SEQ ID NO: 46913
  CDS (1)..(900)

SEQ ID NO: 49689 - protein, 299 aa, Magnetospirillum magnetotacticum MS-1; identical to SEQ ID NO: 46914

SEQ ID NO: 49690 - DNA, 822 bp, Rubrivivax gelatinosus PM1; identical to SEQ ID NO: 46915
  CDS (1)..(822)

SEQ ID NO: 49691 - protein, 273 aa, Rubrivivax gelatinosus PM1; identical to SEQ ID NO: 46916

SEQ ID NO: 49692 - DNA, 888 bp, Rhodospirillum rubrum; identical to SEQ ID NO: 46917
  CDS (1)..(888)

SEQ ID NO: 49693 - protein, 295 aa, Rhodospirillum rubrum; identical to SEQ ID NO: 46918

SEQ ID NO: 49694 - DNA, 936 bp, Ralstonia metallidurans CH34; identical to SEQ ID NO: 46919
  CDS (1)..(936)

SEQ ID NO: 49695 - protein, 311 aa, Ralstonia metallidurans CH34; identical to SEQ ID NO: 46920

SEQ ID NO: 49696 - DNA, 924 bp, Burkholderia fungorum LB400; identical to SEQ ID NO: 46921
  CDS (1)..(924)

SEQ ID NO: 49697 - protein, 307 aa, Burkholderia fungorum LB400; identical to SEQ ID NO: 46922

SEQ ID NO: 49698 - DNA, 882 bp, Enterococcus faecium; identical to SEQ ID NO: 46923
  CDS (1)..(882)

SEQ ID NO: 49699 - protein, 293 aa, Enterococcus faecium; identical to SEQ ID NO: 46924

SEQ ID NO: 49700 - DNA, 888 bp, Magnetococcus sp. MC-1; identical to SEQ ID NO: 46925
  CDS (1)..(888)

SEQ ID NO: 49701 - protein, 295 aa, Magnetococcus sp. MC-1; identical to SEQ ID NO: 46926

SEQ ID NO: 49702 - DNA, 879 bp, Geobacter metallireducens GS-15; identical to SEQ ID NO: 46927
  CDS (1)..(879)

SEQ ID NO: 49703 - protein, 292 aa, Geobacter metallireducens GS-15; identical to SEQ ID NO: 46928

SEQ ID NO: 49704 - DNA, 870 bp, Cytophaga hutchinsonii; identical to SEQ ID NO: 46929
  CDS (1)..(870)

SEQ ID NO: 49705 - protein, 289 aa, Cytophaga hutchinsonii; identical to SEQ ID NO: 46930

SEQ ID NO: 49706 - DNA, 885 bp, Clostridium thermocellum ATCC 27405; identical to SEQ ID NO: 46931
  CDS (1)..(885)

SEQ ID NO: 49707 - protein, 294 aa, Clostridium thermocellum ATCC 27405; identical to SEQ ID NO: 46932

SEQ ID NO: 49708 - DNA, 855 bp, Microbulbifer degradans 2-40; identical to SEQ ID NO: 46933
  CDS (1)..(855)

SEQ ID NO: 49709 - protein, 284 aa, Microbulbifer degradans 2-40; identical to SEQ ID NO: 46934

SEQ ID NO: 49710 - DNA, 879 bp, Moorella thermoacetica ATCC 39073; identical to SEQ ID NO: 46935
  CDS (1)..(879)

SEQ ID NO: 49711 - protein, 292 aa, Moorella thermoacetica ATCC 39073; identical to SEQ ID NO: 46936

SEQ ID NO: 49712 - DNA, 867 bp, Thiobacillus denitrificans ATCC 25259; identical to SEQ ID NO: 46937
  CDS (1)..(867)

SEQ ID NO: 49713 - protein, 288 aa, Thiobacillus denitrificans ATCC 25259; identical to SEQ ID NO: 46938

SEQ ID NO: 49714 - DNA, 882 bp, Silicibacter sp. TM1040; identical to SEQ ID NO: 46939
  CDS (1)..(882)

SEQ ID NO: 49715 - protein, 293 aa, Silicibacter sp. TM1040; identical to SEQ ID NO: 46940

SEQ ID NO: 49716 - DNA, 873 bp, Azotobacter vinelandii; identical to SEQ ID NO: 46941
  CDS (1)..(873)

SEQ ID NO: 49717 - protein, 290 aa, Azotobacter vinelandii; identical to SEQ ID NO: 46942

SEQ ID NO: 49718 - DNA, 903 bp, Polaromonas sp. JS666; identical to SEQ ID NO: 46943
  CDS (1)..(903)

SEQ ID NO: 49719 - protein, 300 aa, Polaromonas sp. JS666; identical to SEQ ID NO: 46944

SEQ ID NO: 49720 - DNA, 864 bp, Haemophilus influenzae; identical to SEQ ID NO: 46945
  CDS (1)..(864)

SEQ ID NO: 49721 - protein, 287 aa, Haemophilus influenzae; identical to SEQ ID NO: 46946

SEQ ID NO: 49722 - DNA, 22 bp, Primer
atgatccgcagtatgaccgcct

SEQ ID NO: 49723 - DNA, 24 bp, Primer
ttattcgatgttctgaatctgctc

SEQ ID NO: 49724 - protein, 338 aa, consensus; identical to SEQ ID NO: 46949
  MISC_FEATURE (1)..(338): consensus for the disclosure of xaa see table XV

SEQ ID NO: 49725 - protein, 73 aa, consensus; identical to SEQ ID NO: 46950
  MISC_FEATURE (1)..(73): consensus for the disclosure of xaa see table XV

SEQ ID NO: 49726 - protein, 101 aa, consensus; identical to SEQ ID NO: 46951
  MISC_FEATURE (1)..(101): consensus for the disclosure of xaa see table XV

SEQ ID NO: 49727 - DNA, 2391 bp, Escherichia coli
  CDS (1)..(2391)
atggcaattaacaatacaggctcgcgacgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctatacgcagccctgctgctcggcaccatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggagatcaacggcaccttaagcgccgatgccacacctgctgaagctatctcccccgtagccgatcaggactggcctgcctatggtcgtaatcaggaaggtcaacgcttttcgccgctgaaacaaattaacgccgataacgtccataatctgaaagaagcctgggtgttccgtactggcgatgtgaagcagccgaacgatccgggtgaaatcaccaatgaagtgacgccgattaaagtgggcgacaccctttacctgtgtaccgctcaccagcgcctgtttgcgcttgatgccgccagcggcaaagagaaatggcattacgatcctgagctgaaaaccaacgagtctttccagcacgtaacctgccgtggtgtctcttatcatgaagccaaagcagaaaccgcttcgccggaagtgatggcggattgcccgcgtcgtatcattcttccggtcaatgatggtcgactgattgcgattaacgctgaaaacggcaaactgtgcgaaaccttcgccaataaaggcgtgctcaatctgcaaagcaatatgccagacaccaaaccgggtctgtatgaaccgacttcgccaccgattatcaccgataaaaccatcgtgatggccggttcagttaccgataacttctcaacccgcgaaacgtctggcgtgatccgtggttttgatgtcaacaccggggagctgctgtgggcttttgatcccggcgcgaaagatccgaacgcaatcccgtctgacgaacacacctttacctttaactcgccaaactcctgggcaccagcggcctatgacgcgaagctggatctggtctatctgccgatgggcgtgaccacgccggatatctggggcggtaaccgcacaccggaacaggaacgttatgccagctcgattctggcgctgaatgccactaccgggaaactggcgtggagctaccagaccgttcaccacgacctgtgggacatggatcttccggcacagccgacgctggcggacatcaccgttaatggtcagaaagtgccagttatttacgctccggcgaaaaccggcaacatttttgtgctcgatcgtcgtaatggcgaactggtggttccggcaccggaaaaaccggttccccaaggtgcagcgaaaggcgattacgtaaccccaactcaaccgttttctgaactgagcttccgtccgacgaaagatttgagcggtgcggatatgtggggagccaccatgtttgaccaactggtgtgccgcgtgatgttccaccagatgcgctatgaaggcattttcaccccgccatctgaacagggtacgctggtcttcccgggtaacctggggatgttcgaatggggcgggatttccgttgatccaaatcgtgaagtggcgattgccaacccaatggcactgccgtttgtttcgaaactgatcccgcgtggtcctggcaacccgatggagcagccgaaagatgccaaaggcacgggtacggaatccggcattcagccacagtacggtgtaccgtatggtgtcacgctcaacccgttcctctcaccatttggtctgccatgtaaacagccagcatggggttatatctcggcgctggatctgaaaactaatgaagtggtgtggaagaaacgtattggtacgccgcaggacagtatgccgttcccgatgccggttccggtgccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggtaagcagtatgtggtgatctccgcaggcggtcacggttcatttggtacgaagatgggcgactatattgtggcttatgcgctgccggatgatgtgaagtaa

SEQ ID NO: 49728 - protein, 796 aa, Escherichia coli
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 49729 - DNA, 2427 bp, Gluconobacter oxydans 621H
  CDS (1)..(2427)
atgagcacaacatcccggccagggctctgggccctgattacggccgcggtattcgcgctttgcggcgcgatccttaccgttggcggcgcatgggtcgctgccatcggcggccctctctattatgtcatccttggcctggcacttctcgccacggctttcctctcattcaggcgcaacccggctgccctctacctgttcgcagtcgtcgtcttcggaacggtcatctgggaactcaccgttgtcggtctcgacatctgggccctgatcccgcgctcggacatcgtcatcatcctcggcatctggctgctgttgccgttcgtctcccgccagatcggcggcacgcggacgaccgtcctgccgctcgccggtgccgttggcgttgcggttctggcgctgttcgccagcctcttcaccgacccgcatgacatcagtggcgacctgccgacgcagatcgcaaacgcctcccccgccgacccggacaacgtcccggccagcgagtggcacgcctatggtcgtacgcaggccggtgaccgctggtccccgctgaaccagatcaacgcgtccaacgtcagcaacctcaaggtcgcatggcatatccacaccaaggatatgatgaactccaacgacccgggcgaagcgacgaacgaagcgaccccgatcgagttcaacaacacgctttatatgtgctcgctgcaccagaagctgtttgcggttgatggtgccaccggtaacgtcaagtgggtctacgatccgaagctccagatcaaccctggcttccagcatctgacctgccgtggcgtcagcttccacgaaacgccggccaatgccacggattccgatggcaatcctgctccgacggactgcgccaagcgcatcatcctgccggtcaatgatggccgtctggttgaagtcgatgccgacacgggcaagacctgctccggcttcggcaacaatggcgagatcgatctgcgcgttccgaaccagccttacacgacgcccggccagtacgagccgacgtccccgccggtcatcacggacaagctgatcatcgccaacagcgccatcaccgataacggttcggtcaagcaggcttcgggcgccacgcaggcattcgacgtctacaccggcaagcgtgtctgggtgttcgatgcgtccaacccggacccgaaccagcttccggatgacagccaccctgtcttccacccgaactccccgaactcctggatcgtgtcgtcttacgacaggaacctgaacctcgtgtacatcccgatgggcgtgggtactcccgatcagtggggcggtgaccgcacgaaggattccgagcgtttcgctccgggtatcgttgctctgaacgcagacacgggcaagctcgcctggttctaccagaccgttcatcacgatctgtgggacatggacgttccgtcacagccgagcctcgtggacgtaacgcagaaggacggcacgcttgttccggccatctacgctccgaccaagaccggcgacatcttcgtcctcgaccgtcgtaccggcaaggaaatcgtcccggctccggaaaccccggttccccagggcgccgctccgggcgatcacaccagcccgacccagccgatgtcgcagctgaccctgcgtccgaagaacccgctgaacgactccgatatctggggcggcacgatcttcgaccagatgttctgcagcatctatttccacaccctgcgctacgaaggccccttcacgccgccgtcgctcaagggctcgctcatcttcccgggcgatctgggaatgttcgagtggggtggtctggccgtcgatccgcagcgtcaggtggctttcgccaacccgatctccctgccgttcgtctcccagcttgttccccgtggaccgggcaacccgctctggcctgaaaaggacgccaagggtacgggtggtgaaaccggcctgcagcacaactatggcattccgtatgccgtcaacctgcatccgttcctggatccggtgctgctgccgttcggcatcaagatgccctgccgtacgccgccctggggctatgtcgccggtattgacctgaagaccaacaaggtcgtctggcagcaccgcaacggcaccctgcgtgactcgatgtatggcagctccctgccgatcccgctgccgccgatcaagatcggtgtcccgagcctcggtggcccgctctccacggctggcaacctcggcttcctgacggcgtccatggattactacatccgtgcgtacaacctgacgacgggcaaggtgctgtggcaggaccgtctgccggctggcgcccaggcaacgccgatcacctatgccatcaacggcaagcagtacatcgtgacctatgcaggcggacacaactcgttcccgacccgcatgggcgacgacatcatcgcctacgccctgcccgatcagaaatga

SEQ ID NO: 49730 - protein, 808 aa, Gluconobacter oxydans 621H
MSTTSRPGLWALITAAVFALCGAILTVGGAWVAAIGGPLYYVILGLALLATAFLSFRRNPAALYLFAVVVFGTVIWELTVVGLDIWALIPRSDIVIILGIWLLLPFVSRQIGGTRTTVLPLAGAVGVAVLALFASLFTDPHDISGDLPTQIANASPADPDNVPASEWHAYGRTQAGDRWSPLNQINASNVSNLKVAWHIHTKDMMNSNDPGEATNEATPIEFNNTLYMCSLHQKLFAVDGATGNVKWVYDPKLQINPGFQHLTCRGVSFHETPANATDSDGNPAPTDCAKRIILPVNDGRLVEVDADTGKTCSGFGNNGEIDLRVPNQPYTTPGQYEPTSPPVITDKLIIANSAITDNGSVKQASGATQAFDVYTGKRVWVFDASNPDPNQLPDDSHPVFHPNSPNSWIVSSYDRNLNLVYIPMGVGTPDQWGGDRTKDSERFAPGIVALNADTGKLAWFYQTVHHDLWDMDVPSQPSLVDVTQKDGTLVPAIYAPTKTGDIFVLDRRTGKEIVPAPETPVPQGAAPGDHTSPTQPMSQLTLRPKNPLNDSDIWGGTIFDQMFCSIYFHTLRYEGPFTPPSLKGSLIFPGDLGMFEWGGLAVDPQRQVAFANPISLPFVSQLVPRGPGNPLWPEKDAKGTGGETGLQHNYGIPYAVNLHPFLDPVLLPFGIKMPCRTPPWGYVAGIDLKTNKVVWQHRNGTLRDSMYGSSLPIPLPPIKIGVPSLGGPLSTAGNLGFLTASMDYYIRAYNLTTGKVLWQDRLPAGAQATPITYAINGKQYIVTYAGGHNSFPTRMGDDIIAYALPDQK

SEQ ID NO: 49731 - DNA, 2172 bp, Gluconobacter oxydans 621H
  CDS (1)..(2172)
atgctgctgccatgggtgtggcgcaccggtcataactgggtgtcggacaagcgcgaactgctcggctctgccgccatcgcaatggttgcgatcattgcgagctgcttcacgtcctattccatcaacggcacgcttcccgcggaccgcatggcggcgacaggtcagtccgacctgacggccaaggacactccggaagccgactggccggcctatggccgtacggtgggcggtgaccgctacagcccgctggcacagatcacgccggcgaatgtcagcagcctcaagcgcgcctgggtaacccgcacgggtgacgtccagaaggccgacgaaggtgtggttgccggaccggatcagggccacgagttcaacctcgaagtcaccccgatcaaggtcgatgacacgctctatctctgcacgccgcataactgggtcatggcgctcgatgcccggaccggcaaggtgaagtggaagttcgatcccaagccggccgctgccgatctggccgcgaacgtctatctggcctgccgtggcgtctcctactacaaggccgctgacgactatcaggctccggacgggtccaaggcctgccagaagcgcatcttctcccccgttggcgacgtgcgcctgctggctgtcgatgccgaaaccggcaagccctgcgaagacttcggcgagcacggcttcatctccctgcgccagtatctcggtcatgttccgcatggtttccacttcgtgacgtcgccgccgctggtggtgaaggatcgtgtggttctgggcggctggatcttcgacaaccaggcgaatttcgagccctccggtgcaatccgtgcgttcaacccgatcacgggcgaaatcgaatgggcctgggatgccggtcacaacccggaaaactggaagcccggcccgaacgacgagctgacgcgtgacacgccgaacgcctggggcgtttacacggctgatccggatctgggtctgctctacatcccgaccggcaactctccgccggacaactggggtggctcgcgccgtccgttcgacgacgcaacctccagtgccacgatcgctctcgacatcgagacgggtgaacgccgctggaccttccagaccgtgcatcacgatctgtgggacatggatctggccatcggaccgtccatggtcgatctgccgggcccgaatggcgagaacattccggctctgatccagagcacgaagcgcggtgagttcttcgttctggaccgtcgcaccggcaagccggttccgggttacccggttgaggaacgtccggttccgaccgcaggtgttgcagcggatgaccatgtctccccgacgcagcctttcgctgtcggtctgccgtccctgacgccgccggacctcaaggaaagcgacatgtggggcgcgacgctgctggatcagatgatctgccgcatccagttccgccagtccgcttacgaaggtcagttcaccccgccgcatgttggcaagacgacgatcgtctatccggcattctatggtgtggttgactggcagggcgcttccatcgatccgcagcgcaaactgctgatcgccaatgcgagctatctgccgttccggatccgtctggagcaccgtcagaaggccgaaaacgccggcatcctgccgaagtggaacggccagggcgacaagccggaagccaagggcgacgctctgagcgtgtccccggattacggtacgccgtatatcgcctacaccagcccgtggctgaacccgctcgagatcccctgcaagggaccggtctggggcaagatcacggccatcgatctggtgaccaagaagatcgtctggcagcaccccgtcggcaccacgcgcgacacgggtcctttccggacgcataacaaccttccgcttccgaccggcatgtacaacatcggcggcagtgtcgtgaccaagggcggcgtcgccttcatgggggctacggccgacgactatctgcgtggctttgacatgtcgaatggcaaggtcatctggcgtgaccgtctgcccgcaggcggacaggctactccaatgtcctatcaaattgacgggaagcagtatgttgtgatcgccgcaggcggtcatgggggccttggcacccgcagcggtgattatatcatcgcttataccctgaacggggaacagggcgcagccgcgcactga

SEQ ID NO: 49732 - protein, 723 aa, Gluconobacter oxydans 621H
MLLPWVWRTGHNWVSDKRELLGSAAIAMVAIIASCFTSYSINGTLPADRMAATGQSDLTAKDTPEADWPAYGRTVGGDRYSPLAQITPANVSSLKRAWVTRTGDVQKADEGVVAGPDQGHEFNLEVTPIKVDDTLYLCTPHNWVMALDARTGKVKWKFDPKPAAADLAANVYLACRGVSYYKAADDYQAPDGSKACQKRIFSPVGDVRLLAVDAETGKPCEDFGEHGFISLRQYLGHVPHGFHFVTSPPLVVKDRVVLGGWIFDNQANFEPSGAIRAFNPITGEIEWAWDAGHNPENWKPGPNDELTRDTPNAWGVYTADPDLGLLYIPTGNSPPDNWGGSRRPFDDATSSATIALDIETGERRWTFQTVHHDLWDMDLAIGPSMVDLPGPNGENIPALIQSTKRGEFFVLDRRTGKPVPGYPVEERPVPTAGVAADDHVSPTQPFAVGLPSLTPPDLKESDMWGATLLDQMICRIQFRQSAYEGQFTPPHVGKTTIVYPAFYGVVDWQGASIDPQRKLLIANASYLPFRIRLEHRQKAENAGILPKWNGQGDKPEAKGDALSVSPDYGTPYIAYTSPWLNPLEIPCKGPVWGKITAIDLVTKKIVWQHPVGTTRDTGPFRTHNNLPLPTGMYNIGGSVVTKGGVAFMGATADDYLRGFDMSNGKVIWRDRLPAGGQATPMSYQIDGKQYVVIAAGGHGGLGTRSGDYIIAYTLNGEQGAAAH

SEQ ID NO: 49733 - DNA, 2232 bp, Gluconobacter oxydans 621H
  CDS (1)..(2232)
atgcgcagatcccatcttctcgccaccgttgcctgtgccacgctggcctgcgcaccgctggctgccaatgcccagttcgcccccgcaggcagcggtggctcgccgacctcctccgtgccgggccccggcaatggcagcggcaattccttcgagccgaccgagaacacgccggccgcgaagagccgcttttccggcccgtccccctatgcgccccaggctccgggtgtgaacgcggccaacctgccggatatcgggtccatggatccgaacgacgttccgcagatggccccgcagcagagtgccagccccgcctccggagactgggccgcctacggccatgacgacagtcagatgcgctattcgccgctgtccgagatcacgccgcagaacgccgatcagctcaaggtcgctttcgtctatcacaccggtagctatccgcgtccgggccagacgaacaaatgggctgccgaaaccaccccgatcaaggtgggtgacggcctctacatgtgctcggcacagaacgacatcatgaagatcgacccggcgacgggtaaggagatctggcgtcacaacatcaacgagaaatacgaagccatcccctacaccgcagcgtgcaagggcgtgacgtatttcacgtcgtctcaggtgcccgaaggccagccctgccataaccgtatccttgaaggcacgctcgacatgcgcctgatcgcggttgatgccgcgaccggcaatctgtgcgaaggcttcggcaatggcggccaggtcaacctgatgcagggtcttggcgaatccgtccccggcttcgtctccatgacgacgccgccgccggtcgtgaacggtgtggttgtggtcaaccacgaagttctcgacggtcagcgccgctgggctccgtcgggtgtgatccgtggctatgatgccgagagcggcaagttcctgtgggcctgggacgtgaaccgccccaacgatcacagccagccgaccggcaacaaccattacagccgtggtacgccgaactcctgggctgcgatgaccggcgacaatgcgctgggcctcgtctacgtcccgaccggcaactcggcttccgattactacagtgccctgcgtagccctgaagaaaacaaggtctcgtccgcagttgtcgcgcttgacgtaaagacgggttcgccgcgctgggtcttccagaccgttcacaaggacgtctgggactatgacatcggctcgcaggccaccctcatggacatgcccggccaggatggtcagcctgttcccgcactcatcatgccgaccaagcgtggccagaccttcgtgctcgaccgtcgtgacggcaagccgatcctgccggtcgaagagcgtcccgctccgtcgccgggcgtgatcccgggcgatccgcgttcgccgacgcagccctggtccacgggaatgccggctctgcgcgtgccggatctgaaagagacggatatgtggggcatgtcccccatcgaccagctcttctgccgtatcaagttccgccgtgcgaactatacgggtgagttcacgccaccgagcgtcgacaagccctggatcgagtatccgggctataacggcggcagcgactggggttccgtgtcctatgacccgcagagcggcatcctgattgcgaactggaacatcaccccgatgtacgaccagctcgtaacccgcaagaaggccgacgaacttggcctgatgccgatcgatgacccgaactacaagccgggtggcggtggcgccgaaggtaacggcgccatggacggcacgccttacggtatcgtcgtgaccccgttctgggatcagtacacgggtatgatgtgcaaccgcccgccctacggcatgatcacggccatcgacatgaagcacggccagaaggtgctgtggcagcacccgctgggaacggcccgcgccaatggtccgtggggcctgccgaccggtcttccctgggaaatcggtacgccgaataatggtggctcggtcgtgacggccggtggcgtggtgttcatcgcggcagctacggataaccagatccgtgccatcgacgagcacaccggcaaggtggtctggagcgcggtcctgccgggcggcggtcaggctaacccgatgacctacgaagccaatggtcatcagtacgtcgccatcatggcgggtggtcatcacttcatgatgacgccggtcagcgatcagctggtggtttacgcactgcctgatcacaagggctga

SEQ ID NO: 49734 - protein, 743 aa, Gluconobacter oxydans 621H
MRRSHLLATVACATLACAPLAANAQFAPAGSGGSPTSSVPGPGNGSGNSFEPTENTPAAKSRFSGPSPYAPQAPGVNAANLPDIGSMDPNDVPQMAPQQSASPASGDWAAYGHDDSQMRYSPLSEITPQNADQLKVAFVYHTGSYPRPGQTNKWAAETTPIKVGDGLYMCSAQNDIMKIDPATGKEIWRHNINEKYEAIPYTAACKGVTYFTSSQVPEGQPCHNRILEGTLDMRLIAVDAATGNLCEGFGNGGQVNLMQGLGESVPGFVSMTTPPPVVNGVVVVNHEVLDGQRRWAPSGVIRGYDAESGKFLWAWDVNRPNDHSQPTGNNHYSRGTPNSWAAMTGDNALGLVYVPTGNSASDYYSALRSPEENKVSSAVVALDVKTGSPRWVFQTVHKDVWDYDIGSQATLMDMPGQDGQPVPALIMPTKRGQTFVLDRRDGKPILPVEERPAPSPGVIPGDPRSPTQPWSTGMPALRVPDLKETDMWGMSPIDQLFCRIKFRRANYTGEFTPPSVDKPWIEYPGYNGGSDWGSVSYDPQSGILIANWNITPMYDQLVTRKKADELGLMPIDDPNYKPGGGGAEGNGAMDGTPYGIVVTPFWDQYTGMMCNRPPYGMITAIDMKHGQKVLWQHPLGTARANGPWGLPTGLPWEIGTPNNGGSVVTAGGVVFIAAATDNQIRAIDEHTGKVVWSAVLPGGGQANPMTYEANGHQYVAIMAGGHHFMMTPVSDQLVVYALPDHKG

SEQ ID NO: 49735 - DNA, 2274 bp, Gluconobacter oxydans 621H
  CDS (1)..(2274)
atgacttctggtctactgacgccgatcaaggttacgaaaaagcgccttctcagctgcgctgccgcgctggcattttcagcagctgtacctgtcgcttttgcgcaggaagataccggcacagcaatcacgagctccgataacggcggccatcccggggactggctgtcctacggccgttcctattccgagcagcgctacagcccgctcgaccagatcaatacggagaatgtcggcaagctgaagctcgcctggcactatgatctggacacgaaccgcggccaggaaggcactcccctgatcgtcaacggcgtcatgtacgccacgaccaactggagcaagatgaaggcgctggatgcagcgaccggcaagctcctgtggtcctacgatccgaaggttccgggcaacatcgccgaccgtggctgctgtgacacggtcagccgtggcgccgcctactggaacggcaaggtctatttcggcacgttcgacggccgtctgatcgcactcgacgccaagaccggcaagctggtctggagcgtctacacgatccccaaggaggcccagctcggccaccagcggtcctacacggttgacggtgccccccgtatcgccaagggcaaggtcctgatcggcaacggtggtgcagaattcggtgcccgcggcttcgtctctgccttcgacgcggaaaccggcaagctcgactggcgcttcttcaccgttccgaaccccgagaacaagccggacggcgcagcttccgacgacatcctgatgtccaaggcctacccgacctggggcaagaacggcgcctggaagcagcagggcggcggcggtaccgtctgggattcgctcgtctatgacccggtgacggacctcgtctacctgggcgtcggcaacggctcgccgtggaactacaagttccgctccgaaggcaagggcgacaacctcttcctgggcagcatcgtcgcgatcaatcctgacaccggcaagtatgtctggcacttccaggaaacgccgatggacgagtgggattacacctccgtccagcagatcatgacgctcgacatgccggtcaacggcgagatgcgccacgtcatcgtgcatgctccgaagaacggcttcttctacatcatcgatgcaaagaccggtaagttcatcaccggcaagccctacacctacgagaactgggccaacggcctggatccggttacgggtcgtccgaactacgtgcctgacgccctgtggaccctgacgggcaagccctggctcggcatcccgggtgagcttggtggccataacttcgccgccatggcctacagcccgaagacgaagctggtctacatcccggcacagcagatcccgctcctgtacgatggccagaaaggcggcttcaaggcgtaccatgacgcctggaacctcggcctcgacatgaacaagatcggtctcttcgacgacaatgatccggagcatgtggccgccaagaaggacttcctgaaggtcctgaagggctggacggttgcctgggatccggaaaagatggctccggccttcacgatcaaccacaagggtccgtggaacggtggtcttctggccacggccggtaacgtgatcttccagggtctggcaaacggcgaattccacgcctacgacgccacgaacggcaacgatctctattccttccccgcacagagcgcgatcatcgctccgccggtgacctatacggccaacggcaagcagtatgtcgcggttgaagtgggctggggtggcatctatccgttcctgtacggcggcgttgcccgcacctcgggctggacggtcaaccactcccgcgtgatcgccttctcgcttgacggcaaggacagcctgccgccgaagaacgagctgggcttcacccccgtcaagccggttccgacctatgacgaggcccgccagaaggacggatacttcatgtatcagacgttctgctcggcctgccatggcgacaacgcgatctccggtggcgttctgcctgaccttcgctggtccggtgctccgcgcggaagggaaagcttctacaagctcgttggtcgcggtgctctgacggcttacggcatggaccgcttcgacacgtccatgacgcctgagcagatcgaggatatccgcaacttcatcgtgaagcgcgcaaacgaatcctacgacgacgaagtcaaggcacgtgaaaactcaactggcgttccgaacgatcagttcctcaatgtcccgcagtccacggccgatgttccgaccgcggatcacccctga

SEQ ID NO: 49736 - protein, 757 aa, Gluconobacter oxydans 621H
MTSGLLTPIKVTKKRLLSCAAALAFSAAVPVAFAQEDTGTAITSSDNGGHPGDWLSYGRSYSEQRYSPLDQINTENVGKLKLAWHYDLDTNRGQEGTPLIVNGVMYATTNWSKMKALDAATGKLLWSYDPKVPGNIADRGCCDTVSRGAAYWNGKVYFGTFDGRLIALDAKTGKLVWSVYTIPKEAQLGHQRSYTVDGAPRIAKGKVLIGNGGAEFGARGFVSAFDAETGKLDWRFFTVPNPENKPDGAASDDILMSKAYPTWGKNGAWKQQGGGGTVWDSLVYDPVTDLVYLGVGNGSPWNYKFRSEGKGDNLFLGSIVAINPDTGKYVWHFQETPMDEWDYTSVQQIMTLDMPVNGEMRHVIVHAPKNGFFYIIDAKTGKFITGKPYTYENWANGLDPVTGRPNYVPDALWTLTGKPWLGIPGELGGHNFAAMAYSPKTKLVYIPAQQIPLLYDGQKGGFKAYHDAWNLGLDMNKIGLFDDNDPEHVAAKKDFLKVLKGWTVAWDPEKMAPAFTINHKGPWNGGLLATAGNVIFQGLANGEFHAYDATNGNDLYSFPAQSAIIAPPVTYTANGKQYVAVEVGWGGIYPFLYGGVARTSGWTVNHSRVIAFSLDGKDSLPPKNELGFTPVKPVPTYDEARQKDGYFMYQTFCSACHGDNAISGGVLPDLRWSGAPRGRESFYKLVGRGALTAYGMDRFDTSMTPEQIEDIRNFIVKRANESYDDEVKARENSTGVPNDQFLNVPQSTADVPTADHP

SEQ ID NO: 49737 - DNA, 2367 bp, Gluconobacter oxydans 621H
  CDS (1)..(2367)
atgaacagcggcccccgcacgctctccatgatcatcgggattctgggcgccctcatggccgccttcctgatcatcgaaggcctccacctcatcatcctcggcggctcatggttctacaccctcgccggcatcgcgctggcagccagcagcgtctacatgatccgtcgcaacatcctctcgacatggatcgccctcggcctgcttgtggcaacagccctgtggtcgctcgccgaagtcggcaccagcttctggcccagcttctcccgcctgatcgtatttctgtgcgtcgccctgatcgcgaccctcatggcgccctggctcagcggccccggccggcgctacttcacccgccccgtcacaggcgccacctccggcgccctcggcgcgatcatcgtggctttcctcgccggcatgttccgggtccaccccaccatcgccccgcaggacaccacccacccgcaggaaaccgcgtccaccgccgactccgaccagccaggccatgactggcccgcctatggccgcacggcgtccggcacgcgctacgccagcttcacgcagatcaaccgcgacaatgtcggcaagctccgcgtcgcctggacctaccgcactggcgacatggcgctgaacggggccgagttccagggcacccccatcaagatcggcgacacggtctatatctgctcgccgcacaacatcgtctcggccctcgaccccgataccggcacggaaaagtggaagttcgacccccacgcccagacgaaagtctggcagcgctgccgcggcgtcggctactggcatgacagcacggccacggacgccaacgcgccctgcgcctcgcgcatcgtcctcaccacgatcgacgcccgcctcatcaccatcgacgcccgcaccggccaggcctgcacggatttcggaacgaacggcaacgtcaatctcctgaccggcctcggcccgacagcccccggttcctactacccgaccgccgcccccctcgtggccggtgacatcgtggtcgtcggcggccgcatcgccgataacgagcgcaccggcgaaccctccggcgtcgtccgcggctatgacgtccgcaccggcgcgcaggtctgggcctgggacgccaccaacccgcatcgcggcaccacaccgctggccgaaggcgagatctatcccgccgaaacccccaacatgtggggcaccgccagctacgacccgaagctcaacctcgtcttcttcccgctcggcaaccagacccccgatttctggggcggcgaccgcagcaaggcttctgatgaatacaacgacgccttcgtcgccgtggacgccaagaccggcgacgaacgctggcacttccgcaccgccaaccacgacctcgtggactacgatgccaccgcccagcccatcctctatgacattccggacggccatggcggcacccgcccggcgatcatcgccatgaccaagcgcggccaaatcttcgtgctcgaccgccgcgacggcaccccgatcgtccccgtggaaatgcgcaaagtcccgcaggacggcgcaccggaacaccagtacctcgcccccgaacagccctattccgccctctccatcggaacagagcgcctgaaacccagcgatatgtggggtggtacgattttcgaccagctcctgtgccgcatccagttcgcctcctaccgctatgaaggcgagttcacccccgtcaacgagaaacaggccaccatcatctatccgggctattacggcggcatcaactggggcggcggcgccgtggatgaaagcaccggaacgctgctggtcaacgacatccgcatggcccagtggggcaagttcatgaagcaggaagaagcccgtcgcagcggcttcaaacccagctcggaaggcgaatattccgaacagaaaggcaccccctggggcgtcgtccgctcgatgttcttctcccccgccggtctcccctgcgtaaaaccgccctatggcacgatgaacgccatcgacctgcgcagcggcaaggtgaaatggagcatgccgcttggcacgatccaggacatgccggtccacggcatggtcccaggcctcgccatcccgctcggaatgccaaccatgagcggcccgctggccacccataccggcttggtcttcttctccggcacgctcgacaactacgtccgcgcgctcaacaccgacaccggcgaggtcgtctggaaagcccgtctccccgtcgcctcacaggccgctccgatgagctacatgtccgacaagaccggcaaacagtacatcgtcgtcaccgcaggcggcctgacccgctccggcgtcgacaaaaaccgcggcgactacgtcatcgcctacgccctgccctccgaagaataa

SEQ ID NO: 49738 - protein, 788 aa, Gluconobacter oxydans 621H
MNSGPRTLSMIIGILGALMAAFLIIEGLHLIILGGSWFYTLAGIALAASSVYMIRRNILSTWIALGLLVATALWSLAEVGTSFWPSFSRLIVFLCVALIATLMAPWLSGPGRRYFTRPVTGATSGALGAIIVAFLAGMFRVHPTIAPQDTTHPQETASTADSDQPGHDWPAYGRTASGTRYASFTQINRDNVGKLRVAWTYRTGDMALNGAEFQGTPIKIGDTVYICSPHNIVSALDPDTGTEKWKFDPHAQTKVWQRCRGVGYWHDSTATDANAPCASRIVLTTIDARLITIDARTGQACTDFGTNGNVNLLTGLGPTAPGSYYPTAAPLVAGDIVVVGGRIADNERTGEPSGVVRGYDVRTGAQVWAWDATNPHRGTTPLAEGEIYPAETPNMWGTASYDPKLNLVFFPLGNQTPDFWGGDRSKASDEYNDAFVAVDAKTGDERWHFRTANHDLVDYDATAQPILYDIPDGHGGTRPAIIAMTKRGQIFVLDRRDGTPIVPVEMRKVPQDGAPEHQYLAPEQPYSALSIGTERLKPSDMWGGTIFDQLLCRIQFASYRYEGEFTPVNEKQATIIYPGYYGGINWGGGAVDESTGTLLVNDIRMAQWGKFMKQEEARRSGFKPSSEGEYSEQKGTPWGVVRSMFFSPAGLPCVKPPYGTMNAIDLRSGKVKWSMPLGTIQDMPVHGMVPGLAIPLGMPTMSGPLATHTGLVFFSGTLDNYVRALNTDTGEVVWKARLPVASQAAPMSYMSDKTGKQYIVVTAGGLTRSGVDKNRGDYVIAYALPSEE

SEQ ID NO: 49739 - DNA, 2358 bp, Mesorhizobium loti MAFF303099
  CDS (1)..(2358)
atggccgcgcgagcgcgcaacagtcgaaggagtatcatcttggctgtcaccatcacctccttcgttctctttctcctcggtctggcgcttggtggcggtggcatctggctggcttcgctggggggcagttggtactacatcgtcgtcggcctcgccttcctgatcgccgcctggctgctctaccggcgccgttccacggcgctctggctctatgcggcgattgtgctcggcacgctggcctgggcggtctgggaaatcggcttcgactggtgggagctcggcccgcgcggcggcatcatcgtgctggtcgggctgtggctgctgacgccgtgggcaaggcggggccttgccgggcctgacgggcgcgcgccgctgatcctggccgtgctggcatcgctggcggtggccggctattcgatgaccgccgacccgaaaggcattgacggcgcgctcgacaccgacaaggtgattcccaaagccaatctgggtaatgatgtgccggctggcgagtggcactattacggacgcacgcagtttggccaacgctattcgccgctcgaccagatcacgccggacaatgtcgccaatctgcagccggcatggacctatcgcaccggcgatgtgaaggggcccgacgacatcggcgagaccacctatcaggtgacgccgctgaagatcggcgacacgctctacatctgcacgccgcataatttcgccatcgcggtggacgccgcgaccggaaaggaaaaatggcgctacgatcccaagatcaagctcgacaaggaccgccagcaccagacctgccgcggcgtgtcctactatgccgataccgccatcgccgccggccagccctgcgcgacccgcatctacctgccgacctcggatgcgcggctgatcgcgctcgacgccgccagcggtcaggtctgtccggccttcgccgagggcggcacgctgaaccttctgaccaacatgccctatccgaaatcgggctactactattcgacctcggcgccgctgatatcaggcagcaagatcatcgtcggcggcgcggtcaacgacaactattcgacgcaggagccgtcgggggtcatccgcgcctatgatgtcggcaccggcgccctggtgtggaagtgggattccggcaacccggaccagacgacgccgctggcggcgggccagacctataccgccaactcgcccaacatgtggtcgacgccgagcgccgacgagaagcttgggctgctctatgtgccactcggcaaccagacgccggaccagctcggcgccgggcgtagcgccaatgtcgagaaattctcctcctcgatcgccgcgctcgacctcaacaccgggcagttgcgctgggtgcggcagaccgtgcaccatgacctctgggacatggacgtgccggcgcagccgagcctgattgacatcaccaaggccgacggcacagtggtgccggcgctggtcgggccgaccaagcagggcgacctctatgtgcttgaccggcgcaccggcgaaccgcttgttgcagtcaaggaagtgccggcgcccggcggcgccgtcgagggcgatcacacgtcgccgacgcaaccggtgtcggatctctccttcagcccgaagccgctgacggatgccgacatgtggggcatcaccatgttcgaccagatggcctgcaggattgccttccacaagctgcgctacgaaggccgttacacgccgccgtcggtgcagggatcgctgatctaccccggcaatttcggagtcttcaactggggcggggtggcagtcgatccggtgcggcaggtgatgttcggcatgccgacctatctggcgtttacgtcgagactcgtgccccgcgcggacgtaccgccgccgggcgatgacaccaagggcagcgagcaggggctgaaccgcaacgagggcgcgccctacgcagtggtgatggggccgttcctgtcgcctctcggcattccctgccaggcgccaccctggggttatgtcgcgggcgcggatctgcggaccggcaccatcgcctacaagcatcgcaacggtaccgtctacgatatgacgccgctgccgctgccgctgaaggtcggcgtgccgggcattggcgggccgatcatcactgccggcggcgtcgccttcctgggtgccgcggtcgacaactatctgcgcgcctatgacctgacgtcgggccggcaactctggcaggccaggctgcccgccggcggccagtcgacgccgatgacctatacggtcgccgacgggcgccagttcgtggtcatcgtcgccggcggccacggctcggtcggcaccaagccgggggattatgtgatggcttacgcgctgccgaaatag

SEQ ID NO: 49740 - protein, 785 aa, Mesorhizobium loti MAFF303099
MAARARNSRRSIILAVTITSFVLFLLGLALGGGGIWLASLGGSWYYIVVGLAFLIAAWLLYRRRSTALWLYAAIVLGTLAWAVWEIGFDWWELGPRGGIIVLVGLWLLTPWARRGLAGPDGRAPLILAVLASLAVAGYSMTADPKGIDGALDTDKVIPKANLGNDVPAGEWHYYGRTQFGQRYSPLDQITPDNVANLQPAWTYRTGDVKGPDDIGETTYQVTPLKIGDTLYICTPHNFAIAVDAATGKEKWRYDPKIKLDKDRQHQTCRGVSYYADTAIAAGQPCATRIYLPTSDARLIALDAASGQVCPAFAEGGTLNLLTNMPYPKSGYYYSTSAPLISGSKIIVGGAVNDNYSTQEPSGVIRAYDVGTGALVWKWDSGNPDQTTPLAAGQTYTANSPNMWSTPSADEKLGLLYVPLGNQTPDQLGAGRSANVEKFSSSIAALDLNTGQLRWVRQTVHHDLWDMDVPAQPSLIDITKADGTVVPALVGPTKQGDLYVLDRRTGEPLVAVKEVPAPGGAVEGDHTSPTQPVSDLSFSPKPLTDADMWGITMFDQMACRIAFHKLRYEGRYTPPSVQGSLIYPGNFGVFNWGGVAVDPVRQVMFGMPTYLAFTSRLVPRADVPPPGDDTKGSEQGLNRNEGAPYAVVMGPFLSPLGIPCQAPPWGYVAGADLRTGTIAYKHRNGTVYDMTPLPLPLKVGVPGIGGPIITAGGVAFLGAAVDNYLRAYDLTSGRQLWQARLPAGGQSTPMTYTVADGRQFVVIVAGGHGSVGTKPGDYVMAYALPK

SEQ ID NO: 49741 - DNA, 2412 bp, Pseudomonas aeruginosa PAO1
  CDS (1)..(2412)
atgagcgaaggtaaccgcagtcgatcgcgcctgctgccgagcctgctcggcctgttgatcctgctgtccggcctggcgctgctggccggcggcatcaagctggcgagcctgggcggctcgctgtactacctgctggccggcatcggcctggccctgagcggactgttgctgctgctgggcaagcgtgcggcgctaggcctgtacgctctggtgctgttcgccagcaccgtctgggcgctgtgggaagtcggcctggactggtggcaactggtgccgcgcctggctctgtggttcgtcttcggcctgctgctctggctaccctggttccgccgcccgctgctggccgacggtccggcgccgctgggcaccgcggcgctgggcgtggcggtggtcctggccggcgccgccgcggtgggcagccagttcaccaatccggggcagatcgtcggtcgcatcgaccgcgacagcggcatgaccagcaccgccccggcgatgccggacggcgactggcaggcctacgggcgcaccgagttcggcgaccgctactcgccgttgaagcagatcaccccggccaacgtcggccagctcgaggaagcctggcgcatccgtaccggcgacctgccgaccgccgacgatccgctcgaactgaccaacgagaacaccccgctgaaggtcaacggcatgctctacgcctgcaccgcgcacagcaaggtgctggccctcgacccggacaccggcgcggaaatctggcgcttcgatccgcagatccagagcccggtaggcttcaagggcttcgcccacatgacttgccgtggcgtctcctactacgacgaagagcagtacgccaggagcgacgtcggcgcgccgccggccgcgctctccgaggccggcaaggcggtcgccgccagttgtccgcggcgcctgttcctgcccaccgccgacgcccgcctgatcgcgatcaacgccgacaacggcaaggtctgcgaggacttcggggtcaagggcgcggtcgacctgacggccggcatcggtccgttcaccccgggcggctactactccacctcgccggcggcggtcacccgcaatctggtgatcatcggcggccacgtcaccgacaacgagtcgaccaacgagccgtccggggtgatccgcgccttcgacgtgcacgacggcaagctggtgtggaactgggacagcggcaacccggacgagaccgagcccctggcgcccggcaagttctatacccgcaactcgccgaacatgtggtcgctggccagcgtcgacgagaagctcggccaggtctacctgccgctgggcaaccagatgcccgaccagtggggcggcaaccgcacccctggcgccgagaagttcagcgccggcctggtggccctcgacctgaacaccggcaagctgcgctggaactaccagttcacccaccacgacctgtgggacatggacgtcggcagccagccgaccctgctcgacctgaagaccgccgatggcgtcaagccggcgctgatcgcgccgaccaagcagggcagcctgtacgtgctggaccgccgcgacggcacgccgatcgtgccgatccgcgaagtgccggcgccgcagggcgcggtggagggcgaccataccgcgccgacccaggcgcgttccgacctcaacctgctgcgcccgccgctgaccgagcgcgacatgtggggcagcagcccgttcgaccagatgctctgccgcatccagttccgctcgctgcgctacgagggccagtacaccccgccgtcggagcagggcagcctgatctatccgggcaacgtcggagtgttcaactggggcggggtgtcggtcgacccggtgcgccagatcctcttcaccagccccaactacatggccttcgtctcgcagatggtgccgcgcgacaaggtgcccagcggaagcaagcgcgagggcgagaccagcggcgtgcagccgaacaccggcgcgccctacgcggtgatcatgcatccgttcatgtcgcccatcggcctgccgtgccaggcgccgtcctggggtgacgtggcgggtatcgacctgaccaccgccaaggtcgtctggcagcacaagaacggcaccagccgcgacaacaccccggtgccgatcggcctcaccgtcggcgtaccgagcatgggcggctcgatcaccaccgccggcggcgtggccttcctcagcggcacgctcgaccagtacctgcgcgcctacgacgtgaaggacggcaagcagctctggcaggcgcgcctgccggccggcggccaggccacgccgatgagctacaccggcaaggacggtcgccagtacgtgctgatcgtcgctggcggacacggctccttcggtacccgcatgggcgactacatcatcgcctacgccctgcccaggcaatga

SEQ ID NO: 49742 - protein, 803 aa, Pseudomonas aeruginosa PAO1
MSEGNRSRSRLLPSLLGLLILLSGLALLAGGIKLASLGGSLYYLLAGIGLALSGLLLLLGKRAALGLYALVLFASTVWALWEVGLDWWQLVPRLALWFVFGLLLWLPWFRRPLLADGPAPLGTAALGVAVVLAGAAAVGSQFTNPGQIVGRIDRDSGMTSTAPAMPDGDWQAYGRTEFGDRYSPLKQITPANVGQLEEAWRIRTGDLPTADDPLELTNENTPLKVNGMLYACTAHSKVLALDPDTGAEIWRFDPQIQSPVGFKGFAHMTCRGVSYYDEEQYARSDVGAPPAALSEAGKAVAASCPRRLFLPTADARLIAINADNGKVCEDFGVKGAVDLTAGIGPFTPGGYYSTSPAAVTRNLVIIGGHVTDNESTNEPSGVIRAFDVHDGKLVWNWDSGNPDETEPLAPGKFYTRNSPNMWSLASVDEKLGQVYLPLGNQMPDQWGGNRTPGAEKFSAGLVALDLNTGKLRWNYQFTHHDLWDMDVGSQPTLLDLKTADGVKPALIAPTKQGSLYVLDRRDGTPIVPIREVPAPQGAVEGDHTAPTQARSDLNLLRPPLTERDMWGSSPFDQMLCRIQFRSLRYEGQYTPPSEQGSLIYPGNVGVFNWGGVSVDPVRQILFTSPNYMAFVSQMVPRDKVPSGSKREGETSGVQPNTGAPYAVIMHPFMSPIGLPCQAPSWGDVAGIDLTTAKVVWQHKNGTSRDNTPVPIGLTVGVPSMGGSITTAGGVAFLSGTLDQYLRAYDVKDGKQLWQARLPAGGQATPMSYTGKDGRQYVLIVAGGHGSFGTRMGDYIIAYALPRQ

SEQ ID NO: 49743 - DNA, 2334 bp, Sinorhizobium meliloti 1021
  CDS (1)..(2334)
atggtcatcgtcctgaccgccgtcgtcttcgccgtgatcggcctcgccctctgtgggggcggcacgcggctcctgctgctcggcggcagcccgtattatctcatcgccggcttgggctttctgctcaccgcgtttttgctctttcgccgccgcgccgccgcgctttgggtctatgcgctggtcgttctcgggtcgctcgcatgggcgatctgggaggtgggcttcgattggtggcaactcgggcctcggggcggcgtgatcatcctgctcgggctgtggctgctaaccccatggatccggcgacccctcggcttcgtcagccccaccggcgagcaatatggggcaagcgcctggccgcttgcactggtgagcctcctctcggtcggtgtcgccctctattcgatgacgcaggacccccatgacattcgcggcgatctgcccggcgaagtcgcggcgaacgcgaacctcgggggcaacgtaccgccgggcgaatggcaccaatatggtcgcacgcccttcggtcaacgttactccccgctcgaccagatccgtccggaaaacgtcgccaacctgcaggtggcgtggcaataccagaccggagacgtgaagctgcccgaagacgtcagcgaaaccacttatcaggtgacgccgctgaaggtgaaggacacgctctatgtctgcacgccgcacaactgggcgatcgcgctcgacgcagccaccggtcaggagaagtggaaatacgattccaattccggcatgaacccggatcgccagcatcagacctgccgcggcgtcacctattgggccgatccggccgcagcgcccggcagcccctgcgccgagcgcgtctatctgccgacatcggacgcccgcctgatcgcgctcgacgcgacgaatggcgaggtctgcaccagcttcgccgacaacggcgtcctgcatctcgaacagggcatgaagcacaaccccgccggctactactattcgacctcgccgcccgtcgccgtcggcgacaggctcatcatcggcggggcggtcaacgacaactattccaccacggaacagtccggcgtgatccgcgctttcaacatcaacaccggcgcactcatctggaattgggacagcgggaatccggacgtaacggcgcccctccctccgggtcaaacctacaccaccaattcgccaaacagctggtccgtcttcagctatgacgaagggctcggcctcgtctacatccccatgggcaaccaggtgcccgaccagctcggcatgggccgcagcgagcatgtggagaaatactcctcctccatcgtcgccctggacatcaatacgggcgcggtacgctgggtacggcagacggtgcatcacgatctctgggatatggacgtacccgcccaacctgcccttctcgacatcacgagagaggacggaaccgtcgtgccggcactcgtcgggcctaccaagcagggcgacatctatgtgctcgaccggcgaagcggggagccgatcatcccgatcgaggaagtacccgctcccggcggtgcgatccccgaggatttcacggcccccacccagcccgtctcaggtctcaccttcatgcccccgccgctcatggagcgcgacatgtgggggatcagcatgttcgaccagcttgcatgccgcatcgaattcagaacgctgaaatacgagggacgctacacgccgccttccctcgaggggacgatcgtctatcccggcaatttcgggactttcaactggggctccgtcgccgtggatccggagcgccaggtgatgttcgggatgccgacctatctcgccttcacctcgcggctcgttccgcgcgaccagatcgccccgaagggcgaaggcgaaaagggtagcgaacagggcctcaaccgcaatgaaggcgcaccttacggggtctttatgggtccgttcctcggcccgctcgggattccctgccaggcaccgccatggggttatgtcgcaggcgccgatctcagaacgggcaagatcgcctacaagcacaagaacggcacggtctacgacatgacgccgctgccgctgcccttcaagctgggcgttccgggcatcggcggacccatgataaccaagggcgggctcgctttcctgggtgccgcggtcgacgattacttccgggcttacgacctgaccacgggcgaacagctctgggaagcgcggcttccggccggcggccagtcgacgccgatgacctatacggtcggcgagaagcagtatgtcctgatcgtcgcgggcggacacggttcggtcggcaccaagccgggcgactatgtcatcgcctatacgctgccctga

SEQ ID NO: 49744 - protein, 777 aa, Sinorhizobium meliloti 1021
MVIVLTAVVFAVIGLALCGGGTRLLLLGGSPYYLIAGLGFLLTAFLLFRRRAAALWVYALVVLGSLAWAIWEVGFDWWQLGPRGGVIILLGLWLLTPWIRRPLGFVSPTGEQYGASAWPLALVSLLSVGVALYSMTQDPHDIRGDLPGEVAANANLGGNVPPGEWHQYGRTPFGQRYSPLDQIRPENVANLQVAWQYQTGDVKLPEDVSETTYQVTPLKVKDTLYVCTPHNWAIALDAATGQEKWKYDSNSGMNPDRQHQTCRGVTYWADPAAAPGSPCAERVYLPTSDARLIALDATNGEVCTSFADNGVLHLEQGMKHNPAGYYYSTSPPVAVGDRLIIGGAVNDNYSTTEQSGVIRAFNINTGALIWNWDSGNPDVTAPLPPGQTYTTNSPNSWSVFSYDEGLGLVYIPMGNQVPDQLGMGRSEHVEKYSSSIVALDINTGAVRWVRQTVHHDLWDMDVPAQPALLDITREDGTVVPALVGPTKQGDIYVLDRRSGEPIIPIEEVPAPGGAIPEDFTAPTQPVSGLTFMPPPLMERDMWGISMFDQLACRIEFRTLKYEGRYTPPSLEGTIVYPGNFGTFNWGSVAVDPERQVMFGMPTYLAFTSRLVPRDQIAPKGEGEKGSEQGLNRNEGAPYGVFMGPFLGPLGIPCQAPPWGYVAGADLRTGKIAYKHKNGTVYDMTPLPLPFKLGVPGIGGPMITKGGLAFLGAAVDDYFRAYDLTTGEQLWEARLPAGGQSTPMTYTVGEKQYVLIVAGGHGSVGTKPGDYVIAYTLP

SEQ ID NO: 49745 - DNA, 2391 bp, Salmonella typhimurium LT2
  CDS (1)..(2391)
atggcagaaaataacgcacgatcgccacgattactcgtgacgctgacggccctctttgcagcactttgtgggctgtatcttcttatcggaggtgtctggctggttgctattggcggttcctggtactaccccatcgcgggcctcgtgatgctggttgtggccggattgctatggcgcagtaaacgtgccgcactgtggctgtatgccgccctgctgctggcgacaatgatttggggcgtgtgggaagtcgggttcgacttctgggcgctcacgccgcgtagcgatatcctggtgtttttcggcatctggctaatattaccgtttgtctggcatcggctggtggttccttccagtggcgcagtggcggcgctggtcgtggcgttgctgattagcggcggcattctgacctgggccggcttcaacgacccgcaggagatcaacggtacgcttcgcgccgacgccacgcccgccgcaacaagttcgtcgatcgccgacgaagactggccggcctatgggcgcaatcaggaaggccaacgctattcgccgctgaaacagatcactgcggataacgttcaccaactgaaagaagcgtgggtcttccgcaccggcgatctgaaacagcccaacgatccgggtgaaatcaccaacgaagtgaccccgataaaagtcggcgatacgctttatctgtgtacagctcaccagcgtctgttcgcgctggacgccgccagcggtaaagagaagtggcattttgatcctcagttgaagaccgattcgtctttccagcatgtgacctgccgcggcgtctcttatcatgaggccaaagcggataccgcctcgccggaggtcatcgccgactgtccgcgccgtattatcctcccggtcaacgacggtcgccttttcgcggtgaatgccgaaaccggcaagctgtgtgaaaccttcgccaacaaaggcgtcctgaatctgcaaaccaatatgccggataccacaccgggactgtatgaaccgacgtcgccgccgattatcaccgataaaacaattgtcattgccggttcggtcacggataacttctctacccgcgaaacgtccggcgttatccgaggttttgatgttaatagcggtaaactcatgtgggccttcgatccgggggcgaaagatccgaacgcgattccagccgatgagcacgcttttacctttaactcgccgaactcctgggcgcctgccgcctatgatgcgaaactggatctggtctatctgccgatgggcgtgaccacgccggatatctggggcggtaaccgcacgccggagcaggagcgttatgccagctccatcctggcgctgaatgccaccaccgggaaactggcctggagttatcagaccgtccatcacgatctgtgggatatggacctgccggcacagccgacgctggcggatattaccgttgacggtactaccgttccggttatctatgcgccagcgaaaaccggtaatatctttgtgctggacagacgtaatggcgagctggtcgtgcccgccccggaaaaaccggtcccgcagggcgcggcaaaaggcgattacgtcgccaaaactcagccgttctctgatttaaccttccgcccgaaaaaagatctctccggcgcggatatgtggggcgcgaccatgttcgaccaactggtgtgccgcgtcatgttccaccagttgcgctatgaaggtatcttcaccccgccgtccgagcaggggacattggtattccctggcaacctggggatgtttgaatggggcggtatttccgtcgatccagaccgtcaggtcgctatcgctaacccgatggcgctgccgtttgtctcgaagctgatcccacgcggcccgggtaatccaatggagccgccgaaagacgcgaaaggtaccggtacagaagcgggtattcagccacagtacggcgtaccattcggcgtcacgctgaatccgttcctttcgccgtttggcctgccgtgtaaacaaccggcctggggctatatttccgcgttggatctgaagaccaatgaaatcgtgtggaagaaacgtatagggacgccgcgcgacagtatgccgttcccgatgccggttccggtgccgttcaacatggggatgcccatgctgggcgggccaatctcaaccgccggtaatgtgctgttcattgccgcgaccgccgacaactacctgcgcgcttataacatgagcaacggggaaaaactgtggcagggacgtttacccgccggaggccaggcaacgcctatgacctatgaggtaaacggtaagcagtacgtggtcgtttctgccggaggccacggttcgtttggtacgaagatgggcgactatatcgtggcctatgctttgcctgacgacgcgaaataa

SEQ ID NO: 49746 - protein, 796 aa, Salmonella typhimurium LT2
MAENNARSPRLLVTLTALFAALCGLYLLIGGVWLVAIGGSWYYPIAGLVMLVVAGLLWRSKRAALWLYAALLLATMIWGVWEVGFDFWALTPRSDILVFFGIWLILPFVWHRLVVPSSGAVAALVVALLISGGILTWAGFNDPQEINGTLRADATPAATSSSIADEDWPAYGRNQEGQRYSPLKQITADNVHQLKEAWVFRTGDLKQPNDPGEITNEVTPIKVGDTLYLCTAHQRLFALDAASGKEKWHFDPQLKTDSSFQHVTCRGVSYHEAKADTASPEVIADCPRRIILPVNDGRLFAVNAETGKLCETFANKGVLNLQTNMPDTTPGLYEPTSPPIITDKTIVIAGSVTDNFSTRETSGVIRGFDVNSGKLMWAFDPGAKDPNAIPADEHAFTFNSPNSWAPAAYDAKLDLVYLPMGVTTPDIWGGNRTPEQERYASSILALNATTGKLAWSYQTVHHDLWDMDLPAQPTLADITVDGTTVPVIYAPAKTGNIFVLDRRNGELVVPAPEKPVPQGAAKGDYVAKTQPFSDLTFRPKKDLSGADMWGATMFDQLVCRVMFHQLRYEGIFTPPSEQGTLVFPGNLGMFEWGGISVDPDRQVAIANPMALPFVSKLIPRGPGNPMEPPKDAKGTGTEAGIQPQYGVPFGVTLNPFLSPFGLPCKQPAWGYISALDLKTNEIVWKKRIGTPRDSMPFPMPVPVPFNMGMPMLGGPISTAGNVLFIAATADNYLRAYNMSNGEKLWQGRLPAGGQATPMTYEVNGKQYVVVSAGGHGSFGTKMGDYIVAYALPDDAK

SEQ ID NO: 49747 - DNA, 2337 bp, Agrobacterium tumefaciens str. C58
  CDS (1)..(2337)
atggcagtcaccgtcactgcggtcattcttacgctgatcggccttgcgctgttcggcttcggctctcagctcgtcatgttgggcgggagcttttattatcttctttccggactggcctttctgttgacggccgttctgctgttcaagcgcaatcgcgccgcccttcacgtttatgccgttttcattgtcgcgacgcttgcctgggcagtctgggaagtcggatttgactggtggcagcttggaccgcggggcggcgtcattattctcattggtctttggctgctggtgccgtgggtcaggaaaccgcttggcttttcaagcccgaccggtctgagttacagccctaacgcttggccgctggtgctttccgttctcgcctcctttgcagttgccggctactccatggcgcaggacccgcatgatcaggcgggttcgttaccgcaggagatcgcatctgcggcacctgtctatggcggcgaagtgcctgacggtgactggcatcaatatggccgcacaccctatggccagcgttattcgccgctgacgcaggtgaatgtggacaatgtctcgcagttgaaggaagcctggcgttatcagacgggggacgtgaagctgcctgatgatgtgggtgagaccacctatcaggtcacgccactcaagatcggcaatacgctttatatctgcacgccgcataattgggcgatcgccatcgatgccgccaccggcaaggaaaaatggaaatacgaccccaatgtcggtctcaatcctgatcgccagcaccagacgtgccgtggcgtttcctattatgccgaaccgaacgccgctgccggcacggcctgcgcccagcgcgtctacctgccgacctcggacgcgcggctgatcgcgctcgatgcggccaccggccaggtctgcacctcctttgccgatcagggtgtgctgcatcttgaacagggcatgaagtacaatcccgccggttattattattcgacctcgccgccggtcatcgcggctggcaaaatcatcatcggcggcgcggtgaacgacaattattcgacgcaggagcagtccggcgtcatccgcgctttcgatgtgaatagcggtgctctcatctggaactgggattccggcaacccgcagaagaccgagccgatcgcggcgggtgagacctatacgaccaactcacccaacagctggtcggtgctgagttatgacgaaggcctcggcctcgtctacgtgccgcttggcaaccaggtgccggaccagcttggcatgggccgcagcgagaatgtcgagaaatattcctcctcgattgtcgcgctcgatatcaatacgggcaaggaccgctgggtgcgccagacggtacatcacgatctctgggacatggatgtgccggcccagccggtgctgctcgacatcaccaaggatggccagacggttccggccctcgtgggtcccaccaagcagggcgacatctacgtgctcgacaggcgcaccggtgagccgcttctgccgattaccgaggaaccggcgccgaccggagccatccctgaagacttcacatccccgacgcagccaacctcggcgctgtcgttcaagccggaaccgctgcaggaaaagaacatgtggggcgtctccatgttcgaccagctcgcctgccgcatccgcttccatcagctgaattacaagggccgctatacaccgccttcgctcaacggctcgatcatctatcccggcaatttcggcacgttcaactggggcagcgtggcggtcgatcccgagcgtcaggtgatgttcgggatgccaacctatctcgccttcacctcgcagctcgtgccgcgcgccgacattccgccgaagggacaggatgaaaagggcagcgaacagggcctcaaccgcaatgacggtgcgccctatggcgtctttatggggccattcctcggtccgctaaaaatcccctgccaggccccgccatggggttatgtcgcgggtgccgatctgcggaccggcgatgtcgcctacaagcataagaacggcacggtctatgacatgacgccgctgccgctacccttcaaggtgggggtgccgggcattggcggaccgatgatcaccaagggcggcgtcgccttcctcggtgcggccgtcgacaactatctgcgcgcctatgatctcaccacgggcaaagagctctgggaagcgcgtctgccagccggcggtcaggcaacgcccatgacctactcgctcgaaaacggaaaacaatatgtagtgatggtcgcgggcggccacggttcggttggtaccaagcccggtgattacgtcatcgcgtatacgctgccctga

SEQ ID NO: 49748 - protein, 778 aa, Agrobacterium tumefaciens str. C58
MAVTVTAVILTLIGLALFGFGSQLVMLGGSFYYLLSGLAFLLTAVLLFKRNRAALHVYAVFIVATLAWAVWEVGFDWWQLGPRGGVIILIGLWLLVPWVRKPLGFSSPTGLSYSPNAWPLVLSVLASFAVAGYSMAQDPHDQAGSLPQEIASAAPVYGGEVPDGDWHQYGRTPYGQRYSPLTQVNVDNVSQLKEAWRYQTGDVKLPDDVGETTYQVTPLKIGNTLYICTPHNWAIAIDAATGKEKWKYDPNVGLNPDRQHQTCRGVSYYAEPNAAAGTACAQRVYLPTSDARLIALDAATGQVCTSFADQGVLHLEQGMKYNPAGYYYSTSPPVIAAGKIIIGGAVNDNYSTQEQSGVIRAFDVNSGALIWNWDSGNPQKTEPIAAGETYTTNSPNSWSVLSYDEGLGLVYVPLGNQVPDQLGMGRSENVEKYSSSIVALDINTGKDRWVRQTVHHDLWDMDVPAQPVLLDITKDGQTVPALVGPTKQGDIYVLDRRTGEPLLPITEEPAPTGAIPEDFTSPTQPTSALSFKPEPLQEKNMWGVSMFDQLACRIRFHQLNYKGRYTPPSLNGSIIYPGNFGTFNWGSVAVDPERQVMFGMPTYLAFTSQLVPRADIPPKGQDEKGSEQGLNRNDGAPYGVFMGPFLGPLKIPCQAPPWGYVAGADLRTGDVAYKHKNGTVYDMTPLPLPFKVGVPGIGGPMITKGGVAFLGAAVDNYLRAYDLTTGKELWEARLPAGGQATPMTYSLENGKQYVVMVAGGHGSVGTKPGDYVIAYTLP

SEQ ID NO: 49749 - DNA, 2472 bp, Xanthomonas campestris pv. campestris str. ATCC 33913
  CDS (1)..(2472)
atgtcgacattgcttcgtccctcccgtcgcggccattgggccctggcgattctgggaggcgtgattgtgctgctggggctggtgctgctggcaggtggtgcgtggctcgccacgctgggcggatcctggtattacgcaccggcaggcctggcgatgctgatcgctggcgtgttgctgttccgcggccgcaatgccggcgcgtggtggtttgccgccgtcgtggccgccacgctgctgtggacgtggtgggaatcgggcagtgattactggcgctgggtgccgcggctcgggttgatcgtgggcctggcgtttgtgctggcgctgctgttgcccaagctcgagcgcccggtgtcgcgcgccgtctcgcgcagcgtggctggcggactggcagtggtgtttgtggtggcctttgcgttggccttcgtgccgttcggaatcaccgaggccgagggtgcattgacgcaggtggcaggcatcgccgcaggtgtggtcaatcgccccgccgatggcgcacagccggcacagcccgccaatgcgccggtcgatgacgactgggccgcatatggacgcagccaggctgggcagcgctattcgccactcacccaaatcaatcgcgacaatgtcagccagctgcagcaggcgtgggtgttccataccggcgatgtgccgaccaagcgctggggcgccgaaaccacaccgttgaaggtcggcgacagcctgtatctgtgtagcgcgcgcaatcaggtgatcgcgctggacgcctccaccggcaagcagcgctggcgctacgaccccaaggtcaaggacgaggccattccatacaccgcggcctgccgcggggtgtcgtattacgaagtgccgacggcggcgccggccgcaaatgacgcagccgcttcgcaggcggcgacggcgcctgcgctgtgccgtacgcgcgtgatcgaaggcacgctggatgggcgcctgattgcattggatgcgcgcaccgggacaccatgcgcggacttcggcactcacggtcaggtcgacatcaccgtcggcatgggcgagacgccaccgggctacatctcgatcaactcgccgccggccatcgtgcgcggcgtggtggtcatcgggcatcaggtccttgacgggcaaaagcgttatgagccctcgggcgtgatccagggctttgacgcggtcaccggccagttgcgctgggcctgggacatgacccatcccgaatggaatggtgcaccgccgcctggccagacctggacgcgcggcacccccaacatgtggaccaccgcagcggccgacgagcagctgggttacgtgtatctgccgatgggcaattccaccgcggactactggagcagctcgcgcacgccgccggaaaaccgctatgccacctcgctggtggcgttggatgtgaccaccggcaagccggtgtggaatttccagaccacgcatatcgacgcatgggattacgacctcggctcgcagcccagcctgatcgatttccccaaggatggcgtcaacgtgccggccgtgttgctgccgagcaagcagggcgagttgtacgtgctggaccgtcgcaccggcgagccgctggttggcgtggaagagcgcgccgtgcccggcggtggtgtggagccgcagatgcgctccaagacccagccgttctcgctgtatcacacgctgcgcaagccggatctgaccgagcgcgacatgtggggcatgaccccgatcgatcagctggtgtgccgtatccagttccgcaaggcgagctacaagggcatctacacgccgcccgaagccgaccggcattccatcgaataccccggctataacggcggctcggactggggcagcgtggcggtggatccgcaccgtggcgtgatcgtggccaactacaacgacatgcccaactacaacatcctggtgccgcgcgccaaggcggacaaactgggctgggctccgcgcgatcaggtgcgtggcgatgccggtggtgccgaaggcgccggcgacccgcaggccggcacgccctacgcggtaaacgtcaacgccggctggcgtttgccgttcaccaagctgctgtgcaagcagccaccctatggcggcattcgcgccatcgatctgaagagcggcaagaccctgtgggaccgtccctttggcagtgcgcgcggcaacgggccgttcgggattcgctccggcctgccgatcgaaatcggcacgccgaacaacggtggctcggtggtcactgcgggtggtctgatcttcattgccgccgcaaccgatgacctgatccgtgcgatcgacctggccaccggcaaggagctgtggcacgccaagctgccggccggtggccaggccaatccgatggtctacgcgtacggcggccgcgagtatctggtgatcatggcggccggtcaccacttcatggaaacaccggcaggcgatgccctggtggcctacgcgttgccgcagcggtaa

SEQ ID NO: 49750 - protein, 823 aa, Xanthomonas campestris pv. campestris str. ATCC 33913
MSTLLRPSRRGHWALAILGGVIVLLGLVLLAGGAWLATLGGSWYYAPAGLAMLIAGVLLFRGRNAGAWWFAAVVAATLLWTWWESGSDYWRWVPRLGLIVGLAFVLALLLPKLERPVSRAVSRSVAGGLAVVFVVAFALAFVPFGITEAEGALTQVAGIAAGVVNRPADGAQPAQPANAPVDDDWAAYGRSQAGQRYSPLTQINRDNVSQLQQAWVFHTGDVPTKRWGAETTPLKVGDSLYLCSARNQVIALDASTGKQRWRYDPKVKDEAIPYTAACRGVSYYEVPTAAPAANDAAASQAATAPALCRTRVIEGTLDGRLIALDARTGTPCADFGTHGQVDITVGMGETPPGYISINSPPAIVRGVVVIGHQVLDGQKRYEPSGVIQGFDAVTGQLRWAWDMTHPEWNGAPPPGQTWTRGTPNMWTTAAADEQLGYVYLPMGNSTADYWSSSRTPPENRYATSLVALDVTTGKPVWNFQTTHIDAWDYDLGSQPSLIDFPKDGVNVPAVLLPSKQGELYVLDRRTGEPLVGVEERAVPGGGVEPQMRSKTQPFSLYHTLRKPDLTERDMWGMTPIDQLVCRIQFRKASYKGIYTPPEADRHSIEYPGYNGGSDWGSVAVDPHRGVIVANYNDMPNYNILVPRAKADKLGWAPRDQVRGDAGGAEGAGDPQAGTPYAVNVNAGWRLPFTKLLCKQPPYGGIRAIDLKSGKTLWDRPFGSARGNGPFGIRSGLPIEIGTPNNGGSVVTAGGLIFIAAATDDLIRAIDLATGKELWHAKLPAGGQANPMVYAYGGREYLVIMAAGHHFMETPAGDALVAYALPQR

SEQ ID NO: 49751 - DNA, 1740 bp, Xanthomonas campestris pv. campestris str. ATCC 33913
  CDS (1)..(1740)
atgcaccaatcttcctgtcgcagcgcgcgtggcggcgtgttgctcatgcttgcactgagcgctgtgctggccggctgcaagaaagacacgccggccgaacctgccgctcctgcgcaaacggcggcacctgccgcagcggcgccggcggccgcagtggtcgataccgatggcgaattcaccaccaacgccagcaacccggataactggggcggtgtcggtcgcgacttcgccttgacccgccacagcccgttggcggagatcaatcgcgacaacgtcaagaacctcaagatgtcgtgggaaatgaagaccgacgccacgcgcggccacgaaggccaaccgctggtgatcggcagcatcatgtacatggtcagcgcgtatcccaacaacgtgtacgcgatcgatctggcatcgcaggacgacggcggcaaggtgttgtggaaatacaccccgcagcaggacgaacgctcggtggcagtggcgtgctgcgacacggtcaaccgcggcgcatcgtatgccgatggcaagctggtgttcggcagcctgagtggcgatgtgatcgcgctcgatgccaagaccggcaaggaagtgtggaagcagaaacttggccaccccgacaagggcgaaaccatcaccatggcgccgatcattgccgacggcaaagtgatcgccggcatcagcggcaacgagttcggcgtgcttgggcgcgtggccgcctacaacctggccgatggtaagcaggcgtggtcctgcgatgcggccggcaccgacaaatccatctgcctgggcgccgatttcaacaaggccaacccgcaacatgggcagctcggcgacctgggcgtgaagacctttcccaacgacgaatggaagcgcggcggcggtgcggcctggggctggtacagctacgacccgaagctgaagttgctctactacggcaccggcaacccggggctgtggagcccgtcgtaccgctgcggcaagacctcgcatgaggaatgcaacaacggcgagcatgacaacaagtggtcgatgaccttgttcgcccgcaagatcgacaccggcgaagcggtgtggggctaccagaaaaccccgttcgaccagtgggattacgacggtatcaacgagccgatcctggtcgacctgaccatcgacggcaaggaagttccctcggtggtgcagttcgatcgcaacggctttgcctacgtgctcgatcgccgcgatggcacgctgctgcgcgcgcacaagttcgtgccggccaactgggccgaacgcatcgacatgaagaccggccgcccggtgaaggtggctgcgcattcgccactggaacgcggcaagaaagtgcaggcgttcccgtcggcaatgggcggcaaggaccagcagccgtgctcggtggatccggccaattcggcggtgttcttctgcggcaccaacaactggcacatggagcttgagccgcaggaacgcggcaacaccatgatgggcctgccgtatgtgttcgccaacgtgatgatgaagcccaacgagcccggcgcactgggcattgtcaaggcgttcgacgtggtggaaggcaagtccaagtgggagatcaaggagaagttcccggtgtggagcggcaccctggtcaccgatggcgggctggtgttctacggcacgctggacggctggttccgcgcagtggacaaggacaccggcaagaagctgtgggagatgaagttgccctctgatacgcccagggtttcctag

SEQ ID NO: 49752 - protein, 579 aa, Xanthomonas campestris pv. campestris str. ATCC 33913
MHQSSCRSARGGVLLMLALSAVLAGCKKDTPAEPAAPAQTAAPAAAAPAAAVVDTDGEFTTNASNPDNWGGVGRDFALTRHSPLAEINRDNVKNLKMSWEMKTDATRGHEGQPLVIGSIMYMVSAYPNNVYAIDLASQDDGGKVLWKYTPQQDERSVAVACCDTVNRGASYADGKLVFGSLSGDVIALDAKTGKEVWKQKLGHPDKGETITMAPIIADGKVIAGISGNEFGVLGRVAAYNLADGKQAWSCDAAGTDKSICLGADFNKANPQHGQLGDLGVKTFPNDEWKRGGGAAWGWYSYDPKLKLLYYGTGNPGLWSPSYRCGKTSHEECNNGEHDNKWSMTLFARKIDTGEAVWGYQKTPFDQWDYDGINEPILVDLTIDGKEVPSVVQFDRNGFAYVLDRRDGTLLRAHKFVPANWAERIDMKTGRPVKVAAHSPLERGKKVQAFPSAMGGKDQQPCSVDPANSAVFFCGTNNWHMELEPQERGNTMMGLPYVFANVMMKPNEPGALGIVKAFDVVEGKSKWEIKEKFPVWSGTLVTDGGLVFYGTLDGWFRAVDKDTGKKLWEMKLPSDTPRVS

SEQ ID NO: 49753 - DNA, 1986 bp, Xanthomonas axonopodis pv. citri str. 306
  CDS (1)..(1986)
atgcttgcgctgagcgccgttctgtctggctgcaagaaagacacacccaccgaaactgcggcgccggcaacggctgcaacacctgccgctgcgcccgccgctgcacccgccgccgcggccgtggtcgacaccgatagcgagttcaccgccaatgccagcaatgcggacaactggggtggcgtggggcgcgacttcgcactcacccggcatagcccgctggccgagatcaatcgcgacaacgtcaagaatctgaagatgtcgtgggagatgaaaaccgacgccacgcgcggccacgaaggccagccgctggtgatcggcagcatcatgtacatggtcagcgcgtatccgaacaacgtgttcgccatcgatcttgcggcgcaggacgacggcggcaaggtgttgtggaaatacaccccgcaacaggacgaacggtcggtggcggtggcgtgctgcgacacggtcaatcgcggcgcctcgtatgccgacggcaagctggtcttcggcagcctcagcggcgatgtgatcgcgctcgatgccaagaccggcaaggaagtgtggaagcaaaaacttgcgcacccggacaagggcgaaaccatcaccatggcgccgatcatcgccgacggcaaggtggttgccggcatcagcggcaacgagttcggcgtgctcggtcgcgtggccgcctacaaccttgacgatggcaagcaggcatggtcctgcgatgcggccggtaccgacaaggcgatctgcctgggcccggatttcaacaaggccaatccgcagcatggccagctcggcgacctgggcgtcaagacctttcccaacgacgaatggaagcgcggaggcggtgcagcctggggctggtacagctacgacccgaagttgaagctggtgtactacggcaccggcaatcccggcctgtggagcccgtcgtaccgttgcggcaagacctcgcaggaggaatgcaacaacggcgagcatgacaacaagtggtcgatgaccttgttcgcgcgcaagatcgataccggcgaggcggtgtggggctaccagaagaccccgttcgaccagtgggattacgacggcatcaacgagccgatcctggtcgacctgagcatcgatggcaagcaggttccgtcggtggtgcagttcgaccgcaacgggtttgcctacgtgctcgatcggcgcgatggcacgctgctgcgcgcgcacaagttcgtgccggccaactgggccgaacgcatcgacatgaagaccggtcgcccggtgaaggtggccgcgcattcgccgctggaacgcggcaagaaggtgcaggcgttcccgtcggcgatgggcggcaaggaccagcagccgtgctcggtggatccggccaatgcggcggtgttcttctgcggcaccaataactggcacatggagctggaaccgcaggagcgcggcaacaccatgatgggtctgccgtacgtgttcgccaacgtgatgatgaagccgaatgagccgggcgcgctgggcatcgtcaaggcgttcgatgtggtggaaggcaagtccaagtgggagatcaaggagaagtatccggtgtggagcggcaccctggtcaccgacggcgggctggtgttctacggcacgctggatgggtggttccgcgcggtggacaaggacaccggcaagaagttgtgggagaccaagttgccgtccggcatcatcggtaaccccatcgcctacaaggccaacggccatcagtacgtggcggtgttctccggtatcggcgggtggatcggcttgccggtcactgcaggcctggatccgtccgatccgtatggcgcactgggtgcggcggggctggcgttcggtgcgggcttcgacaagatcccgctcggcggcatggtccacagcttccgtatcgatggcgccggcaagaccgtgactgccactgccactgccactgccaccgcaggcggcggcaccgccaatgcagcagcgaagacggcacgatga

SEQ ID NO: 49754 - protein, 661 aa, Xanthomonas axonopodis pv. citri str. 306
MLALSAVLSGCKKDTPTETAAPATAATPAAAPAAAPAAAAVVDTDSEFTANASNADNWGGVGRDFALTRHSPLAEINRDNVKNLKMSWEMKTDATRGHEGQPLVIGSIMYMVSAYPNNVFAIDLAAQDDGGKVLWKYTPQQDERSVAVACCDTVNRGASYADGKLVFGSLSGDVIALDAKTGKEVWKQKLAHPDKGETITMAPIIADGKVVAGISGNEFGVLGRVAAYNLDDGKQAWSCDAAGTDKAICLGPDFNKANPQHGQLGDLGVKTFPNDEWKRGGGAAWGWYSYDPKLKLVYYGTGNPGLWSPSYRCGKTSQEECNNGEHDNKWSMTLFARKIDTGEAVWGYQKTPFDQWDYDGINEPILVDLSIDGKQVPSVVQFDRNGFAYVLDRRDGTLLRAHKFVPANWAERIDMKTGRPVKVAAHSPLERGKKVQAFPSAMGGKDQQPCSVDPANAAVFFCGTNNWHMELEPQERGNTMMGLPYVFANVMMKPNEPGALGIVKAFDVVEGKSKWEIKEKYPVWSGTLVTDGGLVFYGTLDGWFRAVDKDTGKKLWETKLPSGIIGNPIAYKANGHQYVAVFSGIGGWIGLPVTAGLDPSDPYGALGAAGLAFGAGFDKIPLGGMVHSFRIDGAGKTVTATATATATAGGGTANAAAKTAR

SEQ ID NO: 49755 - DNA, 2478 bp, Xanthomonas axonopodis pv. citri str. 306
  CDS (1)..(2478)
atgactgatcaatcctcaaaacgtgggctaggcacctggttgctggtggcctatgccgtggtgatcgccgtgcttggcgcggtgctcgcctaccagggcggccgcctggtggccgtgggcggctcctggtattacctgatcgcgggtattgccctgttcctggcgggcgtcctgctcgcgctgggcaagcgcgccgggctgtggctgtttggcgccacgctggccggtaccatcgcctgggcgctgtgggaagtgggcctggatggctggggcttggtgccgcgcctggccatgatgtcggtgctggggctggtgctgctgccgttctggggggtggcgcgtcgtcgcatgcagccgttgtccggcctgagctatgcgctggtgaccggcgtgctgccaatcctgggcgccgcgctgatcctgtggccgctgctgatgccgcgcaatgtcgagctggccgatgcctccaagttgccggccgacagcgccacggccttcagccgcggcaccgtgcccagccccgacggcaacgtcgcggccaatcatgacgccagcaactggacctcctatgcgggttccaacctgtccaaccactacacgcccggcgcgcagatcacgccggacaacgtgaagaatctcaaggtggcctgggaattccacaccggcgacctcaagcccaaggactccaagctgggctacgccttccagaacaccccgctcaaggtcggcgacctgctctacatctgtacccccacccagaaagtgatcgcggtggaagcggccaacggcaaggagcgctggcgcttcgatccgcagaccaacccaaaggcgatggcgggcgtggctgccaccacctgccgtggcgtgtcgtactaccaggcgcccgaaggcaccgccgagtgcccgacccggatcttctggccgatggtcgatggccgcctcggcgcgctggatgcgcagaccggcaagctgtgcaccagcttcggcaacaacggctatgtcgatctgaatgcgggcaccggcaacaccaagccgggcttcgtcggccccacctcgccgccggtggtgatgcgtggtgtggtgatccagccgaccggccaggtccgcgatggtcaggaaggcgatgcgccgtccggcgtggtgcgtggcttcgatgcgctcaccggccagctgcgctgggcctgggacctgggcaacccggcgatcaccgccgagccgccggccggccagacctacacgcgctcaaccccgaacgtatggtcgctgatggccgccgacgacgagctgggcctggtctatctgcccaccggcaatgcatccggcgacttcttcggcaagggccgcaccccgcaggacgaggaatacaccgcctcgctggttgcggtggatgccgccaccggcaaggaacgctggcacttccgtaccgtcaaccacgacctgtgggactacgacatcggcccgcagccgaacctggtcgattggccggtcgctggcggcggcacgcgtactgcggtgatccaggccaccaagtccggccaggtgttcgtgctggaccgcgccaccggcgagccgatcatgccggtcaagcagattccggtaccgcagggaaccgaccacggcgactggaccgccgccacgcaaccgatctcgccgggcatgcccaacaccgtgggcgcgccgagccgtgagttcgaaaaaatcatcgaatccgatgcctggggcatgactccgttcgaccagttggtctgccgtatccagttcaagcagctgcgctacgaaggcatgttcaccccgcccaccctgcaggggtcgctggccttcaccggcaaccacggcggcatcaactggggcggcgtttcggtggacctgcagcgcggcatcatggtgatgaacagcaatcgcctgccctacaccttgcaggtgtatacccgccagaagatggacgagctgggcgtggtgtcggtgttcgacggcaagagcaagacccccggctacatggcgcagaagggcctggcctacggcgcccgcaaggagccgtggatgtcgccgctcaacaccccgtgcgtggcaccgccgtggggctacatcgccggtgtggacctgcgcacgcagcaggtgatctggcgtcgtccgctgggcaccggttacgaccagggtccgatggccatcccgtccaagaccaagttcgagatcggcacgcccaacaacagcggctcgctggccaccgctggcggggtgaccttcatcggcgcgaccctggacgacttcatgcgcggcttcgacacccttaccggcaagcaggtctgggaaacccgcgtccccgccgggccgcaggcagcgccgatgagctacaccatcaacggcaagcaatacatcgtggccgccgtcggtggacacgaccgcatggaaaccaagtcgggcgacagcgtcattgcctgggccctgcccgacgatgcgcaggccgcgcctgccaagtaa

SEQ ID NO: 49756 - protein, 825 aa, Xanthomonas axonopodis pv. citri str. 306
MTDQSSKRGLGTWLLVAYAVVIAVLGAVLAYQGGRLVAVGGSWYYLIAGIALFLAGVLLALGKRAGLWLFGATLAGTIAWALWEVGLDGWGLVPRLAMMSVLGLVLLPFWGVARRRMQPLSGLSYALVTGVLPILGAALILWPLLMPRNVELADASKLPADSATAFSRGTVPSPDGNVAANHDASNWTSYAGSNLSNHYTPGAQITPDNVKNLKVAWEFHTGDLKPKDSKLGYAFQNTPLKVGDLLYICTPTQKVIAVEAANGKERWRFDPQTNPKAMAGVAATTCRGVSYYQAPEGTAECPTRIFWPMVDGRLGALDAQTGKLCTSFGNNGYVDLNAGTGNTKPGFVGPTSPPVVMRGVVIQPTGQVRDGQEGDAPSGVVRGFDALTGQLRWAWDLGNPAITAEPPAGQTYTRSTPNVWSLMAADDELGLVYLPTGNASGDFFGKGRTPQDEEYTASLVAVDAATGKERWHFRTVNHDLWDYDIGPQPNLVDWPVAGGGTRTAVIQATKSGQVFVLDRATGEPIMPVKQIPVPQGTDHGDWTAATQPISPGMPNTVGAPSREFEKIIESDAWGMTPFDQLVCRIQFKQLRYEGMFTPPTLQGSLAFTGNHGGINWGGVSVDLQRGIMVMNSNRLPYTLQVYTRQKMDELGVVSVFDGKSKTPGYMAQKGLAYGARKEPWMSPLNTPCVAPPWGYIAGVDLRTQQVIWRRPLGTGYDQGPMAIPSKTKFEIGTPNNSGSLATAGGVTFIGATLDDFMRGFDTLTGKQVWETRVPAGPQAAPMSYTINGKQYIVAAVGGHDRMETKSGDSVIAWALPDDAQAAPAK

SEQ ID NO: 49757 - DNA, 2331 bp, Shigella flexneri 2a str. 301
  CDS (1)..(2331)
ttgcagcgctggctgtatctactcattggcggaggctggctggtcgcgattggcggctcctggtactaccctatcgctggccttgtgatgctcggcgtcgcctggatgctgtggcgcagtaaacgcgccgcgctttggctatacgcagccctgctgctcggcaccatgatttggggcgtctgggaagttggtttcgacttctgggcgctgactccgcgcagcgatattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggagatcaacggcaccttaagcgccgatgccacacctgccgaagctatctcccccgttgccgatcaggactggcctgcgtatggccgcaatcaggaaggtcaacgcttttcaccactgaagcaaattcacgccgataacgtccacaagctgaaagaagcctgggtgttccgtactggcgatgtgaagcagccgaacgatccgggtgaaatcaccaatgaagtgacgccgattaaagtgggcgataccctttacctgtgtaccgctcaccagcgcctgtttgcgcttgatgccgccagcggcaaagagaaatggcattacgatcctgagctgaaaaccaacgagtctttccagcacgtaacctgccgtggcgtctcttatcatgaagccaaagcagaaacggcttcgccggaagtgatggcggattgcccgcgtcgtatcattcttccagtgaatgatggtcgcctgattgcgattaacgctgaaaacggcaaactgtgcgaaaccttcgccaataaaggcgtgctcaatctgcaaagcaatatgccagacaccaaaccgggtctgtatgagccgacttctccgccaattatcaccgataaaaccatcgtgatggccggttcagtcaccgataacttctcaacccgcgaaacgtctggcgtgatccgtggttttgatgtcaacaccggggagctgctgtgggcttttgatccgggcgcgaaagatccgaacgcaatcccgtcagacgaacacacctttacctttaactcaccaaactcgtgggcaccagcggcctatgacgcgaagctggatctggtctatctgccgatgggcgtgaccacgccggatatctggggcggtaaccgcacaccggaacaggaacgttatgccagctcgattctggcgctgaatgccactaccgggaaactggcgtggagctaccagaccgttcaccacgacctgtgggacatggatcttccggcacagccgacgctggcggacatcaccgttaatggtcagaaagtgccgattatttacgctccggcgaaaaccggtaacatttttgtgctcgatcgtcgtaatggcgaactggtggttccggccccggaaaaaccggttccccaaggtgctgccaaaggcgattacgttacccctactcaaccattctcggaactgagcttccgtccgacgaaagatttgagcggtgcggatatgtggggagccaccatgtttgaccaactggtgtgccgcgtaatgttccaccagatgcgctatgaaggcattttcacgccgccatctgaacagggtacgctggtcttcccgggtaacctggggatgttcgaatggggcgggatttccgttgatccaaatcgtgaagtggcaattgccaacccaatggcactgccgtttgtttcgaaactgctcccgcgtggtcctggcaacccgatggagcagccgaaagatgccaaaggcacgggtacggaatccggcattcagccacagtacggtgtaccgtatggtgtcacgctcaacccgttcctctcaccatttggtctgccatgtaaacagccagcatggggttatatctcggcgctggatctgaaaactaatgaagtggtgtggaagaaacgtattggtacgccgcaggacagtatgccgttcccgatgccggttccggtgccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccggcgggtggtcaggcaacaccgatgacctatgaagtgaatggcaagcagtacgtggtgatctccgcaggcggtcacggttcatttggtacgaagatgggcgactatattgtggcttatgccctgccggatgatgtgaaataa

SEQ ID NO: 49758 - protein, 776 aa, Shigella flexneri 2a str. 301
MQRWLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQIHADNVHKLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPIIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLLPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 49759 - DNA, 1788 bp, Pseudomonas putida KT2440
  CDS (1)..(1788)
atgacccgatccccacgtcgccccttgttcgccgtgagcctggtgctcagcgccatgctgcttgccggcgcggctcacgccgctgtcagcaatgaagaaatcctccaggacccgaagaacccgcagcagatcgtgaccaatggcctgggcgtgcagggccagcgctacagcccgctggacctgctcaatgtcaataacgtcaaggagctgcgcccggtctgggcgttctccttcggcggggagaagcagcgcggccagcaggcccagccgctgatcaaggacggggtgatgtacctgaccggctcctactcgcgggtgttcgccgtggatgcccgcaccggcaagaaactgtggcaatacgatgcacgtctgccggatgacatccgcccctgctgcgacgtaatcaaccgcggcgtcgcgctgtacggcaacctggtgttcttcggcacgctggacgccaagctggtggccctgaacaaggacaccggcaaggtggtctggagcaagaaggtcgccgaccacaaagaaggctactccatcagcgccgcgccgatgatcgtcaatggcaagctgatcacaggcgttgccggcggcgagttcggcgtggtgggcaagatccaggcgtacaacccggagaacggcgaactgctgtggatgcgccccaccgtggaagggcacatgggctatgtgtacaaggatggcaaggcgatcgagaacggtatttccggcggtgaggcgggcaagacctggcctggcgacctgtggaagaccggcggcgccgcgccgtggctggggggttactacgaccctgaaaccaacctgatcctgtttggtaccggtaacccggcgccgtggaactcgcacctgcgccccggtgacaacctgtactcctcctcacgcctggcactgaacccggacgacggcaccatcaagtggcacttccagagcacgccgcatgacggctgggacttcgacggcgtcaacgagctgatctcgttcaactacaaggacggcggcaaggaggtcaaggctgccgccacggcagaccgcaacggtttcttctacgtgctcgaccgcaccaacggcaagttcatccgcggcttccccttcgtggacaagatcacctgggccactggcctggacaaggacggccggccgatctacaacgacgccagccgcccgggcgcacccggcagcgaggccaagggcagctcggtgttcgtcgcgccggccttcctcggcgccaagaactggatgccgatggcctacaacaaggacacagggctgttctacgtgccgtccaacgagtggggcatggacatctggaacgaaggcatcgcctataagaaaggtgcggcgttcctcggtgccggcttcaccatcaagccgctcaatgaagactacatcggcgtgctgcgcgccatcgacccggtcagcggcaaggaagtgtggcgccacaagaactatgcgccgctgtggggcggtgtgctgaccaccaagggcaacctggtgttcacgggcacgccagagggcttcctgcaggcattcaacgccaagaccggcgacaaggtctgggaattccagaccggctcgggcgtgctcggctcgcccgtcacctgggaaatggacggcgagcaatacgtttcggtagtctccggctggggcggcgcggtgccgctgtggggcggcgaagtggccaaacgggtcaaggacttcaaccagggcggcatgctctggaccttcaagttgcccaagcagttgcagcaaacggcaagcgtcaagccataa

SEQ ID NO: 49760 - protein, 595 aa, Pseudomonas putida KT2440
MTRSPRRPLFAVSLVLSAMLLAGAAHAAVSNEEILQDPKNPQQIVTNGLGVQGQRYSPLDLLNVNNVKELRPVWAFSFGGEKQRGQQAQPLIKDGVMYLTGSYSRVFAVDARTGKKLWQYDARLPDDIRPCCDVINRGVALYGNLVFFGTLDAKLVALNKDTGKVVWSKKVADHKEGYSISAAPMIVNGKLITGVAGGEFGVVGKIQAYNPENGELLWMRPTVEGHMGYVYKDGKAIENGISGGEAGKTWPGDLWKTGGAAPWLGGYYDPETNLILFGTGNPAPWNSHLRPGDNLYSSSRLALNPDDGTIKWHFQSTPHDGWDFDGVNELISFNYKDGGKEVKAAATADRNGFFYVLDRTNGKFIRGFPFVDKITWATGLDKDGRPIYNDASRPGAPGSEAKGSSVFVAPAFLGAKNWMPMAYNKDTGLFYVPSNEWGMDIWNEGIAYKKGAAFLGAGFTIKPLNEDYIGVLRAIDPVSGKEVWRHKNYAPLWGGVLTTKGNLVFTGTPEGFLQAFNAKTGDKVWEFQTGSGVLGSPVTWEMDGEQYVSVVSGWGGAVPLWGGEVAKRVKDFNQGGMLWTFKLPKQLQQTASVKP

SEQ ID NO: 49761 - DNA, 1749 bp, Bradyrhizobium japonicum USDA 110
  CDS (1)..(1749)
atggcgtgcacaacaacatcgtggagggaatacatgacctttggaacgaagggcttcttggctggcatctcgatggttgcgatgctggctaccgctacgtcgggcgttcgcgccaacgactccctgctcaaggcgcaatccgactcgagccagtgggccgttgccggccacgactacggcaacacgcgcttcagcccgctgaagcagatcaacaccgagaacgccggcaagctgacgctcgcttattcgttctcgctcgcctcgctccgttcgaacgaatcctcgccgatcgtcgtcggtaacacgctctacgtttcgagctcctggggcccgaaatacgtctacgcgctcgatgccgccaccggcgtgcgcaaatggacctacgaacccgatattcccgaggacgtgctgcaatacgcctgctgcgacgtgaacaatcgcggcgtctcctatgccgacggcaagatcttcgtcggccgcctcgacggcaagctgacggcgctcgatgccgcgaccggcaaggcgctctggacggcgaaggtggtcgattacaagcagggttcggtcatcacctcgccgccgctcgtcgtgcgcgacaaggtcatcaccggtttcggcggcggcgagtacggcgtgcgcggctcgctccaggccttcgacatcaacaccggcaagcagctgtggcagacctacaccgttccgtcgccggatgagcccggcggcgacacctggaagggcgactccgcccagcatggcggcggtgcggcctggctggtcggctcctacgatccgaagaccgacacggtctattggggtaccagcaatcccggtccctggaacacggcggtacgctcgaccggcgacggcaatttcggcaagctgaccaacctctacaccgcctcgacggtggcgttcgatcccaacaccggcaagatcaagtggcacatccagaccacgccggccgatgcctgggactatgacggcgtcaacgaagccgtgctcgcggatctgaagatcggcggcagcaccgtgccggcgctgatgaaggcggatcgcaacggctacttcttcgtcgccaatcgcgagaccggcaaggtgctttcggcggagaaatacgtgttctccaactgggccaagaagtgggacatcgccacgatgcgcgcggtcgaggatcccgacaagcgtcccgggccgaaccatcccgccaaggacatctgcccgaacctgatcggcggcaagaactggcagccgatgtcgttcaacccgcagaccggcctcgtctacatcccgtccaacaatgtctgcatggactggtcggtctccgacgtcgcctacaagcgcggtgtgttctatctcggcgccgaattcccgaccaaggaaggccccggcggtttcctcggcgagctcgtggcctgggatccggtcgcgcagaagaaggtctggtcgatcaaggaagacctgccgttcaacggcggcacgctgaccaccggcggtggcctcgtgtttgccggcaacatccatggcgatttccgcgccatcgatgcgaagtccggcaaggtgttgtggagcaggaatctcggctccggcatcggcgcaggtccggtgacctaccaggtcgacggcaagcaatatgtcgccatcgtcgtcggccgcacggctgcgctgcctgcgttcctgggcgaggtaggaaagaagatgacggccgcagctcccgagggcggttcgctcttcgtgttctccgtccagtga

SEQ ID NO: 49762 - protein, 582 aa, Bradyrhizobium japonicum USDA 110
MACTTTSWREYMTFGTKGFLAGISMVAMLATATSGVRANDSLLKAQSDSSQWAVAGHDYGNTRFSPLKQINTENAGKLTLAYSFSLASLRSNESSPIVVGNTLYVSSSWGPKYVYALDAATGVRKWTYEPDIPEDVLQYACCDVNNRGVSYADGKIFVGRLDGKLTALDAATGKALWTAKVVDYKQGSVITSPPLVVRDKVITGFGGGEYGVRGSLQAFDINTGKQLWQTYTVPSPDEPGGDTWKGDSAQHGGGAAWLVGSYDPKTDTVYWGTSNPGPWNTAVRSTGDGNFGKLTNLYTASTVAFDPNTGKIKWHIQTTPADAWDYDGVNEAVLADLKIGGSTVPALMKADRNGYFFVANRETGKVLSAEKYVFSNWAKKWDIATMRAVEDPDKRPGPNHPAKDICPNLIGGKNWQPMSFNPQTGLVYIPSNNVCMDWSVSDVAYKRGVFYLGAEFPTKEGPGGFLGELVAWDPVAQKKVWSIKEDLPFNGGTLTTGGGLVFAGNIHGDFRAIDAKSGKVLWSRNLGSGIGAGPVTYQVDGKQYVAIVVGRTAALPAFLGEVGKKMTAAAPEGGSLFVFSVQ

SEQ ID NO: 49763 - DNA, 1665 bp, Bradyrhizobium japonicum USDA 110
  CDS (1)..(1665)
atgaaacgctttgcgatggccgcgagcctcgtcatgcttgcatcaacgtatgcaaacgcccagaccaccgagcaactggtcaagggtgcgaccgatacatcgaacgttctcaactacgggatgggctacaatctccagcgcttctcgaccctgaaccagatcaacaaggacacggtgaaaaacctcgtcccggtctggaactactccttcaatgacgatcgcagcgaggaatcgcagccactggtgtaccagggcgtgatctacgtgacctcgcacaacgcgaccatggcggtcgacgccaagaccggcaagcagatctggaaatccaagatcgagtaccccgccgagacgccgcgcatcgtctgctgcggcatcatcaaccgcggcgccgcgctctacgacggcaaggtgttccgcaccaccctcgacgccaacgtgatcgcgctcgacgccaaggacggcaaggagctttggcggcagaaggcggccgatatcaaggaaggctattcgatgacggtggccccgctggtcgccgacggcgtcgtcatcaccggcatctccggcgccgagttcggcacccgcggcttcatcgacggctgggatccggcgacgggcaagcatctctggcgcacccattcgatcccctctcccgacgagcccggtggcgacacctggaagggcgacacctggaagctcggcggcggctcgacctggatcaccggctcctacgatcccgagctgaacacggtctattggggcatcggcaatcccggcccgttcaactcggcggtgcgccccggcgacaacctctacacctgctccgtgctggcgatggatcccaagaccggcaagatcaagtggcactaccagttctcgccgaacaatccgttcgactatgacagcgtggccgagatggtcctcgccgacatgaacgtcgagggcaagccgaccaaggtgctgatggatgccaaccgtaacggcttcttctacgtgctcgaccgcaccaacggaaagctgctcgcggccaatccctacgtgaaggtgaactgggcgaccggcgtcgacatgaagacgggccgcccgatcgagaccgacgtttcgaaggacgcccgcgagggcaagaaggtgactgtctatccgtcgatcctcggcggcaagaactgggagccgatgtcgttcaatccgcaaaccggattggcctacgccaacacgctcgccttcggcggcaagtacaaggccgaaccggtcaccttcaagcagggcgaatggtatctcggcatggacctcaccgatccctgggaattcggcgacggcgcgcggggccatctgaaggcgatcgatccgatgaccggcaaggcgaagtgggaggcgcccgccgacatcccgcgcttctccggcgtgctgtcgaccgcgggcggcgtcgtgttcacgggcgccctgaccggcgagttcgaggccttcgatgccgacaccggcaagaagctctggcagttccagaccggctccggcatcgagggacaaccggtgacgtggcagcaggatgacgtgcaatacatcgccgtcaccagcggctacggcggcgtctactcgctgttctccggcgacgagcggctcgccaaggtgccgcccggcggctcgctgtgggtctttgcggtcaagcaatag

SEQ ID NO: 49764 - protein, 554 aa, Bradyrhizobium japonicum USDA 110
MKRFAMAASLVMLASTYANAQTTEQLVKGATDTSNVLNYGMGYNLQRFSTLNQINKDTVKNLVPVWNYSFNDDRSEESQPLVYQGVIYVTSHNATMAVDAKTGKQIWKSKIEYPAETPRIVCCGIINRGAALYDGKVFRTTLDANVIALDAKDGKELWRQKAADIKEGYSMTVAPLVADGVVITGISGAEFGTRGFIDGWDPATGKHLWRTHSIPSPDEPGGDTWKGDTWKLGGGSTWITGSYDPELNTVYWGIGNPGPFNSAVRPGDNLYTCSVLAMDPKTGKIKWHYQFSPNNPFDYDSVAEMVLADMNVEGKPTKVLMDANRNGFFYVLDRTNGKLLAANPYVKVNWATGVDMKTGRPIETDVSKDAREGKKVTVYPSILGGKNWEPMSFNPQTGLAYANTLAFGGKYKAEPVTFKQGEWYLGMDLTDPWEFGDGARGHLKAIDPMTGKAKWEAPADIPRFSGVLSTAGGVVFTGALTGEFEAFDADTGKKLWQFQTGSGIEGQPVTWQQDDVQYIAVTSGYGGVYSLFSGDERLAKVPPGGSLWVFAVKQ

SEQ ID NO: 49765 - DNA, 1728 bp, Bradyrhizobium japonicum USDA 110
  CDS (1)..(1728)
atgaccaggaagcaatggtttctgtccggcttcgtcgccttcacctgtcttgcctcgaccgccgccggtgccggcccgatcgagaattattctccggtcaccgcgcagcgcctggagaatccggaaccgagcaactggatgctctatcggcgcacctatgacgggcagggctacagcccgctcgaccagatcaacacctcgaacgtgaagggtctcacgccggtctggacgtttgcaacaggcgtcgtcgaaggccacgaggcgccgccgatcgtcaacaatggcgtgatgttcgtggcgaccccgatggggcaggtgatcgcgctgaacgcgaaaaccggcgacgagtactggcgctacaagcggcagctccccgacgatctgttccagctgcatccgaccagccgcggcgtcggcttgtgggaggacaagctctatctcgccaccaccgacgatcatgtcgtcgcgctcgacgccaagaccggcaaggtggtgtgggacaccaaggtgcaggactacaagaagggccagtatatgaccctgatgccgctgatcgtcgacggcaaggtcatcgtcggcggctccggcggcgagttcggcgtgcgcggctatgtcgccgcctatgacgccaaggacggcaaggagctgtggcggacctacaccattcccggcgaaggcgagcccggtcacgacacctggcagggcgatgactggaagaacggcggcggctcggcctggatgaccggcaattacgacaaggacaccaagacgatctattggggcgtcggcaacgcggcgccgtggccgggcgagacccatcccggcgacaatctctacacctcgtcggtgctcgcgctcgatccgaacaacggcaagatcaagacctatcaccagtaccaccagaacgactcctgggactgggacgaggtcgaagcgccgatgctgatcgacctgcaacgtgacggccgcagcatcaagagcctggtccatccggggcgcgatgcgatcttctgggtgctcgagcgcacgccgaccaagatcaactacgtggcaggttggccgttcgtctccaccgacgtctggaagggcatcgatgccgaaaccggcaagccgatcgtcgatcccgcgcacaagccggtgattggcaagcgcgtggagttctgtccctctctatggggcggcaaggactggccgtcggcggcctacagccagaagacgggcctggtttacgtgcccgccaacgagaatttctgcggcggattcaccggcgagaaggtcgcactcaagccgggcgagctctggctcggcaccaagccggaagacatcgggctgaagaccaagccgggggcggatcattttggcgagctccaggcctgggatcccgtcaccggcaagaaggtgtggcagcacaacttcccgaagtcgcagctgttcggctcggtgacggcgaccgcgggcgatctcatctttgccggcggcaccaacgaccgcaacttccgcgccttcaacgccaagaccggcgagctgttgtgggagcagaagaccaactccggcatcatgggcatgccggtgtcgtatgagatcgacggcacgcaatacatcgcgatccagtcgggatggggtgtggacgcgcagcggatccaggatgcgctggtgaccaacaacatcggcatcgaggccaatgtgccgcagggcggcgtgatctgggtgttcgcgctgaagaaatag

SEQ ID NO: 49766 - protein, 575 aa, Bradyrhizobium japonicum USDA 110
MTRKQWFLSGFVAFTCLASTAAGAGPIENYSPVTAQRLENPEPSNWMLYRRTYDGQGYSPLDQINTSNVKGLTPVWTFATGVVEGHEAPPIVNNGVMFVATPMGQVIALNAKTGDEYWRYKRQLPDDLFQLHPTSRGVGLWEDKLYLATTDDHVVALDAKTGKVVWDTKVQDYKKGQYMTLMPLIVDGKVIVGGSGGEFGVRGYVAAYDAKDGKELWRTYTIPGEGEPGHDTWQGDDWKNGGGSAWMTGNYDKDTKTIYWGVGNAAPWPGETHPGDNLYTSSVLALDPNNGKIKTYHQYHQNDSWDWDEVEAPMLIDLQRDGRSIKSLVHPGRDAIFWVLERTPTKINYVAGWPFVSTDVWKGIDAETGKPIVDPAHKPVIGKRVEFCPSLWGGKDWPSAAYSQKTGLVYVPANENFCGGFTGEKVALKPGELWLGTKPEDIGLKTKPGADHFGELQAWDPVTGKKVWQHNFPKSQLFGSVTATAGDLIFAGGTNDRNFRAFNAKTGELLWEQKTNSGIMGMPVSYEIDGTQYIAIQSGWGVDAQRIQDALVTNNIGIEANVPQGGVIWVFALKK

SEQ ID NO: 49767 - DNA, 2175 bp, Rhodopseudomonas palustris CGA009
  CDS (1)..(2175)
atgaggaagcctgctgacgcggtgcggactgcgatccgacctgtccaacaacccgcgatacgattagttgcgaggcggctcggcgctgcggcgctgatggctgcgctgctgacgccggcggtcgccgcggcgcaagactccaagggctccgccgcgcacatccgcgcggtgacaggcgcggtcgatagcgccgcgatcgtcgccaacgtcaagaccaccaaggattggccgagttacggcctcgactacgccgagacccggttcagcaagctcgaccagatcaacaccgaaaacgtcaagcagctcggcctgcagtggagctacagcctcggctccgaacgcggcgtcgaagcgacgccggtggtggtcgacggcatcatgtacgtcaccgcgtcatggagcgtcgtgcacgcgatcgacacccgcaccggcaagaagctgtggacgttcgatcccaaggtcgatcactcgaagggctatcgcggctgctgcgacgtcgtgaaccgcggcgtcgcgctgtacaagggcaaagtgttcgtcggcgcctatgacggccggctgatcgcgctcgatgccgcgaccggcagcaaggcctgggagatcgacacgctgatcgaccacgagcactcctacaccatcaccggtgcgccgcgggtgttcaacggcaaggtggtgatcggcaacggcggcgccgaatacggcgcgcgcggctacgtcaccgcctatgatgccgagacaggcaagcaggcatggcgctggttcacggtgccgggcgatccgagcaagccgttcgaagacgagtcgatggagaaggccgccaagacctgggatccggccggcaaatggtggctcaatggcggtggcggcaccgcgtgggacaccatcaccttcgatcccgacctcaatctgatctatgtcggcaccggcaacggctcgccgtggaatcggcatctgcgcagcccggcgggtggcgacaatctgtatctggcgtcgatcgtcgcgctgaatgccgacaccggcaaatacgtctggcactatcaggagacgcccggcgacaactgggattatacctcgacccagccgatgatcctcgcggacatcgcgatcgacggcaagccgcgcaaggtgatcctgcacgcgccgaagaacggcttcttcttcgtgatcgaccgcaccgacgggaagttcatctcggcgaagaatttcgtcgatgtgaattgggcgactggctacgattccaatggccggccgatcgaagtgcccgaagcgcggtcggcggacaaatcgttcgatgcgatcccggggccgtatggcgcgcacaactggcacccgatgtcgttcaacccgcagaccggtctggtgtatctgccggcgcagggcgtgccggtcaatctcaccggcgagaaggcgctgacccagaacaagatggagccgttcaagttcggttcgaccaccggctggaacgtcggcttcacgctgaacgcggtgccgccgaagaacctgccgttcgggcgcctcgtggcatgggacccggtgcagcagaaagaagtctggcgcgccgaatacgtctcgccgtggaatggcggcaccttgaccaccgccggcaacctcgtgttccagggcacggctgacggccgcttcgtcgcttacaatgccaagaccggcgagaagctgtgggagagcccgctcggcaccggcgcggtggcggcgcctgcgacctacatggtcgacggcgtgcaatacgtgtcgatcgcggtcggctggggcggggtgttcggcatcagcgcccgcgccaccgagaccgaggcgccgggcacggtgtacaccttcgcggtcggcggcaaggccaagatgccggaattcgccaagtatcagatgggcaacctgctcaccggcatcgaatacgatccgaaggacgtggcggaggggaccgcgatctacgtcgccgcctgtgccacctgccacggggtgcccggtgtcgaccgcggcggtaacgtcaagaacctcggctattccaccaccgaccggatcgcccacctgaaggacatcgtgttcaaggggccgttccgcgacaagggcatgccggacttcaccggcaagctgaccgaggccgacgtggtcaagatccaggccttcatccaaggcaccgcggacgcgatccggccgaagaagtag

SEQ ID NO: 49768 - protein, 724 aa, Rhodopseudomonas palustris CGA009
MRKPADAVRTAIRPVQQPAIRLVARRLGAAALMAALLTPAVAAAQDSKGSAAHIRAVTGAVDSAAIVANVKTTKDWPSYGLDYAETRFSKLDQINTENVKQLGLQWSYSLGSERGVEATPVVVDGIMYVTASWSVVHAIDTRTGKKLWTFDPKVDHSKGYRGCCDVVNRGVALYKGKVFVGAYDGRLIALDAATGSKAWEIDTLIDHEHSYTITGAPRVFNGKVVIGNGGAEYGARGYVTAYDAETGKQAWRWFTVPGDPSKPFEDESMEKAAKTWDPAGKWWLNGGGGTAWDTITFDPDLNLIYVGTGNGSPWNRHLRSPAGGDNLYLASIVALNADTGKYVWHYQETPGDNWDYTSTQPMILADIAIDGKPRKVILHAPKNGFFFVIDRTDGKFISAKNFVDVNWATGYDSNGRPIEVPEARSADKSFDAIPGPYGAHNWHPMSFNPQTGLVYLPAQGVPVNLTGEKALTQNKMEPFKFGSTTGWNVGFTLNAVPPKNLPFGRLVAWDPVQQKEVWRAEYVSPWNGGTLTTAGNLVFQGTADGRFVAYNAKTGEKLWESPLGTGAVAAPATYMVDGVQYVSIAVGWGGVFGISARATETEAPGTVYTFAVGGKAKMPEFAKYQMGNLLTGIEYDPKDVAEGTAIYVAACATCHGVPGVDRGGNVKNLGYSTTDRIAHLKDIVFKGPFRDKGMPDFTGKLTEADVVKIQAFIQGTADAIRPKK

SEQ ID NO: 49769 - DNA, 2397 bp, Acinetobacter sp. ADP1
  CDS (1)..(2397)
ttgaaagtatggtgttttatacttgggctggcgttacttattactggtgcattttatgttatcggtggtggaaaactgattagcttgggtggttcatggtacttcctgattgctggtttaatgattactacctcagctttttttatgttcaagaaaaaagcaaccggggtctggttatatgctttggccttcattggtactgttatttgggcgttaattgatgctggtttcgaattttggccattgcattcacgtttgatgttcccagcaggtttatttgctgcggtcatgttaaccttgccatctattcgtaaataccaatatcaaaccccaatgagcgctccagcatatgtcattggtggtttgaccgttttaggaatgctcggtggtctgtatggaatgtttattccacatgaaactgtgaaagcatctggcgaagaactaccacttgttccagttgaccctgccaaaaaacaggtaaattgggatcattatggtaatgatgctggcggcagtcgttttgtagcgcttgatcagattaaccgtaacaacgtatctaaattaaaagaagcttggcgtttccgtacaggtgattttacgactggtacaggtaacggtgcagaagatcaaatgacaccattgcaagttggcaataaagtattcttgtgtacaccacataataatatatttgcaattgatgcagactctggaaagcagctttggaaagcagaagttaactctactgcggatgcatgggaacgttgtcgtggcgtcgcttattttgattcgacacaaccattggtacaacctacattggctggtgcaacacctgtagctgctttagcagcaaatactgagtgtccgcgacgtgtatataccaatactgtagatggccgtttgattgcagtaaatgcagatacaggcgctcgttgtaaagactttggtgttaatggtacagtgaatttacatgaaggacttggtgaaaatactaaggcacctcgctttgaagtcacttcggcacctaccattgcaggtacaacgattgtcgtgggaagccgtattgcagataacgtggcagccgatatgcctggtggagtcattcgtgcctatgatgtgattacaggtaaattacgttgggcatttgatccacgtaatccagatccaaactacgttttaaaaccaggtgagatttacaaacgcagttctacgaactcatgggcagccatgtcttatgacccgcaaatgaataccgtgttcttgccaatgggaagttcatctgtagacgtttggggtggtaatcgtactgcagccgaccataaatataatacctctgtacttgcacttgatgcgacgacaggtaaagaaaaatgggtttataatactgttcataatgacctttgggattttgacttaccaatgcaaccaagtttggtagacttcccaatgaaagatggtacaactaaacctgcggttgttattggcactaaatcaggtcagttttatgtacttgatcgtgtgacaggtaaaccactgactaaagtgatcgagcagccaattaaagtggctgatattcctggcgaacaatacagtaaaactcagccgcgttcagttgaaatgccgcaaattggtaatcagacacttaaagagtctgatatgtggggcgcgacgccatttgatcagttgatgtgtcgtatcaactttaaatcaatgcgttatgacgggctttacaccgcaccaggtactgatgtatcactgagcttcccgggttctctgggtggtatgaactggggttctatcgcatttgatccaacgcaccgttatatgtttgtgaatgacatgcgtttagggctttggattcaattgatcaagcagactcctgaagatatcaaaattcaggcaaatggtggcgagaaagttaatacaggtatgggtgcagttccaatgaaaggtacgccatataaagtgaataaaaaccgctttatgtcagcgttgggcattccatgtcaaaaaccaccttttggtaccatgactgcaattgatatgaaaacacgtcaagtggcttggcaagtaccattgggtacgattcaagacacgggtccaatgggtattaaaatgggcttgaaagcaccaattggtatgccaaccattggtggtcctatggcgactcaaggcgggttagtattctttgctgcaacgcaagactactacttacgtgcgtttaactcatctaatggtaaagagttgtggaaagcacgtcttcctgtgggtagtcaaggtacgcctatgagttatatgtcaccaaaaactggaaaacaatacgttgttgtttcagcaggtggtgcacgtcagtctccagatcatggtgactacgtgattgcatatgcccttgaaaaataa

SEQ ID NO: 49770 - protein, 798 aa, Acinetobacter sp. ADP1
MKVWCFILGLALLITGAFYVIGGGKLISLGGSWYFLIAGLMITTSAFFMFKKKATGVWLYALAFIGTVIWALIDAGFEFWPLHSRLMFPAGLFAAVMLTLPSIRKYQYQTPMSAPAYVIGGLTVLGMLGGLYGMFIPHETVKASGEELPLVPVDPAKKQVNWDHYGNDAGGSRFVALDQINRNNVSKLKEAWRFRTGDFTTGTGNGAEDQMTPLQVGNKVFLCTPHNNIFAIDADSGKQLWKAEVNSTADAWERCRGVAYFDSTQPLVQPTLAGATPVAALAANTECPRRVYTNTVDGRLIAVNADTGARCKDFGVNGTVNLHEGLGENTKAPRFEVTSAPTIAGTTIVVGSRIADNVAADMPGGVIRAYDVITGKLRWAFDPRNPDPNYVLKPGEIYKRSSTNSWAAMSYDPQMNTVFLPMGSSSVDVWGGNRTAADHKYNTSVLALDATTGKEKWVYNTVHNDLWDFDLPMQPSLVDFPMKDGTTKPAVVIGTKSGQFYVLDRVTGKPLTKVIEQPIKVADIPGEQYSKTQPRSVEMPQIGNQTLKESDMWGATPFDQLMCRINFKSMRYDGLYTAPGTDVSLSFPGSLGGMNWGSIAFDPTHRYMFVNDMRLGLWIQLIKQTPEDIKIQANGGEKVNTGMGAVPMKGTPYKVNKNRFMSALGIPCQKPPFGTMTAIDMKTRQVAWQVPLGTIQDTGPMGIKMGLKAPIGMPTIGGPMATQGGLVFFAATQDYYLRAFNSSNGKELWKARLPVGSQGTPMSYMSPKTGKQYVVVSAGGARQSPDHGDYVIAYALEK

SEQ ID NO: 49771 - DNA, 2406 bp, Acinetobacter sp. ADP1
  CDS (1)..(2406)
atgtctcaaccatcttcaaattcaggacttagaacattgaccgtagttatcgctgcggtgattggtctattcctgctcgttggaggtatatggcttactgtactcggtgggtcattctattatgtgattgcaggattggcattactgatctttgcatggctcttgctcaaacgatcaagcacttctatctggttgtatgctgcattaatgctcggtacaacgctatggggtatttgggaagttggtacagacttctgggccttggcaccgcgtctggacattttaggcgtacttggtctatggattttaattccagccgtgagccgtggaatggacaatgcaaaatcaagcaaaattgcgttgtcttctacacttgtgattgcaattgtggtcatggtttattctatttttaatgatccgcaagaaattaatggtgtcattaaaaatgagcaacccaaaactgcacaagcagttgaaggtgttgatgctgctgattggcctgcctatggtcgtacccagggtggtgtacgttattcgcctttaacgcagattaatgatcagaacgttaaagatttgaaagtggcatggaccttccgtacaggtgacttaaaaactgcaaatgactcgggtgaaaccaccaatcaggttacgccaatcaaagttggcaataacatgtacatgtgtaccacccaccaatggttaattgcacttgaccctgcaacaggtaaagaaaaatggcgttttgatccgaaattaaaagcagataaaacctatcaacatttaacctgtcgtggtgtgatgtattacgatgccaataataccagtgagttcgcaaccagcttgcaagccaaaaaatcagcatcgacagaatgcccacgtaaagtctttttacctgtgaatgatggtcgtctggttgctatcaatgcagatactggtaaggcatgctctgactttggtacgaagggtgaagtcgatttacaaaagttgatgccatatgcttatccaggcggttataacccaacatcgccaggtattgtttctggtacaacagtggtgattgcaggttctgtcacagataactactccaataaagagccatcaggtgtcattcgtggttacgatgtaaacacgggtaaactgctttgggcatttgatacgggtgcacaagatccaaatgcacttcctggcgaaaattcgacgtttgtacacaattctccaaatgcatgggcgccattggcatacgatccgaagctggatatcgtctatgtaccaacaggtgtcggtacgccagatatctggggtggagatcgtaccgagttgaaagagcgttatgcaaattcaatgctggcaatcaacgccacaaccggtaaacttgtttggcatttccagaccacacatcatgatttgtgggatatggatgtaccatcacagccttcactggcagatgttaaagacaagtctggtcagactgttccagcgatttatgtgttaaccaaaacaggcaatgtttttgttctagatcgtcgtaatggtaaggcgattgtgccaattacagaaaaagcggtaccacagaccgtgaaacgtggcccacaaaccaagggtgaacgttattctgcgacacaaccattttctgcacttgatttagcaccaaaagacaaacttacagacaaacaaatgtggggtgccacaatgtttgatcagttgatgtgtcgcgtgtcattcaagcgtctgaactatgacggtatttatacaccaccatctgaaaacgggactttagtgttcccaggaaatctgggtgtatttgaatggggtgggatgtcggtcaatcaggatcgtcagattgcagtcatgaatccgttggcgctaccgtttgtgagccgtctgattccgatggatccgaaccgtaaggaaactgcacgtggtgcaggaacagagcatggtattcaaccgatgtatggtgtgccttatggtgtggaaatcaatgcattcttgtcgcctcttggtttgccttgtaagcagcctggctggggctatattgctggtgtcgatttaaattcacatgaagtggtctggaaaaaacgtatcggtactatccgtgatagtttgccaaatctattccagttgccagcacttaaaattggtgtacctggcttgggtggaaccatttcaactgcaggtaacgtaatgtttgttggtgcaacccaggataactatatccgtgcgtttaatgttagtaatggtgaaaaactgtgggaagcacgtttaccagcaggtggtcaagccacaccgatgacctatgaaatcaatggtaaacaatatgtggtaattatggcgggtggtcatggttcatttggcaccaagatgggtgactatcttgtggcttatgcattgccggataccaaataa

SEQ ID NO: 49772 - protein, 801 aa, Acinetobacter sp. ADP1
MSQPSSNSGLRTLTVVIAAVIGLFLLVGGIWLTVLGGSFYYVIAGLALLIFAWLLLKRSSTSIWLYAALMLGTTLWGIWEVGTDFWALAPRLDILGVLGLWILIPAVSRGMDNAKSSKIALSSTLVIAIVVMVYSIFNDPQEINGVIKNEQPKTAQAVEGVDAADWPAYGRTQGGVRYSPLTQINDQNVKDLKVAWTFRTGDLKTANDSGETTNQVTPIKVGNNMYMCTTHQWLIALDPATGKEKWRFDPKLKADKTYQHLTCRGVMYYDANNTSEFATSLQAKKSASTECPRKVFLPVNDGRLVAINADTGKACSDFGTKGEVDLQKLMPYAYPGGYNPTSPGIVSGTTVVIAGSVTDNYSNKEPSGVIRGYDVNTGKLLWAFDTGAQDPNALPGENSTFVHNSPNAWAPLAYDPKLDIVYVPTGVGTPDIWGGDRTELKERYANSMLAINATTGKLVWHFQTTHHDLWDMDVPSQPSLADVKDKSGQTVPAIYVLTKTGNVFVLDRRNGKAIVPITEKAVPQTVKRGPQTKGERYSATQPFSALDLAPKDKLTDKQMWGATMFDQLMCRVSFKRLNYDGIYTPPSENGTLVFPGNLGVFEWGGMSVNQDRQIAVMNPLALPFVSRLIPMDPNRKETARGAGTEHGIQPMYGVPYGVEINAFLSPLGLPCKQPGWGYIAGVDLNSHEVVWKKRIGTIRDSLPNLFQLPALKIGVPGLGGTISTAGNVMFVGATQDNYIRAFNVSNGEKLWEARLPAGGQATPMTYEINGKQYVVIMAGGHGSFGTKMGDYLVAYALPDTK

SEQ ID NO: 49773 - DNA, 1806 bp, Methylococcus capsulatus str. Bath
  CDS (1)..(1806)
atgcaaatttgcaaactggcaagtggctgcggcgggtcgatgctggcgatggccgccgtgctagccgcgcaatccacgcacgccaattcggagctggaccggctgtcgaaggacgaccggaactgggtcatgcagaccaaggactacagcgccacccacttcagccggctgacggaaatcaatagccacaacgtcaagaacctgaaggtggcctggaccctgtccaccggcacgttgcatggccacgaaggtgcgccgttggtggtggacggcatcatgtacatccacacgccgttccccaacaacgtctatgcagtcgacctgaacgacacccgcaagatgctgtggcagtacaagcccaagcagaatccggcggcccgcgcggtggcttgctgcgacgtggtcaaccgcggtctggcctacgtgccggccggcgagcacggtccggcgaagatcttcctcaaccagcttgacggccacatcgtcgcactcaacgccaagaccggcgaagagatatggaagatggaaaattccgacatcgccatgggctccaccctcaccggcgcgcctttcgtggtgaaggacaaggtactggtaggttcggccggggccgagctgggcgtgcgtggctacgtcacggcctataacatcaaggacggcaagcaggagtggcgggcctatgccaccggtcccgacgaagacttgttgctggacaaggacttcaacaaggacaacccgcattacggtcagttcggcctggggctctcaacctgggagggtgatgcctggaagatcggcggcggcaccaattggggctggtatgcctatgatcccaagttggacatgatctactacggttccggcaatccggcaccctggaacgagaccatgcggcccggcgacaacaaatggaccatgaccatctggggccgcgacgccgacaccggccgcgccaagttcggctaccagaagacgccgcacgacgagtgggattacgccggtgtcaactacatgggtctgtccgaacaggaagtggacggcaagctgacgccgctgctgacccatcccgaccgcaacggtctggtgtatacgctgaaccgggaaaccggcgccctggtcaatgccttcaagatcgatgacaccgtcaactgggtgaaaaaggtcgatctgaagaccggcctgccgatccgcgatccggagtacagcacccgcatggaccacaatgccaaaggcatctgtccctcggccatgggctatcacaaccagggcatcgagtcctacgatccggacaagaagctgttcttcatgggcgtgaaccacatctgcatggactgggagccgttcatgctgccctaccgcgccggccagttctttgtgggggcgaccctcaacatgtatccgggacccaaggggatgctgggtcaggtcaaggcgatgaacgcggtcaccggcaagatggaatgggaagtgccggagaagtttgcggtctggggtggcaccttggcgaccgccggcgacctcgtgttctacggtaccctcgacggcttcatcaaggcccgcgacacccgtaccggcgagctgaagtggcagttccagttgccctccggcgtgatcggccatcccatcacctatcagcacaacggcaagcaatacattgccatctactccggcgtcggcggctggccaggagtagggctggtattcgacctgaaggacccgaccgcaggtctgggagctgtgggtgcgttcagggaactggcgcattacacccagatgggtggatcggtgttcgtgttctcgctttga

SEQ ID NO: 49774 - protein, 601 aa, Methylococcus capsulatus str. Bath
MQICKLASGCGGSMLAMAAVLAAQSTHANSELDRLSKDDRNWVMQTKDYSATHFSRLTEINSHNVKNLKVAWTLSTGTLHGHEGAPLVVDGIMYIHTPFPNNVYAVDLNDTRKMLWQYKPKQNPAARAVACCDVVNRGLAYVPAGEHGPAKIFLNQLDGHIVALNAKTGEEIWKMENSDIAMGSTLTGAPFVVKDKVLVGSAGAELGVRGYVTAYNIKDGKQEWRAYATGPDEDLLLDKDFNKDNPHYGQFGLGLSTWEGDAWKIGGGTNWGWYAYDPKLDMIYYGSGNPAPWNETMRPGDNKWTMTIWGRDADTGRAKFGYQKTPHDEWDYAGVNYMGLSEQEVDGKLTPLLTHPDRNGLVYTLNRETGALVNAFKIDDTVNWVKKVDLKTGLPIRDPEYSTRMDHNAKGICPSAMGYHNQGIESYDPDKKLFFMGVNHICMDWEPFMLPYRAGQFFVGATLNMYPGPKGMLGQVKAMNAVTGKMEWEVPEKFAVWGGTLATAGDLVFYGTLDGFIKARDTRTGELKWQFQLPSGVIGHPITYQHNGKQYIAIYSGVGGWPGVGLVFDLKDPTAGLGAVGAFRELAHYTQMGGSVFVFSL

SEQ ID NO: 49775 - DNA, 2331 bp, Idiomarina loihiensis L2TR
  CDS (1)..(2331)
atgattttattcgctattctaattgcacttcttggccttgccttaacggccggtggcgtctacctgctcacacttggcggcagcccctactaccttctggcgggcctggtcttactattaaacgcctggcttggttacaaacgtcatccgttaacacgcactttgttcgctgtatttctgatcctcaccatgctgtggtcatcgtgggaatccggttatgactggtgggcattagcgccgcgcataggtttatttttggtgctggccatacctttgctgttttccaaagaggcagacaacggcgggcgcaaagtattgctcccggtctgggccgttcttgcactaatgacactgggcagcgttctggcaaacccacatgacttatccggaaagctcgatacgcaagtagacagcgaatctcctaaactgggcaactctccggaagacagttggtacgcttatggccggactaatatgggtcagcgttattcgccactggataaaattaccaccgaaaatgtggggcagttggaagaagcctggcgttacagcactggtgacatgaagggccctaaagacgtgggtgaaaccacctatgaagcaacaccattgaaaattggcgatacgctttatttgtgtacgccgcacaactggttagtcgcactggatgccaacaacggctctaaacgctgggtatttgacgccaaagtgccacctgaaagtcagcgccagcatcaaacctgtcgcggtgtgtcctatttgccacccagctccggtgaagcgccgtctgctgaaaagctggatatagcagccgaaactcaggctccggtgcagtgtgacgcagagctctttttgccaacttccgatgcccgtttaattgcaattgacccgaccacaggcgcacgctgtgcaaactttgccgataacggtgaactggatttaacccacaatatgccgttcaaacaagccggttactattactctacgtcgccgccagttgtagcgaatggcgtagtggtagttgcaggctcggtaaatgacaactacgacaaaaactcaccttccggcgttattcgtgcctatgacgtaaaaactggcgagctggtatggaactgggattccggtaacccggatgaaaccgctcctattgccgaagacgaagtttacactaccagttctcctaacagctggtcggtagccagtgctgatgaagagctgggtcttatttactttcctatggggaaccgcactcccgatcagttgggttggtatcgctctgaaaatgaagagaaatattccagctctgtggttgcgctaagccttaaaaccggacaggtagagtgggtacaacaatttgttcatcatgacctgtgggacatggatacccctgctcagccggtactactcgacttagataccgtaagcggaaaacagccggctcttgtggtacccactaagcaaggcgatgtgtacgtgctgaatcgtgaaaccggcgaacctatatttccgattaccgaaaaatcagcacctcagggaacggtggctctggataatgcctcgccaacacagccaatttcagcgctaaccttccgtccacccaccatgactgaaaaagacatgtggggagcgacaccgctggatcagatgatgtgccgtattcagtttaagtcactgcgctatgaaggtcagtacacgccgccatcagaacaaggcacactggtatatccgggtaactttggggtcttcaactggggcagtgttgcagtagacccaaaacgtcaggttatgttcggtatgcctttatacctggccttcacacaaaggctggttaaaaaagacggctccgacatgggtccggccaaccagggagaacaaggcctgaactcaaacgacggcgcgccttatgcagtggatatgaagcctttactttctccgctaggtgttccctgtcagcagccaccatggggctacgtggccggtgttgacctgaaaaccggcgaaaccgtatacaagcataaaaacggtactgtccgtgacctgacaccgcttccgctgccaattaaaatgggcgtccccggtattggtggccctgtcatcaccgaaggtggtctggtctttatggcagccgctgtcgataactacctgcgcgcttatgacttatccaccggtgaagaactttggcgtgcacgtttgccagctggaggacaggccacaccaatgacctatttgaacagccagggtgaacaaatggtggttcaggtagccggtggtcacggctctataggcaccaccattggcgattatgtgattgcctataaactcaaacgctaa

SEQ ID NO: 49776 - protein, 776 aa, Idiomarina loihiensis L2TR
MILFAILIALLGLALTAGGVYLLTLGGSPYYLLAGLVLLLNAWLGYKRHPLTRTLFAVFLILTMLWSSWESGYDWWALAPRIGLFLVLAIPLLFSKEADNGGRKVLLPVWAVLALMTLGSVLANPHDLSGKLDTQVDSESPKLGNSPEDSWYAYGRTNMGQRYSPLDKITTENVGQLEEAWRYSTGDMKGPKDVGETTYEATPLKIGDTLYLCTPHNWLVALDANNGSKRWVFDAKVPPESQRQHQTCRGVSYLPPSSGEAPSAEKLDIAAETQAPVQCDAELFLPTSDARLIAIDPTTGARCANFADNGELDLTHNMPFKQAGYYYSTSPPVVANGVVVVAGSVNDNYDKNSPSGVIRAYDVKTGELVWNWDSGNPDETAPIAEDEVYTTSSPNSWSVASADEELGLIYFPMGNRTPDQLGWYRSENEEKYSSSVVALSLKTGQVEWVQQFVHHDLWDMDTPAQPVLLDLDTVSGKQPALVVPTKQGDVYVLNRETGEPIFPITEKSAPQGTVALDNASPTQPISALTFRPPTMTEKDMWGATPLDQMMCRIQFKSLRYEGQYTPPSEQGTLVYPGNFGVFNWGSVAVDPKRQVMFGMPLYLAFTQRLVKKDGSDMGPANQGEQGLNSNDGAPYAVDMKPLLSPLGVPCQQPPWGYVAGVDLKTGETVYKHKNGTVRDLTPLPLPIKMGVPGIGGPVITEGGLVFMAAAVDNYLRAYDLSTGEELWRARLPAGGQATPMTYLNSQGEQMVVQVAGGHGSIGTTIGDYVIAYKLKR

SEQ ID NO: 49777 - DNA, 1821 bp, Silicibacter pomeroyi DSS-3
  CDS (1)..(1821)
ttggggtggttcggcttggagaggatgcaagggaggaaaccgatgaacaagatcatcatggccgcagtggcgggcctggtcgcgacggcgggctggcacagcgccgcgctggcggccggtgtcaccgaagaggacctggccaatgacacggccaacacgtccagcgtattgaccaacggcatgggccggcatttgcagcgctacagcccgctggacattctgaacaaggacaacgtcaagaacctgatgcccgcttgggccttcagcctgggtggagagaagcagcgcgggcaggaaacccagccgctgatccatgacggggtgatgtatatcaccggctcctacagccgcatgtatgccatcgacgtcaacaccggcgaagagctctggcaatatgacgcccgcctgcccgagggcatcctgccctgctgcgacgtgatcaaccggggcggcgccatctatggcgacaagatctatttcggcacgctcgacgcccgtatcgtggcactcgacctgaaaaccggcgatgtcgtctggaacaagaagatcgccgattacaaggcaggctactcctataccgccgcgccgctgatcgtgaaggggctggtgatcaccggcaactcgggcggtgagttcggcattgtgggcgaggtgcaggcgcgcgacgccgagaccggcgagatggtctggacccgtccggtgatcgaaggtcacatgggcactttcaaaggcgaagaaagcaccatgaccggcacgctgaacgcgacctggccgggcgacatgtggaaaaccggcggcggcgccacctggctgggcggctcgtatgacgccgagaccgatacgctggtctttggcgcgggcaaccccgccccctggaacagctggctgcgcgatgccggtcagaacaacgatggcaagggtgacaacctttatgccgccagccgcatcggcatcaatcccgacaatggcgagatcaagtggcatttccagaccaccccgcgcgagggctgggactatgacggtgtgaacgaggtcgtggcctataccgaccgcgacggcaacaagcgctgggccaccgccgaccgcaacgggtatttctacgtgctgaaccgcgaggacggcaaattcgtgcgcggcgtgccatttgtgaaggatatcacctgggcctcgggcctggatgagaacggccgcccgatcttcaacgaggacaaccgcccgggcgacccggcggcagcggccgatggcgccaagggcgaggtgatctttgcctctccctcgttcctgggcggcaagaactggatgccgatggccttcagccagaagaccggcaatttctatgtcccctcgaacgaatggggcatggatatctggaacgagccgattacctacaagaagggcgcggcctatctgggcgcgggctttaccatcaagccgaactacgaggaccatatcggcagcctcaaggcgatcgatcccgataccggcgagctgaagtgggagttcaagaacgacgccccgctctggggtggcgtgatgaccactgcgggcgggctggtgttcaccggtacgcccgagggcaagttcatcgcctttgacgacgaaaccggcgagatcctgtggtcgttccagaccggatcgggcattgtcggccagccggtcacctgggagatggacggcgagcaatatgtttcggtcatctccggctggggcggcgcggtgccgctctggggtggcgaggtcgccaagaaggtgaactatctcaaccagggcggcttgctctggaccttcaagctgcccaagcagctggccgccgccaactga

SEQ ID NO: 49778 - protein, 606 aa, Silicibacter pomeroyi DSS-3
MGWFGLERMQGRKPMNKIIMAAVAGLVATAGWHSAALAAGVTEEDLANDTANTSSVLTNGMGRHLQRYSPLDILNKDNVKNLMPAWAFSLGGEKQRGQETQPLIHDGVMYITGSYSRMYAIDVNTGEELWQYDARLPEGILPCCDVINRGGAIYGDKIYFGTLDARIVALDLKTGDVVWNKKIADYKAGYSYTAAPLIVKGLVITGNSGGEFGIVGEVQARDAETGEMVWTRPVIEGHMGTFKGEESTMTGTLNATWPGDMWKTGGGATWLGGSYDAETDTLVFGAGNPAPWNSWLRDAGQNNDGKGDNLYAASRIGINPDNGEIKWHFQTTPREGWDYDGVNEVVAYTDRDGNKRWATADRNGYFYVLNREDGKFVRGVPFVKDITWASGLDENGRPIFNEDNRPGDPAAAADGAKGEVIFASPSFLGGKNWMPMAFSQKTGNFYVPSNEWGMDIWNEPITYKKGAAYLGAGFTIKPNYEDHIGSLKAIDPDTGELKWEFKNDAPLWGGVMTTAGGLVFTGTPEGKFIAFDDETGEILWSFQTGSGIVGQPVTWEMDGEQYVSVISGWGGAVPLWGGEVAKKVNYLNQGGLLWTFKLPKQLAAAN

SEQ ID NO: 49779 - DNA, 2346 bp, Rhodobacter sphaeroides 2.4.1
  CDS (1)..(2346)
ttgaccgctaccctgaccgccatcgtccttgccctcgccgggctgggcctcctcatcccgggcgcctggctggccgttctgggcgggagctggttctacctcgtggccggagccctcatgctgctgacggcatggcaggtgttccgccgctcctcctccgccgaatggatctatggcggcctcatcctcggcgcgctcgtctggtccgtctgggaagtgggcttcgactggtgggaactcattccccgcggcggcatcatcgcgcttctgggcatctggctctacctgcccttcatgcggcggcagctgctgaccgaggacggccgccccgcgcccggcctgcccttggccctgccccttctggcggccatcggggccgccatctggtcatggaccggagacgaagcgggacatgcaggctcgctgccgacggaagtggtcagcgccgagcccgatctcggcccctccgcgcctcccggcgagtggcaccagtacggccgcacgcagtacgggcagcgctacagcccgctcgaacagatcaacatccagaatgtcgccgagctcgagcaggtctggcagtatcagaccggcgatgtgaagctgccgcaggacgtgaccgagaccacctatcaggtcacgccgctgaaggtcgccgaccgtctctacatctgcaccccgcacgatctggccatcgcgctcgatgcggcgaccggcaaggaagcctggcgcttcgacgcgcgctccgggctcgagtccgaccggcagcaccagacctgccgcggcgtgacctactggcgggatccggcacgcgccgagggagagctctgcgccgagcgggtctatctgccgacggccgatgcgcggctgatcgcgctcgacgcaaagtccggcgcggtctgcaccttcttcgccgacgagggtacgctccatctcgagaacgggatgccctacaccccggcaggcttctactattccacctccccgcccgtggcggtcggaggccggatcatcatcggcggcgcggtcaacgacaatttctcggtctattcgcagtcgggcgtgatccgggccttcgatgccaacaccggggcgctcctgtggaactgggacagcgccaaccccgacaagaccgcccccatcgactggatgaacggcgagacctataccgcaaattcgcccaactcctggtcggtcttctcggtcgatgaggaacgcggcctcgtctacatcccgctcggcaaccaggtccccgaccagctgggcttcaaccgctcgcccgccgtcgaggaacattcctcctcggtcgtggcgctcgacgtggcgacgggtcagaaggcctgggtgttccagaccgtgcaccatgacctgtgggacatggacgtgcccgcccagcccgttctgatcgatctcgacatcgacggtcagacggtgcccgcgctcgtgcagccgacgaagcagggcgacatctatgtgctcaaccgcgagacgggcgagccgatcctgcccgtcaccgaagagcccgccccgcaggagggcgctctgcgcgaagagacccctgccccgacgcagcccacctcggcgctgagcttcaaacccgaggcgctgcgcgagaaggacatgtggggcgtcacgctctacgaccagctcgcctgccggatccagtatcaccggttgaactacgagggccgctacacgcccccgtcgctgaacggcaccatcgtctatccgggcaatttcggcaccttcaactggggctccgtcgccgtcgatcccgagcggcaggtgatgttcggcatgcccacctacctgcccttcacgagccagctggttccggccgaggacatcccgccgcccggcgcagatcagaaggccagcgaacagggcctgaaccgcaacgagggcgcgccctacggcgtcatcatggggcccttcctcgggccgctcggcgtgccctgctcggcgccgccgtggggcttcgtcgcgggggcggacctccgcaccggagagatcgcctacatgcaccgcaacggcaccgtgcgcgacatgacgcccctgccgctgcccttcaaggtgggcgtgccggggatcggcgggccgatcgtcacgcgcggcggcgtggccttcctcggagcggcggtcgacgactacctgcgcgcctacgatgtgaccacgggcgatcagctctggcaggcgcggctgcccgcgggcggccagtcgacgccgatgacctacgagcaggacggccggcagttcgtggtgatcgtggcgggcgggcacggctcggtcggcacgaaaccgggcgactatgtgatcgcctacgccctgcccgacggctcggagggttga

SEQ ID NO: 49780 - protein, 781 aa, Rhodobacter sphaeroides 2.4.1
MTATLTAIVLALAGLGLLIPGAWLAVLGGSWFYLVAGALMLLTAWQVFRRSSSAEWIYGGLILGALVWSVWEVGFDWWELIPRGGIIALLGIWLYLPFMRRQLLTEDGRPAPGLPLALPLLAAIGAAIWSWTGDEAGHAGSLPTEVVSAEPDLGPSAPPGEWHQYGRTQYGQRYSPLEQINIQNVAELEQVWQYQTGDVKLPQDVTETTYQVTPLKVADRLYICTPHDLAIALDAATGKEAWRFDARSGLESDRQHQTCRGVTYWRDPARAEGELCAERVYLPTADARLIALDAKSGAVCTFFADEGTLHLENGMPYTPAGFYYSTSPPVAVGGRIIIGGAVNDNFSVYSQSGVIRAFDANTGALLWNWDSANPDKTAPIDWMNGETYTANSPNSWSVFSVDEERGLVYIPLGNQVPDQLGFNRSPAVEEHSSSVVALDVATGQKAWVFQTVHHDLWDMDVPAQPVLIDLDIDGQTVPALVQPTKQGDIYVLNRETGEPILPVTEEPAPQEGALREETPAPTQPTSALSFKPEALREKDMWGVTLYDQLACRIQYHRLNYEGRYTPPSLNGTIVYPGNFGTFNWGSVAVDPERQVMFGMPTYLPFTSQLVPAEDIPPPGADQKASEQGLNRNEGAPYGVIMGPFLGPLGVPCSAPPWGFVAGADLRTGEIAYMHRNGTVRDMTPLPLPFKVGVPGIGGPIVTRGGVAFLGAAVDDYLRAYDVTTGDQLWQARLPAGGQSTPMTYEQDGRQFVVIVAGGHGSVGTKPGDYVIAYALPDGSEG

SEQ ID NO: 49781 - DNA, 1803 bp, Rhodobacter sphaeroides 2.4.1
  CDS (1)..(1803)
atgaagatgctgaagacgggtctcgtagcgaccctattgctctcgtctgcgccggtctttgccaacgactcggtcctcaaggcgaccgacgatccgaagcagtgggcgatccagaccggcgactatgccaacacccgctattccgagctgaaccagatcacccgcgagaacgtgggcaagcttcaggtcgcctggaccttctcgaccggcgtgctgcggggccacgagggctcgcccctcgtcgtggacggcatcatgtatgtccacacgcccttcccgaacaacgtctatgcgctcgatctggccaatgacggcaagatcctgtggcgctacgagccgcagcagaaccccgacgtcatcggcgtgatgtgctgcgacacggtcaaccgcggcgtggcctatgccgatggcatgatcttcctgcatcaggccgatacgaccgtcgtggccctcgacgcgaagagcggcgaggtgaaatggaccgtgcagaacggcgacccggccaagggcgagaccaacaccgcgaccgtgctgccggtcaaggacaagctcctcgtcggcatctcgggcggcgagttcggcgtgcgcggccatgtcaccgcctatgacatgaagacgggcaagcaggtctggcgcgcctattccaccggccccgacgccgagatgctggtcgatccggaaaagaccatggtgctcggcaagcccgtgggcgccgacagctcgatcaagagctgggaaggcgaccagtggcagatcggcggcggcaccacctggggctggtattcctacgaccccgacctgaacctcgtctattacggcaccggcaacccctcgacctggaacccgtcgcagcgtccgggcgacaacaagtggtccatgaccatcatggcccgcgatgccgataccggcatggccaagtggatgtatcagaagaccccgcacgacgagtgggactatgacggggtaaacgagaacatcctcgtcgatcaggagatcgacgggcagatgcgcaagctgctggtgaacctcgaccggaacggcttcggctacacgctcgaccgcgagacgggcgagcttctggtggcgaagaaatacgacccggcggtgaactgggcgaccgaagtggtgatggacaaggagtccgatcaatacggccgtccgcaggtggtggcggaatattcgacggcgcagaacggcgaagacaccaacaccaccggcgtctgcccggccgcgctcggctccaaggaccagcagcccgcctccttctcgcccaagaccggcctcgtctatgtgccgacgaaccacgtctgcatggactacgagccctaccgggtcagctactcggccggccagccctatgtcggcgccaccctctcgatgtatccggcgccgaacagccatggcggcatgggcaatttcatcgcctgggacgcgacgaagggcgagatcaaatggtcgctgcccgagcagttctcggtctggtcgggggctctggccaccgcgggtgacgtggtgttctacggcacgctcgaaggctatctgaaggccgtcgatgcggagacgggcgagctgctctatcgcttcaagaccccgtccggcgtcatcggcaacgtgatgacctacgagttcaacggcaagcagtatgtgggcgtgctctcgggcgtcggcggctgggcgggcatcggcctcgccgcgggcctgaccaaccccaacgagggtctgggcgccgtgggcggctatgccgcgctgtcggactatacccagctcggcggtcagctcaccgtctttgccctgccggactga

SEQ ID NO: 49782 - protein, 600 aa, Rhodobacter sphaeroides 2.4.1
MKMLKTGLVATLLLSSAPVFANDSVLKATDDPKQWAIQTGDYANTRYSELNQITRENVGKLQVAWTFSTGVLRGHEGSPLVVDGIMYVHTPFPNNVYALDLANDGKILWRYEPQQNPDVIGVMCCDTVNRGVAYADGMIFLHQADTTVVALDAKSGEVKWTVQNGDPAKGETNTATVLPVKDKLLVGISGGEFGVRGHVTAYDMKTGKQVWRAYSTGPDAEMLVDPEKTMVLGKPVGADSSIKSWEGDQWQIGGGTTWGWYSYDPDLNLVYYGTGNPSTWNPSQRPGDNKWSMTIMARDADTGMAKWMYQKTPHDEWDYDGVNENILVDQEIDGQMRKLLVNLDRNGFGYTLDRETGELLVAKKYDPAVNWATEVVMDKESDQYGRPQVVAEYSTAQNGEDTNTTGVCPAALGSKDQQPASFSPKTGLVYVPTNHVCMDYEPYRVSYSAGQPYVGATLSMYPAPNSHGGMGNFIAWDATKGEIKWSLPEQFSVWSGALATAGDVVFYGTLEGYLKAVDAETGELLYRFKTPSGVIGNVMTYEFNGKQYVGVLSGVGGWAGIGLAAGLTNPNEGLGAVGGYAALSDYTQLGGQLTVFALPD

SEQ ID NO: 49783 - DNA, 1704 bp, Magnetospirillum magnetotacticum MS-1
  CDS (1)..(1704)
atgctcgctctgcttgcagccttcaatgtgagcgccaagccggtaaccgatgccgacatcgccaatgatgccaacaatacctccgaagtcctgacctacggcatcggcacccaggcccagcgtttcagccagctggacaagctcaacaccgacacggtggccaagctgacgccggtatgggcctattccttcggcggcgagaagatgcgcggccaggaaagccagccgctgatccaggacggcaccatctacgtgaccggttcctattcgcgcctcttcgcgctggacgccaagaccggcaagcacaaatggacctacgaggcccgtcttcccgacggcatcatgccctgctgcgacgtcatcaaccgtggcgcggcgctctatgacaatctggtgatcttcggaaccctggacgccaagctggtggccctggacaaggagaccggcaaggtcgtctggaagaaggacatcgaggattacaaggccggctattccttctcggccgcgcccctgatcgtcaagggcaagatcatcaccggcgtgtcgggtggcgaattcggcatcgtcggcaaggtcgaggcacgcgatcccaagaccggcgagctgatctggtcgcgtcccaccgtcgagggccatatgggcacgctcaacggcaaggagaacggcatcaccggcaccaccaatgcttcctggcccggcgatatgtggaagtcgggcggtgcggccacctggctgggcggaacctacgaccccgaaaccaacctgattttctacggtaccggcaatccggcgccctggaacagccatacccgtcccggcgacaatctctatagcgcctcgaccctggccatcgaccccgataccggcaagatcgtctggcattaccaaaccacgccccatgacggctgggatttcgacggcgtcaacgagctggtctcgttcgatctggtcaaggatggcaagaccatcaaggcgggcgccaaggccgaccgcaacggctatttcttcgtgctcgaccgcaccaacggcaagttcatcagcgcgacgcccttcgtgaacaccatcacctgggccaccggcttcgattcggcgggcaagcccaaattcgttcccgacaaccgtcctggcaagcccacggccgatggcaagggcaagtctgtcttcgcggctccggccttcctgggcgccaagaactggatgcccatggcctataacccggacaccaagctgttctacgtcccggccaatgaatggggcatggatatctggaacgagccggtcacctacaagaagggcgccgcctatctgggcgccggtttcaccatcaagccgctgcacgacgactatatcggcgcgctccgcgccatcgatccggccaccggaaagatcgtttgggaatacaagaactccgccccgctgtggggtggcgtgctgaccaccaagggcaatctggtcttcaccggaacccccgaaggcttcctcaaggccttcgatgccaagaccggccaggaattgtggaagttccagaccggctcgggcgtggtgggtgtgcccgtgacctgggaaatggacggcgagcagtatgtggccgtcgcctcgggttggggtggcgccgtgccgctgtggggcggcgaggtcgccaagaaggtcaaggacatcagccagggcggcatgctttgggtgttcaagttgcccaagtcctag

SEQ ID NO: 49784 - protein, 567 aa, Magnetospirillum magnetotacticum MS-1
MLALLAAFNVSAKPVTDADIANDANNTSEVLTYGIGTQAQRFSQLDKLNTDTVAKLTPVWAYSFGGEKMRGQESQPLIQDGTIYVTGSYSRLFALDAKTGKHKWTYEARLPDGIMPCCDVINRGAALYDNLVIFGTLDAKLVALDKETGKVVWKKDIEDYKAGYSFSAAPLIVKGKIITGVSGGEFGIVGKVEARDPKTGELIWSRPTVEGHMGTLNGKENGITGTTNASWPGDMWKSGGAATWLGGTYDPETNLIFYGTGNPAPWNSHTRPGDNLYSASTLAIDPDTGKIVWHYQTTPHDGWDFDGVNELVSFDLVKDGKTIKAGAKADRNGYFFVLDRTNGKFISATPFVNTITWATGFDSAGKPKFVPDNRPGKPTADGKGKSVFAAPAFLGAKNWMPMAYNPDTKLFYVPANEWGMDIWNEPVTYKKGAAYLGAGFTIKPLHDDYIGALRAIDPATGKIVWEYKNSAPLWGGVLTTKGNLVFTGTPEGFLKAFDAKTGQELWKFQTGSGVVGVPVTWEMDGEQYVAVASGWGGAVPLWGGEVAKKVKDISQGGMLWVFKLPKS

SEQ ID NO: 49785 - DNA, 2406 bp, Azotobacter vinelandii
  CDS (1)..(2406)
atggtcacgacaagggcggcgcagccgctgcgcatcacgctgaccgggatactggcgctgctgatgggcgccctgttggcgctcggcggcgcctatctggcggtcctgggcggctcctggtactacctgctcgccggcctcgggctgctggccgtgggcatcctgatcctggcgagacggcggctggcgatctggctgtatgccgtgctgctgctcgccaccctggcctggacgattcacgaggccggctccgactggtggcggctggcggcgcgcatcgacctgtggtgggtgctggggctctggctgctgctgcccttcgtcaaccgccatatcggcgtcccggcgcgctggcgggacggcgccagcggcctgctcggcatcgctctgctgctcggcgcactgctggccggttacgcgctgacccgggaccattcgcgcatcgccggcgagttcggtgccgagcgcatggccggcgcaagcccggcgggagcggccgaccgctcggcgagcgagtggccggcatacggcggctcggcgcgcggcgaccgctactcggcggccgacctgatcacccccggaaacgtcggacggctgaagaaggcctgggaataccataccggcgactggccccgcgaaggcgacccggccgaattcaccaaccaggtcacgccgctgaagatcggcgacagcctgttcatctgcaccccccacagcatcgccatcgccctggacgcggacagcggcgaggaactgtggcgcttcgatccgaacatcaaccgcgaggccaagtactaccagcacatgacctgccgcggcctggcctatcacgatgcggcggcctaccccggcgccggcggcgaggccgccgccggcgttcccgcgcgctgcagccgcaggctgttcctgccgaccaacgacgccacgctgtacgcgctggaccccggcgacggcaagccgtgcgaggacttcggcacgggcggcatgatcgacctgaaggtgggcctgggcgaccaggccctgggggtgtacctgccgacctcgccgccggtggtgaccgagaagctgctgatcgtcggcggctcggtgaccgacaacggctcggtggactcccccggcggggtgatccgcgcctacgacgtgcgcagcggcgcgctggtgtggaactgggacccgggcaacccggaagccaccgagcccctgccggcgggcgggacctacgtgcgcagcacgccgaactcctggaccatcgccgtggccgacgaagggttggggctggtcttcatccccaccggcaaccagaccccggaccagtggggagcgcggcgctcgccgcaggccgagcgtttcaccgcggccctggtggcgctcgatctggccagcggcaaggtgcgctgggaattccaggccgtgcaccacgacctgtgggaccgcgacctgccttcgcaaccgacccaggtcgatctcgacggcccgcagggcaaggtgccggcgatcatccaggcgaccaagggcggcgatctgttcgtgctggaccggcgcaccggccagcccgtggtgccagtgcgcgagcggcccgtgccgcagggcgcggtcacgggcgatttcaccgcaccgacccagccggcctccgatctcagctacgccccgcaggagccgctgcgcgagcgcgacatgtggggcgccacgccgttcgatcaactgctgtgccgcatccgcttccgccagttgcgctacgagggggacttcacgccgccgagcgagcagggctcgctgatctaccccggcaatgtcggcaccttcaactggccatcgctggcggtcgatccgcagcggcaactgctgttcgccgcgcccaactacctggccttcgtctcgcggctggtcgagcgcggcgaggtcgaggccggggaacgccgcgaaggcggcggcgaactcggcctgcagcccaatctcggtgctccctacctggtgcacctgggaccgttcgtctccccgctgggcctgccctgccagtcgcccccctggggctacgtcacggcggtggatctgcgcagcatgcagccggtgtggatgcacaagaacggcaccagccgcgacaacgcgccgttcatcccgttcgccgtgggcgtgcccgcgctgggcgggcccctggtcaccgccggcggcgtggcctttctcagcggcacgctggattactacctgcgcgcctacgatctgcgcaacggcgaggaactgtggaaggggcgcctgcccgcgggtggccaggcgacgccgatcacctacctgtcggaaaagaccggcaagcagttcgtcgtggtgatggccggcgggcacagctcgttcggcacccggatcggcgactcgctggtcgcctggacactggaggacgagacggagcgctga

SEQ ID NO: 49786 - protein, 801 aa, Azotobacter vinelandii
MVTTRAAQPLRITLTGILALLMGALLALGGAYLAVLGGSWYYLLAGLGLLAVGILILARRRLAIWLYAVLLLATLAWTIHEAGSDWWRLAARIDLWWVLGLWLLLPFVNRHIGVPARWRDGASGLLGIALLLGALLAGYALTRDHSRIAGEFGAERMAGASPAGAADRSASEWPAYGGSARGDRYSAADLITPGNVGRLKKAWEYHTGDWPREGDPAEFTNQVTPLKIGDSLFICTPHSIAIALDADSGEELWRFDPNINREAKYYQHMTCRGLAYHDAAAYPGAGGEAAAGVPARCSRRLFLPTNDATLYALDPGDGKPCEDFGTGGMIDLKVGLGDQALGVYLPTSPPVVTEKLLIVGGSVTDNGSVDSPGGVIRAYDVRSGALVWNWDPGNPEATEPLPAGGTYVRSTPNSWTIAVADEGLGLVFIPTGNQTPDQWGARRSPQAERFTAALVALDLASGKVRWEFQAVHHDLWDRDLPSQPTQVDLDGPQGKVPAIIQATKGGDLFVLDRRTGQPVVPVRERPVPQGAVTGDFTAPTQPASDLSYAPQEPLRERDMWGATPFDQLLCRIRFRQLRYEGDFTPPSEQGSLIYPGNVGTFNWPSLAVDPQRQLLFAAPNYLAFVSRLVERGEVEAGERREGGGELGLQPNLGAPYLVHLGPFVSPLGLPCQSPPWGYVTAVDLRSMQPVWMHKNGTSRDNAPFIPFAVGVPALGGPLVTAGGVAFLSGTLDYYLRAYDLRNGEELWKGRLPAGGQATPITYLSEKTGKQFVVVMAGGHSSFGTRIGDSLVAWTLEDETER

SEQ ID NO: 49787 - DNA, 2376 bp, Pseudomonas syringae pv. syringae B728a
  CDS (1)..(2376)
atgattctcaaagtgaccggtatcgtcatcgcgatactcagcctcattctgctattcatgggggcgcaactggtggctgccggcggttcaccggcctactcgatgatcgccctgggtttgctggccacagcaaccctggtattcctgaaaagaaagtcggcacttaccctgtatgcggtgatgatgtgggggattctgctctggatcatctatgaagcgggcctggacaaatggcagtggatccctcgcggcgatctgtttgcactgatcggcctgtggctggccatgccctgggtcgtgcggccgctttatcaagcgcggtcgagcaccgataagcgtcgttttcatccgttgctgggcggtacgcttggcgtaatgctgctgatcgtgattgcgctgatgtttcacgatccgtacccgcagcaagggcggatcgacagcgtggcgaccgcccgcagcgccgagtcggcaggcagtgactgggctgcatatggcggtagcaacgcgggccagcgcttttccagcctcgatcagatcaccccggacaacgtcggcaagctgtcggtggcctgggaataccacaccggtgacttgcgcgatgaagacgaggatgccggcgagtacacctttgaagcgacgcccctcaagatcaacgaccgggtgtatgtgtgcacgcctcataacgaagtgcatgcgctgaacccgcagaccgggcaactggcctggaaatacacccccgagaaaaaacgctcgtatttgcagcagcaccagacctgccgtggcgtcagctactattcggcagcctccagcccgacaggccagccacaacagcccgctcaatgcgccaaacgcatcatcaccgcgactgcagatgccaggctggtagcgcttgatgccgacagcggcaacctgtgcagcgacttcggcagcggcggggtgatcgacttgagcttcaacatgggcacgatccgcccgcacgcgctgatgcagacatccgcgccactgattgcaggcgatctgatagtgatcggcagctcgatcatggataacggttataacgacggcaacccgtcgggtgtgattcgcgcctacgacgtcatcaccggcaggctggtatggaatttcgatccgcaaaacccggacaacacccagcctatagcggctgaccagagctatccgcaggacacgccggtcgcctgggcaaccctgagcgctgatgtcaaaaacggtctggtgtacgtcccgttcggcaacgcttcgcccgacgaaaccggcacccggcgtaaccccgacagcaacaccgagaagtttcgcgatgcactggtggctctcgacctgaagagcggcgcgctgcgctggaaattccagacctcgaacaatgacctttgggatcgcgacaacccatcgcagccctcactgctggatctgggaaaagacggtagccgccagcctgccctggtgttgccgaccaaagtaggcaacatctttgtgcttgaccgactgacgggcgagccgatcgtgcctgtcgatcaggtcagtgtgcgcaccgcgggcggtgttgaaggcgagcgctttgcacccacccagccggtctcgcgacttaacttcatcccgccggtgttgaccgagaagtccatgtggggcgttacgccttttgaccagatggcttgccggatcgcgtacaacacccttcgttatgacggtaacccttggacaccggccaccgagtcgggatcgctgatctatcccggcaacataggcgtgttcaactggggttcggtggccgtggaccctgaccgccagttgctgatcaccgcaccggtgcgcctggcgtatgtctacaacctgatcaagcgccccgcgcaggcccgggaaaaacgcctgttcactcaggagggcaagccctactggaacgagaacttcgacggtgactatgccatccgtatttccagattcgcctcgagccttggcattccgtgcacagcgccaccgtgggggaccatggccggggtcgatctgacgaccggcaagacccaatggatgcgccgggttggtaccaccaaaaacctcaagaccagcttcatgcagggacgttttccggtcggttttcccatgggcatggtcgcccatggcggtccgatggtgacggcaggcggattggcctttcacggcgcgacggcggataactttttccgcgcctacgacgtcaatagcggcgaagtgctctgggaacacgagttacccgcgggtggccaatcgattccttcgacgtataccggcaacgacggcaaacagtacgtggtcattgctgccggcggtcacggatcgctcggtacgacgttgggcgacagcgtgattgccttccgggttgattga

SEQ ID NO: 49788 - protein, 791 aa, Pseudomonas syringae pv. syringae B728a
MILKVTGIVIAILSLILLFMGAQLVAAGGSPAYSMIALGLLATATLVFLKRKSALTLYAVMMWGILLWIIYEAGLDKWQWIPRGDLFALIGLWLAMPWVVRPLYQARSSTDKRRFHPLLGGTLGVMLLIVIALMFHDPYPQQGRIDSVATARSAESAGSDWAAYGGSNAGQRFSSLDQITPDNVGKLSVAWEYHTGDLRDEDEDAGEYTFEATPLKINDRVYVCTPHNEVHALNPQTGQLAWKYTPEKKRSYLQQHQTCRGVSYYSAASSPTGQPQQPAQCAKRIITATADARLVALDADSGNLCSDFGSGGVIDLSFNMGTIRPHALMQTSAPLIAGDLIVIGSSIMDNGYNDGNPSGVIRAYDVITGRLVWNFDPQNPDNTQPIAADQSYPQDTPVAWATLSADVKNGLVYVPFGNASPDETGTRRNPDSNTEKFRDALVALDLKSGALRWKFQTSNNDLWDRDNPSQPSLLDLGKDGSRQPALVLPTKVGNIFVLDRLTGEPIVPVDQVSVRTAGGVEGERFAPTQPVSRLNFIPPVLTEKSMWGVTPFDQMACRIAYNTLRYDGNPWTPATESGSLIYPGNIGVFNWGSVAVDPDRQLLITAPVRLAYVYNLIKRPAQAREKRLFTQEGKPYWNENFDGDYAIRISRFASSLGIPCTAPPWGTMAGVDLTTGKTQWMRRVGTTKNLKTSFMQGRFPVGFPMGMVAHGGPMVTAGGLAFHGATADNFFRAYDVNSGEVLWEHELPAGGQSIPSTYTGNDGKQYVVIAAGGHGSLGTTLGDSVIAFRVD

SEQ ID NO: 49789 - DNA, 2535 bp, Psychrobacter sp. 273-4
  CDS (1)..(2535)
atggaaaaattcgtagcgatcattatggcagtttttgccgcccccttgcttatcggtggcgcttatctgctctctttaggcggtagtccatactatctctttgctggcattgtcatgctagcgacagcatttttattgttcaaaaaacattggagtgcttacgggctctacgctatttttatagtagcgactattgcttgggctctttgggagtccggcttttattggtgggcactggcacctcgtgttggcttcccattgatctttggtctattaatgttattgccgtgggtatctaataagatgcgcgggcagcgcgctcaagtagcgacaagcactgctaatagtgcaataactccaaacacggttaaaaagaatcctctttattattgggggttgctcgctagtgtggttgtaggtgcactcctttcttttgggagcttagcaaacaacgccacggacaagttaggtgaacttgatttaagtgcctctgataaagacacctctacaaatcttggcgattcattatcaactggcgaacaaacaccagatggcgaatggagcgcatatggccgtactgactatggccaacgctactctcctttgactcaaatcaccactgataatgtcaaagatttagagctggcttggcaaattcaaacgggtgatgttaaaggccctaacgatgttggcgagaccacttatcaggcaacgccgttaaaaatcggcaatgcgctgtacttatgtacgcctcataactgggtaatggcactagatgctgactctggtgagacactatggaagtttgatccaaaagtagaaaaaaacctacaacgccaacaccaaacctgtcgaggtgtgtcttactatgctggtcagtctggcacggatagcactcctccagtggctaataatgagacaagcagtaccattagcaatgcagctgtcagcaatcaacccgctgcaaccagcgatatgatagtgcaaaaaattgctggtaatacctttgaaaatgcatctaagcaatgcgatgctaagatatttatcccaacttctgatgccaaactatatgcactcgatccaaatactgggcaacgctgtcaagattttggtgaagatggcgcattagatttgatgcacaatatgccatttacacaggcgggctactactattcgacgtcgcctccgatagtggtaggcaatacgattgttgtggcaggggccgtcaatgacaactatgatgtaaattcaccttctggtgttatccgtgcttatgatgtcaatactggtgagctattgtggaactgggattcaggcgaccctgacaacaccgcgccttttgatgtcaatgatcctactcagacgtacaaaaccagctcgccaaattcatgggcgatcgctagtgctgatgaagagcttggtttggtttacttccctatgggtaaccgcacgccagatcagctgggcagctaccgaaacgctgctgaagaaaaatatgcaacctctgttgtcgcgttagatattaatacaggcgaagcgcgctgggtacagcagtttgtccatcatgatctttgggatatggatacacctgctcagccaacgttgcttgacttagatacagctgatggcgtccaacctgctttggttgtaccgaccaaacaaggtgatgtctatgtcttgaaccgcgcaacaggcgagcctattgtaccaatcaaagaacgtgatgcaccgcaaggctatctcattgcaggtgaacacgccgcacccactcagccttattctggtttgagttttgagccaccaatgttgaaagaaaaagacatgtggggtgccagcctgattgatcagatgatgtgccggattgaatttaaccagcttaattatgatggtcgttatacaccaccatcaacgaatggcagcatagtctatcctggtaactttggtacctttaactggggcggaatcgccgtcgatcctgaaaatggcgtgatgtttggtatgccaacttaccttgcctttacctcaaaactcattcccaaagaaacacttggtgatgttgaaaccaataaaggtgagcaaggtgtgaatgccaatgaaggcgcagattatgcggtagaaatgggaccgtttttatcaccgcttggcgtaccttgtcagcagccaccatggggcacgatagcaggtgctgatttggccacaggcgagattgcttatcaacgcaaaaatggtaccgtacaagacttatctcctattccattaaaattggagttaggtgtccctggtatcggtggacctatcatcactaaaggtggcgtcgcactcttatcagcggcgaccgaaaacaacttccgcgcttatgatttgaaaaatggtgatgtactatggaatgtgcgtattccagcaggtggtcaagccacgcctatgacttacttgaactctaaaggtgagcaaatggtagtattggttgctggtggacatggttcagtgggtacaaccattggtgattatgtcatggcctataagcttgctaagtga

SEQ ID NO: 49790 - protein, 844 aa, Psychrobacter sp. 273-4
MEKFVAIIMAVFAAPLLIGGAYLLSLGGSPYYLFAGIVMLATAFLLFKKHWSAYGLYAIFIVATIAWALWESGFYWWALAPRVGFPLIFGLLMLLPWVSNKMRGQRAQVATSTANSAITPNTVKKNPLYYWGLLASVVVGALLSFGSLANNATDKLGELDLSASDKDTSTNLGDSLSTGEQTPDGEWSAYGRTDYGQRYSPLTQITTDNVKDLELAWQIQTGDVKGPNDVGETTYQATPLKIGNALYLCTPHNWVMALDADSGETLWKFDPKVEKNLQRQHQTCRGVSYYAGQSGTDSTPPVANNETSSTISNAAVSNQPAATSDMIVQKIAGNTFENASKQCDAKIFIPTSDAKLYALDPNTGQRCQDFGEDGALDLMHNMPFTQAGYYYSTSPPIVVGNTIVVAGAVNDNYDVNSPSGVIRAYDVNTGELLWNWDSGDPDNTAPFDVNDPTQTYKTSSPNSWAIASADEELGLVYFPMGNRTPDQLGSYRNAAEEKYATSVVALDINTGEARWVQQFVHHDLWDMDTPAQPTLLDLDTADGVQPALVVPTKQGDVYVLNRATGEPIVPIKERDAPQGYLIAGEHAAPTQPYSGLSFEPPMLKEKDMWGASLIDQMMCRIEFNQLNYDGRYTPPSTNGSIVYPGNFGTFNWGGIAVDPENGVMFGMPTYLAFTSKLIPKETLGDVETNKGEQGVNANEGADYAVEMGPFLSPLGVPCQQPPWGTIAGADLATGEIAYQRKNGTVQDLSPIPLKLELGVPGIGGPIITKGGVALLSAATENNFRAYDLKNGDVLWNVRIPAGGQATPMTYLNSKGEQMVVLVAGGHGSVGTTIGDYVMAYKLAK

SEQ ID NO: 49791 - DNA, 1782 bp, Dechloromonas aromatica RCB
  CDS (1)..(1782)
atgcacagtcatacccccaagcggagtgccctcacacttgcgctgatcgccgccgccgttctggccggcgggcaggctctggccggcgtcaccgatgccgacatcctgaacgatgccaagaccaccggcgacgtcgtcagctttggcctcggcacgcagggccaacgcttcagcccgtctacgcagatcaacaccaaatccgtgaagaacctggtcccggcctggtcgatgtccttcggcggcgagaagcagcgcggccaggaatcgcagccggtcatccacgacggcaagatgttcgtcaccgcctcctacagccgcctgttcgccatcgatgcgaagaccggcaagaagctgtggaagtacgagcaccgtctgccggacggcatcatgccctgctgtgacgtgatcaatcgcggcgccgcgctgtacggcgacctggtcatcttcgccacgctggatgcccaactcgtggccatgaaccagaataccggcaaggtcgtctggaaggaaaagctcggcgattacgcggccggctattccgcctccgccgccccgatcattgccaagggcaagctgatcacgggcatctccggtggcgaattcggcgctgtcggccgcattgacgcccgcgacccgctgaccggcaagctgctgtggacccgtccgaccgtcgaaggccacatgggctatcgctacgacgccgacggcaaggctatcgaaaacggcatctccggcaccctcaacgccacctggagcggcgacctctggcaaactggcggcgcagcaacctggaacggcgccacctacgatccggaaaccaacctgatcttcgccggcaccggcaatccggccccgtggaacagccacctgcgcccgggcgacaacctgttctcgtcgtccaccgttgccatcgatgccgacaccggcaagatcgcctggcacttccagggcaccccgcacgacggctgggactttgacggcgttaacgagttcgtctcctttgacctcaaggacccgaagaccggcaagatcgtcaaggcaggtgcaaaggctgaccgcaacggcttcttcttcgtgaacgaccgcaccaacggcaagctgctcggcgcctacccgttcgtcaagaagatcacctgggctaccggcttcaacctcgaaaccggccgtccgaactacatcgaagaaggccgtccgggcgacccgaacgccagtgccgatggcaagaagggcaaggtcgtcttctcggctccgtccttcctcggcggcaagaaccagcaacaaatggcctacagcccgcaaaccggcctcttctacgtgccggccaacgagtggtcgatggatatctggaacgaacccgtttcctacaagaaaggtgcggcttacctcggcgccggcttcaccatcaaggctctgaacgacgactacatcggcgccctgcgcgcggtcgacccggctaccggcaagatcgtctgggaaaacaagaactacgctccgctgtggggcggcgtcctgaccaccgccggcggcctcgtcttctacggcacccccgaaggcttcctgaagggtgtcgatgccaagaccggcaaggaactgtggtccttcaacgtcggcaccggcatcgttgcaccaccggtcagttgggagcaggatggcgagcagatgatcgccgtcacgaccggctggggcggcgccgtgccgctgtggggcggcgacgtcgccaagcgcgtgaacttcctcgaacagggcggttccgtctgggtcttcaagctgcacaagggctaa

SEQ ID NO: 49792 - protein, 593 aa, Dechloromonas aromatica RCB
MHSHTPKRSALTLALIAAAVLAGGQALAGVTDADILNDAKTTGDVVSFGLGTQGQRFSPSTQINTKSVKNLVPAWSMSFGGEKQRGQESQPVIHDGKMFVTASYSRLFAIDAKTGKKLWKYEHRLPDGIMPCCDVINRGAALYGDLVIFATLDAQLVAMNQNTGKVVWKEKLGDYAAGYSASAAPIIAKGKLITGISGGEFGAVGRIDARDPLTGKLLWTRPTVEGHMGYRYDADGKAIENGISGTLNATWSGDLWQTGGAATWNGATYDPETNLIFAGTGNPAPWNSHLRPGDNLFSSSTVAIDADTGKIAWHFQGTPHDGWDFDGVNEFVSFDLKDPKTGKIVKAGAKADRNGFFFVNDRTNGKLLGAYPFVKKITWATGFNLETGRPNYIEEGRPGDPNASADGKKGKVVFSAPSFLGGKNQQQMAYSPQTGLFYVPANEWSMDIWNEPVSYKKGAAYLGAGFTIKALNDDYIGALRAVDPATGKIVWENKNYAPLWGGVLTTAGGLVFYGTPEGFLKGVDAKTGKELWSFNVGTGIVAPPVSWEQDGEQMIAVTTGWGGAVPLWGGDVAKRVNFLEQGGSVWVFKLHKG

SEQ ID NO: 49793 - DNA, 1725 bp, Ralstonia eutropha JMP134
  CDS (1)..(1725)
atgatggccgtcgcgaccgccgtggccagtctggccactcaggcggcagtgaccgatgccatgatcgagaacgatgcgaagagccccggcgacgtgttgtcatggggcatgggaccgcaagggcagcgctattccggcctcacgcgcatcaataccaaaaacgtcggcaacctggtgccggcgtggtcgttctcgttcggcggcgagaagcagcgcgggcaggaagcgcagccgctgatccacgacggcaagatgttcgtcacggcgtcgtattcgcgcatctacgcgctcgacctgaagaccggcagcaaattgtggaagtacgaacaccgcctgccggaaggcatcatgccgtgctgcgacgtggtcaaccgcggcgcggcgctctacgacaacctggtgatcttcggcacgctcgatgcgcaactggtggcactggaccagaagaccggcaaggtcgtgtggaaggagaagctggaggactatgcagcaggctattcctatacggcggcgccgctgatcgtcaagggcatggtgctcaccggcatctcgggcggcgaattcggtgtggtcggccgcgtcgaggcccgcgacgccaagaccgggcaactggtgtggtcgcgccccgtggtggaaggccatatgggctacaagtacgacaaggacggcaacaagaccgagaacggcgtgaccggcacggagaacgcaagttggcccggcgaaacgtggaagaccggcggtgccgccacgtggctcggcggcacctatgatccggccaccggtctcgcttacttcgggaccggcaaccccggcccgtggaatagccatatccgcaagggggacaacctctattcggcgtcgacggtggccatcgatccggccaccggcaagatcgtctggcactaccagaacaccccgaacgacggctgggattttgacggcgtcaatgagttcgtgaccttcgacctggacggcaagcgcatgggcggcaaggccgaccgcaacggcttcttctatgtcaacgatgcgaccaacggcaaactggtcaatgccttcccgttcgtgaagaagatcacgtgggccactggcatcgacctgaagaccggtcggcccaccttcaacgacgagggtcgcccgggcgatccggccagcggcgccgacccgaagaagggcaagtccgtgttcgccgcgcccggcttcctgggtggcaagaaccagcagccaatggcctacagcccgcagacgggcttgttctacgtgccggccaacgaatggggcatggatatctggaatgagcccgtcagctacaagaagggcgccgccttcctgggtgccggattcaccatccatccactgaacgaggactacatcggttcgctgcgcgccatcaaccccaagaccggcaagatcgtctgggaggtcaagaacaacgcgccgctgtggggcggtgtgatgaccaccgccggcgggctggtgttctggggcacgccggaaggctacctcaaggccgccgacgcccggaccggcaaggagctgtggaagttccagaccggcagtggcgtggtcgcgccgccggtcacctgggaagagaacggcgagcagtatgtcgccgtggtgtcgggctggggcggtgcggtgccgctgtggggcggggaagtcgccaagcgcgtgaatttcctggagcagggcggttcggtgtgggtgttcaagctgcacaagggctga

SEQ ID NO: 49794 - protein, 574 aa, Ralstonia eutropha JMP134
MMAVATAVASLATQAAVTDAMIENDAKSPGDVLSWGMGPQGQRYSGLTRINTKNVGNLVPAWSFSFGGEKQRGQEAQPLIHDGKMFVTASYSRIYALDLKTGSKLWKYEHRLPEGIMPCCDVVNRGAALYDNLVIFGTLDAQLVALDQKTGKVVWKEKLEDYAAGYSYTAAPLIVKGMVLTGISGGEFGVVGRVEARDAKTGQLVWSRPVVEGHMGYKYDKDGNKTENGVTGTENASWPGETWKTGGAATWLGGTYDPATGLAYFGTGNPGPWNSHIRKGDNLYSASTVAIDPATGKIVWHYQNTPNDGWDFDGVNEFVTFDLDGKRMGGKADRNGFFYVNDATNGKLVNAFPFVKKITWATGIDLKTGRPTFNDEGRPGDPASGADPKKGKSVFAAPGFLGGKNQQPMAYSPQTGLFYVPANEWGMDIWNEPVSYKKGAAFLGAGFTIHPLNEDYIGSLRAINPKTGKIVWEVKNNAPLWGGVMTTAGGLVFWGTPEGYLKAADARTGKELWKFQTGSGVVAPPVTWEENGEQYVAVVSGWGGAVPLWGGEVAKRVNFLEQGGSVWVFKLHKG

SEQ ID NO: 49795 - DNA, 1857 bp, Methylobacillus flagellatus KT
  CDS (1)..(1857)
atgtctccttttcttatcgtcgtttccttgaatcttgtttccgccgtttcgtcagcagcagatcctctgctgccattgcttcaggatgacaagcagtgggtcagcccacgcaaggattattacaatcaaggctatagtcgcctgagccagatcaatcaccgcaatgttgcgaacctcaagcttgcttggagcttttcgactggtgtccagcgtgggcatgaaggggcgcctctggtggtggggaatgtgatgtatgtgcatacagcgtttcctaataatgtctatgcactggacctggatcatgaccagaaaatactctgggcttacttccccaagcaaaccagcgatattgaagccattctgtgctgtgacagcgtgagccgcggcctggcatatggcgatggcaagatactgctgcagcagaacaacggcatattgctggcactggacgcccgcgatggacgcaaggtgtgggaggttcaggtgaacgaccccagaatgggggctaccaataccaatgcgccttatgtgttcagggataaagtactgacggggtgcagcggtggcgaatttggtgtgcggtgctttcttgccgcctatgcactgcaggatgggcggttgcaatggaaggcctatagcactgggccggatagtgaagtgttgataggtccgggatttaatgcagagaacccgcattacagtgcactctccacttatgaggatgtgaacggtggcaatagggaaggggggtctttccgtgccctgcccaaggaaaggctgaagtttccagagaccgagctgggggtgaaaacctggctcaagccgcaggcggctgccaacggctggcaacatggtggaggcccggtctggggatggttttcttatgatcccaagctcaacctggtttactatggaacgggcaatccctcggtctggaatccagatatccggcctggggacaacaaatgggccatgacattgttcgcacgcgacctcgataccggcatggcgcgttggggctaccagctgacgcctcatgacgagtgggattacgacagcgtcaatgaattgatactatgggatcagggtagccggaagctggccacgcatttcgatcgcaatggctttgcctatactctggatcgccagaatggcaagttactggcggcggagaaaatgcaccctttcgtcaactgggcgaccggtattgacctgcagaccgggattccgctcaaggatggccgctatgctacgcatgaggaccaggaaacgtcggcgatctgcccctctgccataggcgtcaagaatatacagcctgcggcgtattccccgcaaaacggctggttttatgtgccgatgaaccacttgtgcatgacgtatgaagcggtggaggccaagtatgtggctggacagccatgggccggcgccagcctgtccatgtacccggggcctgatggcgacatgggggctttcatggcctgggatgcccttaagcacaagcctgtctggtatacgcgtgagaagtaccctgtctggagcggggcattggcgacggctgggcaactggcattctacggcacactggaccgatggttcaaggcgctggatgctcggaatggcaaggagttatggcgcttccaagtgggttcgggcattgtgggcaaccccatgacttatcagcacgcaggcaagcagtatgtggcggttttctcaggcatcggaggatgggcaggtgttgcgctcaaccagggactgacaggggacagcgacggggctggcacggctggcgcttttcgcgggttgagccaggagaatgcggctccagggagtggtgcgctcaacgtattcgcgttgtaa

SEQ ID NO: 49796 - protein, 618 aa, Methylobacillus flagellatus KT
MSPFLIVVSLNLVSAVSSAADPLLPLLQDDKQWVSPRKDYYNQGYSRLSQINHRNVANLKLAWSFSTGVQRGHEGAPLVVGNVMYVHTAFPNNVYALDLDHDQKILWAYFPKQTSDIEAILCCDSVSRGLAYGDGKILLQQNNGILLALDARDGRKVWEVQVNDPRMGATNTNAPYVFRDKVLTGCSGGEFGVRCFLAAYALQDGRLQWKAYSTGPDSEVLIGPGFNAENPHYSALSTYEDVNGGNREGGSFRALPKERLKFPETELGVKTWLKPQAAANGWQHGGGPVWGWFSYDPKLNLVYYGTGNPSVWNPDIRPGDNKWAMTLFARDLDTGMARWGYQLTPHDEWDYDSVNELILWDQGSRKLATHFDRNGFAYTLDRQNGKLLAAEKMHPFVNWATGIDLQTGIPLKDGRYATHEDQETSAICPSAIGVKNIQPAAYSPQNGWFYVPMNHLCMTYEAVEAKYVAGQPWAGASLSMYPGPDGDMGAFMAWDALKHKPVWYTREKYPVWSGALATAGQLAFYGTLDRWFKALDARNGKELWRFQVGSGIVGNPMTYQHAGKQYVAVFSGIGGWAGVALNQGLTGDSDGAGTAGAFRGLSQENAAPGSGALNVFAL

SEQ ID NO: 49797 - DNA, 1800 bp, Methylobacillus flagellatus KT
  CDS (1)..(1800)
atgaaaggcagagtaagccatgtcggtatcagcgctgctgtcagcagcctgctggtgcttgcgacggtgcagggtgctcaggcaaaccaggaggtgctgaatttacagaaaaatgcagataactgggctttgcaaaccggtaattacactggtcagcacaatagcacattgagccaaatcaacaaaagcaacgtcaagaacctgaaggcagcttggtctttctctaccggcgttttgcatggtcatgaaggcgcgccactggtcattggcgacatgatgtatgtgcacagtgcgtttccgaacaatacgtttgccatcaacctgaatgaccccggcgtgattgcatggcagcacaagcccaagcaaattgcctcggtcaaggccgtggcatgttgcgacatcgtgaaccgcggcttggcctatggcgacggcaagatcgtgaagacccagctggacggtaggctggtggcccttgatgccaaatccggcaagatcgtgtgggaaatcgaggtgtgtgatccgaaggtgggcgccacactgacccaggcgccatttgtcgccaagaattctgtcctggttggctgctcgggtgctgagctgggcgttcgcggcgcggttaactccttcaacctgaaaactggcgaattgcagtggcgtgcttttgccaccgggcccgatgaagaggtccgcctagccaagaacttcaacagcgataacccgcattacggtcaattcggcctcggtctcaagacctgggaaggcgatgcatggaagatcggtggcggcaccaactggggttggtatgcctatgatcccaagctgaacctcttctactatggttcaggcaacccggcgccatggaacgaaaccatgcgtcccggcgacaacaagtggaccatgaccatctgggctcgtgacctcgacacaggtgaagccaagtggggctaccaaaagacgcctcacgacgaatgggacttcgcaggcgtgaatcaaatgattctttccgatcacaaggttgacggcaaggtgacacctctgctcacccatatcgaccgtaacggcatcatgtacacgctgaaccgcgacaacggcaacctgatccaggctgccaaggttgatccggcggtcaacgtgttcaagaaggttgacctcaagactggtacgccagtgcgcgatcctgagttcagcacacgcatggatcataagagcaccaacgtatgtccttccgccatgggcttccacaaccagggcctggatgcgctggatcttgacgagcccatcgtctacgcaggcctgaaccatatttgtatggattgggagccattcatgctgccataccgtgcaggccagttcttcgtgggcgcaaccctggcgatgtacccaggacctagtggcccgaccaagaaggaaatggggcaagtgcgtgccatggacatcgtgacaggtaagtacaagtggaccaagtgggagaagttcgctgtttggggcggcacgctcgctaccaagggtggcctggtggtctacaacacactggatggctatatcaaggccctggacaaggacaacggcaaagacttgtggaagttcaagatgccatccggcggcatcggggcgcccatgacctatcaattcaagggtaagcagtacatcggctccatgtacggtgtgggtggatggcctggcgttggcctggtattcgacctgaccgatcctagcgctggtctgggtgctgtaggtgccttcaaggagctacagaatcacactcaaatgggtggtggcctgatggtgttcagcctctaa

SEQ ID NO: 49798 - protein, 599 aa, Methylobacillus flagellatus KT
MKGRVSHVGISAAVSSLLVLATVQGAQANQEVLNLQKNADNWALQTGNYTGQHNSTLSQINKSNVKNLKAAWSFSTGVLHGHEGAPLVIGDMMYVHSAFPNNTFAINLNDPGVIAWQHKPKQIASVKAVACCDIVNRGLAYGDGKIVKTQLDGRLVALDAKSGKIVWEIEVCDPKVGATLTQAPFVAKNSVLVGCSGAELGVRGAVNSFNLKTGELQWRAFATGPDEEVRLAKNFNSDNPHYGQFGLGLKTWEGDAWKIGGGTNWGWYAYDPKLNLFYYGSGNPAPWNETMRPGDNKWTMTIWARDLDTGEAKWGYQKTPHDEWDFAGVNQMILSDHKVDGKVTPLLTHIDRNGIMYTLNRDNGNLIQAAKVDPAVNVFKKVDLKTGTPVRDPEFSTRMDHKSTNVCPSAMGFHNQGLDALDLDEPIVYAGLNHICMDWEPFMLPYRAGQFFVGATLAMYPGPSGPTKKEMGQVRAMDIVTGKYKWTKWEKFAVWGGTLATKGGLVVYNTLDGYIKALDKDNGKDLWKFKMPSGGIGAPMTYQFKGKQYIGSMYGVGGWPGVGLVFDLTDPSAGLGAVGAFKELQNHTQMGGGLMVFSL

SEQ ID NO: 49799 - DNA, 1725 bp, Mesorhizobium sp. BNC1
  CDS (1)..(1725)
atggcgacagccgcgttcgcggtgatctcagcgcccgcccttgcccagaacacgcgtgaatattcgcccgtcacggacgagatgctcgccaatccgccggcagaagactggctttccttccgtggcgcctacaacaaccagggttacagcaagctcgacctcatcaacaaggatacggttgacgatctggagctggcatgggcttggcccatggccgaggcgggcattcaggaaacggctcccctcatccatgacggcatccttttcctgcagaccaacaacaatatcgtcgaggcgctcgacgccaagaccggcgaccgcatctggacctatatccatgagttgcctgaactgccggcaagctggagttaccagctcaaccaggcacgccgtcagaaggcgtccatcgcgctctatcaggacaaggtggtcctgaccaccgtcgatgccaagatcgtcgtgctcaacgcactcgacggcaaggtcgtctgggaaaagcaggttctcgactacaacaagggctacagctacacggtcggcccgatcgtcgttgacaataaaatcatcagcgccatttcgggctgctccatcgccggcaccgcgggcggctgctatatcctggcccatgatttcgagacgggcgaggagctctggcgcttcaacacgatcaatgaccccgacaatcctgaacagcaggcgagctggggtgaggttccgccggaaaaccgctggggcggcacgccctggaccatcggctcctatgatcccgagacccgcactaccttctggggcatcggaatgcccggtccctattccgagctgattcgcggctcgggcgacgggtcggtgctctacaccaactcaacgatcgcgctcgacatcgataccggtaagctcaagtggtactaccagcacctgccgcgcgacaactgggatctcgacagcccgttcgaacgcatcctcgtcgaccaggaagtcgatggcgaagtcaagaagatgctcgtgaccgtcgcaggcaagaacggcatcgccttcgggcttgaccgggagaccggcaagtatctctggcacaaggagacggtccatcagaacgtggtcaccgggatcgatccggatggcaccgtgcatatcaatgaggacctggttgcgaaggcagtcggcgaggagcatcttgtctgcgcctcggtatcgggtggtaagctgtggcaggcaggttcctatagtccgctgacccaagcttattatgtgcccttgacggaagcctgcaataccgtggctccgacccagaccgagttcactgccggcaacgcggtgggcgcgatgaagtttggtccgcgtgtcctgcccgaaggcgtcaccgaggccggccttgttcaggcaatcgcggtcactccgacgtccggcaagaccaagtgggactaccgttcgcgcccgaccccgaccagctccgtgctggcgacggccggtggtcttgtcttcggtggtgacgcagcgcgcgatgtgaaggcctgggaccaggaaacgggcgaggtggtctggtcgcagcgcctcaatgctccgatcggcggctatcctgccacctatgcagtcgatggcgagcagtacctggtggtgcccaccggctactcgaactccgccagctcgatttcttcggcattcccggagattccgctgccgacaggctcgggcaactccatcttcgtgttcaagctgcccagcaagtaa

SEQ ID NO: 49800 - protein, 574 aa, Mesorhizobium sp. BNC1
MATAAFAVISAPALAQNTREYSPVTDEMLANPPAEDWLSFRGAYNNQGYSKLDLINKDTVDDLELAWAWPMAEAGIQETAPLIHDGILFLQTNNNIVEALDAKTGDRIWTYIHELPELPASWSYQLNQARRQKASIALYQDKVVLTTVDAKIVVLNALDGKVVWEKQVLDYNKGYSYTVGPIVVDNKIISAISGCSIAGTAGGCYILAHDFETGEELWRFNTINDPDNPEQQASWGEVPPENRWGGTPWTIGSYDPETRTTFWGIGMPGPYSELIRGSGDGSVLYTNSTIALDIDTGKLKWYYQHLPRDNWDLDSPFERILVDQEVDGEVKKMLVTVAGKNGIAFGLDRETGKYLWHKETVHQNVVTGIDPDGTVHINEDLVAKAVGEEHLVCASVSGGKLWQAGSYSPLTQAYYVPLTEACNTVAPTQTEFTAGNAVGAMKFGPRVLPEGVTEAGLVQAIAVTPTSGKTKWDYRSRPTPTSSVLATAGGLVFGGDAARDVKAWDQETGEVVWSQRLNAPIGGYPATYAVDGEQYLVVPTGYSNSASSISSAFPEIPLPTGSGNSIFVFKLPSK

SEQ ID NO: 49801 - DNA, 1827 bp, Mesorhizobium sp. BNC1
  CDS (1)..(1827)
atggtgtccacgtcgcttgcccagcaggcgcctgctggaccgactacgccccccgctggaccgacggctccgccggccgggccgggcgcgccccctgctgccgcaggagctccgacaacccccgccgcacccgtcgtgattccggattacaagtccgtgacccaggaaatgctgacaacacccgctgatggtgactggccgaactatcggcgcacctatgacggctggggctacagtccgctgaaccagattaccacggacaacgtggctgacatggagccggtctggatgatctccaccggagcagccgaaggacatgaatcgccgccgatggtgatcaacggcatcatgttcgtcacccaggccacgacgacgagcaaccaggtaatggccatcaaggctgacaccggtgaaatcctctggcgctatcagcgtgcgcttccggaagacatgcacagctcgcatccgacaaatcgcggtgtgggtttctggggcgacaagatcttcttcacctcacgcgatgcggttttggtggcactcgacgccaagagcggcgccgaagtgtggaccgccccgatcgacgactataagaatggctattacgcgaacctcgctccgcttgtgatcgacggtaaggtcatcgttggcacttcgggcggcgagcgtggtatccgtggcttcgtcgccgccttcaacgccgacgatggtaaggaagtatggcgcacctataccatccccgctccgggcgagcccggttcggagacgtggccggacaacgaggcgtggaagacgggtgccggctcaacctggatcaccggtcactacgatcctgagaacaagctgatctattggggcgtcggtaatggtggcccctggatgggcgatcaacgtccaggcgacaatctgtatgtcacatcggtgattgccctcgatccggaaagcggtgagatcaaggggcacttccaataccatccgaacgactcgttcgattgggacgaagtggcggcaccgattctcgtcgatctgccgaacaaggatggcgagaccgtgccgggcctggtgcatgccgcccgtaacggcgtgctttgggagctggagcggaagccggatggcgagatcggcttcatcaagggcactccctacgtgaaggaaaactggatcaagagcatggatccggagaccgggcgcgtagagtatgccgagggaaccaagccgggtacgggcatccttggcgatttctgcccctcgttctggggcggtaaggattggcctcccatcgcctatgacccggagacaaactatgtcttcattccggcgaacgagaatctctgcaccaagatgcagggtggcacggtggtcgagtaccgtccgggcgccagcttcacacgtggcacgcagggtgatcgctccgatctctatcttgccgaaggcgctgatcacatcggcgaggttcaggcttgggatctgtcgacgggcgagaaggtgtggacgcatgagttccccaattcggcgaactggggcccgcttatgacgacggctggcggtctcgtgttcggcggcggaacgaatgacaacatgttccgtgcattcgatgccaagtcgggcgacatcgtctgggagatgaagctcaactcgagcgtcatcggcgtgccttcttccttcgaggtagatggcaagcagtatgtctccgtccaggctggttggggtatcgatgcggcctccatgcagagccgccttgcgacttcctatccggataagttcaagcccggcccgaccgttccgacgggcggcgtgatctgggtcttcgcgcttccggaagagaactga

SEQ ID NO: 49802 - protein, 608 aa, Mesorhizobium sp. BNC1
MVSTSLAQQAPAGPTTPPAGPTAPPAGPGAPPAAAGAPTTPAAPVVIPDYKSVTQEMLTTPADGDWPNYRRTYDGWGYSPLNQITTDNVADMEPVWMISTGAAEGHESPPMVINGIMFVTQATTTSNQVMAIKADTGEILWRYQRALPEDMHSSHPTNRGVGFWGDKIFFTSRDAVLVALDAKSGAEVWTAPIDDYKNGYYANLAPLVIDGKVIVGTSGGERGIRGFVAAFNADDGKEVWRTYTIPAPGEPGSETWPDNEAWKTGAGSTWITGHYDPENKLIYWGVGNGGPWMGDQRPGDNLYVTSVIALDPESGEIKGHFQYHPNDSFDWDEVAAPILVDLPNKDGETVPGLVHAARNGVLWELERKPDGEIGFIKGTPYVKENWIKSMDPETGRVEYAEGTKPGTGILGDFCPSFWGGKDWPPIAYDPETNYVFIPANENLCTKMQGGTVVEYRPGASFTRGTQGDRSDLYLAEGADHIGEVQAWDLSTGEKVWTHEFPNSANWGPLMTTAGGLVFGGGTNDNMFRAFDAKSGDIVWEMKLNSSVIGVPSSFEVDGKQYVSVQAGWGIDAASMQSRLATSYPDKFKPGPTVPTGGVIWVFALPEEN

SEQ ID NO: 49803 - DNA, 2559 bp, Mesorhizobium sp. BNC1
  CDS (1)..(2559)
atgtttcgtatcatactatcagtaatcattgctgttcttggccttgtcattgccgccggcggcgtttggctcgctgttcttggcggctcctggttctacatcctgcttgggcttcttctcgttctttccggcgctttgcttttgaggcgcagcgcaagcgggcttcttctgtacggcctgaccattcttctcactcttgcctggagtgtttgggaagtgggcttcgactggtgggctttggttccccgcggtgctctcatcctagtcctgggcgttcttttgctactgccgcccatattgcgggccatgcgcgttccagaaggccgacgggcgagctacgggatgaacagcggcgtgcttgcggcctcgatcttcatcgcagccatcgttggcatctattcgatgtttcaacagccgcacgatatcgatggcgcattccccgagcagcggattgccgtgtccccggcgccgcagcaaggcgatgtgccgcctggcgaatgggcagcctatggccgcacctcctttggccagcgctattcaccactggaccagatcacgcctgaaaacgtgtcgcagttggaagtggcatggagctatcagacgggagagatgcgcgatgaaaacgatcccggcgagacgacatatgaggtgacgccgctgatggtgaacaacaccctctatatctgtacgcccttcagcacggtgatcgcgcttgatcctgttactggccaggaaaagtggcgcttcgacccgcaactgagacagccgccgaccgagacaacgcagcatatgacctgccgcggcgtttcgtatcacgaggcagcgccgggggatcttcctgcgaccagccccacggctcaggctgcaccggaaaccgcgccgacgggccaagccggagcaccggatgaaacggcggagatcgcgacgagcgtggatgagataacgacgcaggcagcacctgtgccgcagaacatcgttaccggacaggcagaacccggcgcacttagctttgttgttacgcgcgaagagccgcctgcgcgcgtgacgctcagccagcagtgcatgaagcggctgttcgtgcccacgtcggatgggcggctgatcacgataagtgccgatacgggggagatctgccccggcttcggcggcgacggcacgatcaatctctgggcgaatatgccgaacgttacgcccggctcctactattccacctcgcctcccctgattgccggccggcttgtcatcatcggcggggccgtaaacgataacgaagcgatcacctcgccctccggcgtaatccgggccttcgatctctacaccggcgcacttgtctggaatttcgacagcaagaatcccgaagcgacgcagccgatcgcgccagacggcgtatattcccagaacgcaccaaattcctggagcgtggcgagctacgaccctaatctcggcctcgcctattttccgatgggcaacgaatcgccggaccagttcggcggaaatcggggtgaaaataccgaacgctactcctcctcggttctggcgctgcgggctgacaccggcgaggtggcatgggtgttccagacagtgcatcacgacatctgggactatgacgtgcccgctcagcctgtcctgatcgacctcacggtcgatggacaggcagtgccagcgctggtgcaggccacaaaacaaggcgacatcttcgtgctcaaccgggcaaccggcgagcccattttccctatcgaggagcggccaacgccgcagggcgcggtggagggcgaccggacagcgcccacccagccgcattcagccatttcgttcggcccggcccccctcagagaagccgatatgtggggcgcgacgccgatcgatcagctctattgccgggttcgtttccaccagcttcgctacgaaggccgatacacgccgccttcactccaaggcacaattgtgtatccgggcaatttcggcacgttcaactggggttctgtggctgtggaccccaaccgcgacatcatgtttgcgatgcccgtctatcttgccttcgaggtgaaacaggttcctcggcagaacgagctttcccgggttgtgacacaggagggcgaggcgatcttcaacgagaatttcggtgcaccttacgcggcgcagatggggccgttttattcgccccttcagcttccctgccaaaggccgccttggggctatatcgcagcggtggacctgaccacgggcgaaaccgtttacaagcaagtaaacggcacagtgcgggatctttcgcccattcccctgccgtttgaaatgggcgtgccgggaattggcgggccgatcgttaccgctggcggtgtagcctttctctcgggcacgctcgactattatgtgcgcggctatgacctgcgtaccggcgaggagctgtggcgtgagcggctgcccgccggcggccaagccacgccttccacctatgtgggcgaggatggccggcaatatctggtcgtggtcgccggcggccacggttccaccggcacaaaggcgggcgattcgattatcgcttatgcactgccgcaatag

SEQ ID NO: 49804 - protein, 852 aa, Mesorhizobium sp. BNC1
MFRIILSVIIAVLGLVIAAGGVWLAVLGGSWFYILLGLLLVLSGALLLRRSASGLLLYGLTILLTLAWSVWEVGFDWWALVPRGALILVLGVLLLLPPILRAMRVPEGRRASYGMNSGVLAASIFIAAIVGIYSMFQQPHDIDGAFPEQRIAVSPAPQQGDVPPGEWAAYGRTSFGQRYSPLDQITPENVSQLEVAWSYQTGEMRDENDPGETTYEVTPLMVNNTLYICTPFSTVIALDPVTGQEKWRFDPQLRQPPTETTQHMTCRGVSYHEAAPGDLPATSPTAQAAPETAPTGQAGAPDETAEIATSVDEITTQAAPVPQNIVTGQAEPGALSFVVTREEPPARVTLSQQCMKRLFVPTSDGRLITISADTGEICPGFGGDGTINLWANMPNVTPGSYYSTSPPLIAGRLVIIGGAVNDNEAITSPSGVIRAFDLYTGALVWNFDSKNPEATQPIAPDGVYSQNAPNSWSVASYDPNLGLAYFPMGNESPDQFGGNRGENTERYSSSVLALRADTGEVAWVFQTVHHDIWDYDVPAQPVLIDLTVDGQAVPALVQATKQGDIFVLNRATGEPIFPIEERPTPQGAVEGDRTAPTQPHSAISFGPAPLREADMWGATPIDQLYCRVRFHQLRYEGRYTPPSLQGTIVYPGNFGTFNWGSVAVDPNRDIMFAMPVYLAFEVKQVPRQNELSRVVTQEGEAIFNENFGAPYAAQMGPFYSPLQLPCQRPPWGYIAAVDLTTGETVYKQVNGTVRDLSPIPLPFEMGVPGIGGPIVTAGGVAFLSGTLDYYVRGYDLRTGEELWRERLPAGGQATPSTYVGEDGRQYLVVVAGGHGSTGTKAGDSIIAYALPQ

SEQ ID NO: 49805 - DNA, 2157 bp, Ralstonia eutropha JMP134
  CDS (1)..(2157)
atgagccgatccttccggcgcggccgaccggcgcagaccggtgccgccgccctgcttgtccttgccaccgcttccgccgccgtcgaggccggtgatctgcctgccaggacatccaacgcccgcatcggcgccgcgacgcgccaggtcgacggcgacttcatccgtaacaatgcggcagccacgcgcgactggcccagctatggccttgactatgccgagacgcgcttcagccggctcgggcaggtgaacgccggcaacgtcaaggaactcgggctggtctggtcctacaacctcgaatcgacgcgcggcgtcgaagcgaccccgctggtggtcgatggcgtgatgtacgtcagcgcgtcctggagcgtggtccacgcaatcgatacgcgcaccggcaagcgcctgtggacgttcgacccgaaggtcgacaagtccatcggctacaagggctgctgcgacgtggtcaaccgcggcgtggcgctgtaccagggcaaggtgttcgtggcgtcctacgacggccgcctgattgccgtcgatgccgtcaccgggcgcaagctgtgggaaaaggacaccatcatcgaccatagccgcgcgtacaccatcaccggcgcgccgcgcgtggtcaagggcaaggtcatcatcggcaacagcggcgcggagtacggcgtgcgcggctacatcacggcctacgatgcgagttccggcgaacagaaatggcgctggttcacggtgcccggcgatcctgcgaagccgttcgaggatgcatcgatggcgcgcgccgcgcagacctgggacccagccggtaaatggtgggaggcgggtgggggcggcacggcgtgggacaccctcaccttcgatcccgaactcaacctgatgtacgtggggaccggcaacggctcgccgtgggcgcaccgcacgcgcagcccggccggcggcgataacctgtaccttgcatcgatcgtcgcgctcgatccggacacgggcaagtacgtgtggcactaccaggaaacgcccggcgacaactgggactacacgtccacgtcgccgatgatcctggccgacctgaagatcgatggccagccgcgcaaggtgatcctgcacgcgccgaagaatggcttcttcttcgtgatcgaccggaccgatgggcggttcatctccgcgaagaactatgtcgacgtaaactggaccaccggctacgacgccaacggccgccccgccgaagttcccgaagcacgcgcgaccgacaagccctatgaagcgatcccgggcccctacggcggccacaactggcaatcgatgtcgttcaatccgcagaccgggctggtctacgtgccagcacagaacgtgccggcgaacctcatggacgacaagcgctggcgcttcaatgccgctgcgcccggtgcgctgcagagcaacaccggctggaacaccggcaagatcctcggctccgcgagcccggccaacaagccgttcgggcgcctgattgcgtgggacccggtgcagcagaaagcggcatggacgcaggaatacgtcgcgccctggaatggcggcacgctgaccacagccggcaacctggtgttccagggcacgtcggacggccggttgattgcctatgacgcgcgcaacggcgacaagctgtgggaaacgccgacgggcaccggcgtcatcgctgccccgacgacctacatggtcgatggcaagcagtatgtgtcgatcgccgtgggctggggcggtgcgtacggcgcgtaccggcgcgtcgcggatcgcgaaggtcccggcacggtctacacgttcgcgctcgggggcaaggcggccatgccggaattcgtcaaggctcgcgtgggggaactgctgtccggggtcagttacgatccggccaacgtgaaggacggtgccggcctctacgtcagcaactgcgtggcctgccatggcgtgccgggcgtggatcgcggcggcaatattcccaacctgggctatatgcacccgacctacatccagaacctggacaagttcatcttcaaggggcccgcgatggtgcgcggcatgccggacttcagcggcaagctgagcgccgaggatgtcgagaagctcaaggcctttatccagggcacggccgacgcgatccggcccaagtcggtcgccggtaccggccagtag

SEQ ID NO: 49806 - protein, 718 aa, Ralstonia eutropha JMP134
MSRSFRRGRPAQTGAAALLVLATASAAVEAGDLPARTSNARIGAATRQVDGDFIRNNAAATRDWPSYGLDYAETRFSRLGQVNAGNVKELGLVWSYNLESTRGVEATPLVVDGVMYVSASWSVVHAIDTRTGKRLWTFDPKVDKSIGYKGCCDVVNRGVALYQGKVFVASYDGRLIAVDAVTGRKLWEKDTIIDHSRAYTITGAPRVVKGKVIIGNSGAEYGVRGYITAYDASSGEQKWRWFTVPGDPAKPFEDASMARAAQTWDPAGKWWEAGGGGTAWDTLTFDPELNLMYVGTGNGSPWAHRTRSPAGGDNLYLASIVALDPDTGKYVWHYQETPGDNWDYTSTSPMILADLKIDGQPRKVILHAPKNGFFFVIDRTDGRFISAKNYVDVNWTTGYDANGRPAEVPEARATDKPYEAIPGPYGGHNWQSMSFNPQTGLVYVPAQNVPANLMDDKRWRFNAAAPGALQSNTGWNTGKILGSASPANKPFGRLIAWDPVQQKAAWTQEYVAPWNGGTLTTAGNLVFQGTSDGRLIAYDARNGDKLWETPTGTGVIAAPTTYMVDGKQYVSIAVGWGGAYGAYRRVADREGPGTVYTFALGGKAAMPEFVKARVGELLSGVSYDPANVKDGAGLYVSNCVACHGVPGVDRGGNIPNLGYMHPTYIQNLDKFIFKGPAMVRGMPDFSGKLSAEDVEKLKAFIQGTADAIRPKSVAGTGQ

SEQ ID NO: 49807 - DNA, 1728 bp, Burkholderia cepacia R1808
  CDS (1)..(1728)
atgaagaaactctcggcttcgaagagccgactggcatcgatcggcatcgcggcggctgccgcgatcgtcttgaatcccggcctggtggctgccgccgcggattatccggccgtcacgtatcagcggctgaccgatgcgcaacgcgacccgggctggctcacctactaccgcacctacaacggccaggcgcattcgccgctcaagcagatcgacgcgtcgaacgtgaagcagctcacgcaggcatggagctacaagtttccggccgagctgaagcagggcttcgaggccacgccgatcgtcaacggccgctacctgttcgtcaccacgccgaaggacaacgtctacgcgttcgacgcgaccaccggcgcgcaactgtggaagtacgagccgaagctcggcgccgagtcgttcaagaccgcatgctgcgacgtcgtgaaccgcggcgtcgcgctgtacggcaagaacgtctacgtcgcgatgctgagcggcgaggttgccgcactcgacgcccagaccggcgcgctcgtgtggaagaagcagatgttcgaaccgggcctcggctacgcgttctcgctcgcgccgctcgcgatcgacggcgcgatcgtggtcggcagctcgggcggcgaatacggcgcgcgcggcttcatcgcggcgctgagcccgaacgacggctcggtgctgtggaagcgctacacgatccccggccagggcgagaagcacgccgacacgtggcccgacgggatgcaggcgcacggcggcgcgccggcgtggctgaccggcacctacgatgcggcgacgcgcacgctgtactggggcgtcggcaacccggggccgtggctcgcggacctgcgccccggcgacaatctgtactccgattcgctgctcgcgctggacccgaagaacggcgacctcaagtggcactaccagtacacgaagcacgacacgtgggactacgacggcgtgaacacgccggtgctcgcgacgatcaagtacaagggcaaagagcatgacgcgatcatccatgcggaccgcaacggctacttccacgcgatcgaccgcgacagcggcaagctgatctacgccgagccgttcgtgaaggcgacctcggtcaccggctacacggaagacggcgcaccgatccaggacccggcgaagtatccgaaggtcggcacgacgatcgagacgtgcccgagcttcctcggcggcaagaactggtggtcggtgtcgtacgaccccgagcgtcatctcgcgatcgtgccgacgctgcatgcgtgcatgagcctgtccggcaagtcggtcaactacatggaagggctgccgtatctcggcgaaggcttcgagatcaagccggaaccgggcagcgaaggctacggcgaactgcaggccatcgacgtcaacaccggcaagaaggtgtggagccactggagcaagctgccgtggaacggcggcgtcgcgacgaccgccagcggcctcgcgttcagcggctcgctcgacggccacctgtatgcgttcgacgtgtcgaccggcaaggtgctgtgggaaagcccgcagctcgcgagcgggatcatcgcgcagccgtcggtgttcgaagtcgacggcaaggaatacgtcgcggtgctcgccggctacggcggcgcgaacccgatctggggcggcccgatggccaaggccgcggatgacgtaccgcgcggcggcacgctgtacgtgttcgcgctgaaccgcggctga

SEQ ID NO: 49808 - protein, 575 aa, Burkholderia cepacia R1808
MKKLSASKSRLASIGIAAAAAIVLNPGLVAAAADYPAVTYQRLTDAQRDPGWLTYYRTYNGQAHSPLKQIDASNVKQLTQAWSYKFPAELKQGFEATPIVNGRYLFVTTPKDNVYAFDATTGAQLWKYEPKLGAESFKTACCDVVNRGVALYGKNVYVAMLSGEVAALDAQTGALVWKKQMFEPGLGYAFSLAPLAIDGAIVVGSSGGEYGARGFIAALSPNDGSVLWKRYTIPGQGEKHADTWPDGMQAHGGAPAWLTGTYDAATRTLYWGVGNPGPWLADLRPGDNLYSDSLLALDPKNGDLKWHYQYTKHDTWDYDGVNTPVLATIKYKGKEHDAIIHADRNGYFHAIDRDSGKLIYAEPFVKATSVTGYTEDGAPIQDPAKYPKVGTTIETCPSFLGGKNWWSVSYDPERHLAIVPTLHACMSLSGKSVNYMEGLPYLGEGFEIKPEPGSEGYGELQAIDVNTGKKVWSHWSKLPWNGGVATTASGLAFSGSLDGHLYAFDVSTGKVLWESPQLASGIIAQPSVFEVDGKEYVAVLAGYGGANPIWGGPMAKAADDVPRGGTLYVFALNRG

SEQ ID NO: 49809 - DNA, 2136 bp, Rubrivivax gelatinosus PM1
  CDS (1)..(2136)
atgcaccgacgccccgccccctcacccgcagcgctggttgcccggctggtcgtgaccctgagcctggcctgcgggctgtccgccccgtcggcagccgccggcaccgaggtgaacgacgcggccctgagcgacccgaagcagggtgcgaactggctggcctacggccgcaactacagcgagcagcgctacagcccgctggcgcaggtccatgccggcaacgtggggcggctcgggctcgcgtggtcgatggcgctgcccgaagaccgctctctgctgtcgacgccgctgatcgtcgacggcgtcatgtacttcaccggcagctggagcaagacccgcgcggtggacgccgcgaccggcaagctgctgtgggagtacgacccggagtcgatcaagcacgctggcggcgaacgcctgcgtgccatgtgggactccagccgcgggctggcctactggaagggcaagctggtcatcgcgaccatcgacgggcggctgatcggcctggacgcgaagaccggccagaagctgtggagcacccagaccttcgacccgaagcgaccgctctacatctccggtcacccgaaggccttccgcgacctggtgatcgtcggcaacggaggctccgagttcggcgcgggccgcggcttcgtcagtgcgtaccacgtggacagcggcaagctggcgtggaagttctacgtggtgccgggcaatcccgccgacggcttcgaggacgaggcccaggcgatggcggccaagacctggaccggcgagtggtggaagcacggcggcggcggccaggtgtggaacggcctcacctacgaccccgagtacgaccagatcctgatcggcaccggcaacggcggtccgtggaaccggaaggtgcgcagcccggacggcggcgacaacctgttcctctgctcgatcgtggcgctggacgcacggaccggcaagtacaagtggcactaccagaccgtgcccggcgagacctgggactacaactccagcatggacatggtgctggccgacctgaagctgcggccgggcggcggaccgcgcaaggtgctgctgcatgcgccgaagaacggcttcttctatgtcatcgaccgcaagaacggcaagctgctgtcggccgagaagatcgccaaggtgacctgggcgaccggcatcgacatgaagaccgggcggccgatcgaggccgagggcgcgcgctacgaggacggctcggagctggtatggcccagcgtctacggggcccacaactggcatgccatgtccttcaatccgaagaccgggctggtctacatccccaaggtcgaactgcccgcgctgttcaccgacacgggcgtgcggatcgtcgactggcgcaagcccgagaacttcggccagctcgatgtcgcggtcgacatcggcctgggcagcgacatccccaaggacgccggggtgagctcgctgctggcctgggacccggtgaagcagaagaaggcgtgggaggtggcccagccgaactactggaaccccggcaccatgaccaccgcgggcaacctggtgttccagggccgcatcgacggcacgttcatcgcctacgacgcgcgcgacggcaggcagctgtggtcggtgcacgtcgggtccggcatcagcgcgccgccggtcacctactcggtgggcggccggcagtacgtgtcgctgctcgtcggctggggcggtgccggcatgtcgctcggtggcggcagctcgatggcgcagtacggctggggctttggcggccagacgcggcagttgctgactttcgcgctcgacggcaagctgccgatgcccgacgtgggcaagcccgtgttcgtccggcccatcgtgccggcggatttcaagcccgacgagaagctggtcgatcgtggccgtgcgctctacgccagcacctgcgtctggtgccacagcgccggcgcggtgtcgggaggctatgcgccggacctgcgtgcctcgccgatgctgctggacctgaaggcgttgcggaccgtactcgaaggcgccctggtgcagcgcggcatgccgaaataccccgacctcacggacgacgatctcgtggcactccagcactacgtgcgcagtcaggctatcgtgacttcacagccgaccccgccctag

SEQ ID NO: 49810 - protein, 711 aa, Rubrivivax gelatinosus PM1
MHRRPAPSPAALVARLVVTLSLACGLSAPSAAAGTEVNDAALSDPKQGANWLAYGRNYSEQRYSPLAQVHAGNVGRLGLAWSMALPEDRSLLSTPLIVDGVMYFTGSWSKTRAVDAATGKLLWEYDPESIKHAGGERLRAMWDSSRGLAYWKGKLVIATIDGRLIGLDAKTGQKLWSTQTFDPKRPLYISGHPKAFRDLVIVGNGGSEFGAGRGFVSAYHVDSGKLAWKFYVVPGNPADGFEDEAQAMAAKTWTGEWWKHGGGGQVWNGLTYDPEYDQILIGTGNGGPWNRKVRSPDGGDNLFLCSIVALDARTGKYKWHYQTVPGETWDYNSSMDMVLADLKLRPGGGPRKVLLHAPKNGFFYVIDRKNGKLLSAEKIAKVTWATGIDMKTGRPIEAEGARYEDGSELVWPSVYGAHNWHAMSFNPKTGLVYIPKVELPALFTDTGVRIVDWRKPENFGQLDVAVDIGLGSDIPKDAGVSSLLAWDPVKQKKAWEVAQPNYWNPGTMTTAGNLVFQGRIDGTFIAYDARDGRQLWSVHVGSGISAPPVTYSVGGRQYVSLLVGWGGAGMSLGGGSSMAQYGWGFGGQTRQLLTFALDGKLPMPDVGKPVFVRPIVPADFKPDEKLVDRGRALYASTCVWCHSAGAVSGGYAPDLRASPMLLDLKALRTVLEGALVQRGMPKYPDLTDDDLVALQHYVRSQAIVTSQPTPP

SEQ ID NO: 49811 - DNA, 1668 bp, Rubrivivax gelatinosus PM1
  CDS (1)..(1668)
atgatcccgaagctcgacgttctgcgaaaacgatcgctcgccggcctggccgctgcagctgccctgctgctctgcaccggcacgggcagcgccgaggagaccggcaagaactggcccgactaccacggcgactggcgcggctggcgctacagcccgctcgaccagatcaacaagaagaacgtcaagaagctgaaggtggcgtggatccaccagcccggcgagatcgcgcagggcctgcaggccacgccgatcgcgctcgacggcgtgctgtactacagcgcgtcgaacaaccgcagcttcgcgctcgacgccgccaccggccggcagctctgggagtacatccccgagctcgacgcggtgcaggagaagtcggtgttcggtttctacaaccgcggcgtgacggtcggccgcggcaaggtcttcatcggcgcctcggacggccacctgatcgcgctcgaccagaagaccggcaaggaactctggaaggtgaagctcaccgaccccaagacctgccacggctgcaacttcacctcgccgcccatcctggccggcgacgtgctgatcgccggcccgaccggcggcgacctggcgcagcgctccaggctctatgcgctgaaggccgacaccggcgagaaggcctggaccatggagctgctgaaggacgacccgaagagctggcccggcgacaccatcaaggtcggcggcggcggtgcctggctgcccggccagtacgacgcgaagaacgacaccttcttcatcggcacctcgaacccggcgccggacttcaatgccgagctgcgctcgggcgacaacctctacaccgcgacggtgctcgcgctcgaaccgtccaccggccgcatcaagtggcaccaccaggaggtgccgaacgacgcctgggatttcgactcggcctacgagttcgtgatgttcgagaagaacggccaggaactgatgatgcacctcaacaaggggggcttcgtctcggtctacgaccgcaagaccggcgcggtgcaggacgtctggcggatcgccgaggagatgaactggatcaagggcgtggacccgaagaccggcgcgctgatcggacgcaatccgccgaagtccggccagagcgaggtgttctgccccagcgcgctgggcgtgcgcagctggaacgcgggcgcctacagcccgaagacaaagctctggtacacgaacgcctacgagatctgcaaccgcgtcgtgatgaagcagcagccgatcgaccagctggcgttctcgcagggctactacgacgtggccgagctggagatcatcccgccgccgggcaagaaggcgtccgcacggctggtggcccatgacccggtgaccggcaagcaggcctggcggctggacttcgaggccccggggctggcgcatgtgctggccaccggcggcggcctgatcttcaacggcgatccgcgcggtctgctgtcggcctacgacgaccggaccggcaagacgctgtggtccttcaacgtcggctcgggcatgcgcggcggcatcgtcagctactcggccggcggcaagcagtacatcgtcgcggcgaccggcttcggctcgctgttcccgggtttcgcgtccatcccgtggccggagttcaagaacgtgcgcggcggcgcggcgctgatcgccttcacgctggaatag

SEQ ID NO: 49812 - protein, 555 aa, Rubrivivax gelatinosus PM1
MIPKLDVLRKRSLAGLAAAAALLLCTGTGSAEETGKNWPDYHGDWRGWRYSPLDQINKKNVKKLKVAWIHQPGEIAQGLQATPIALDGVLYYSASNNRSFALDAATGRQLWEYIPELDAVQEKSVFGFYNRGVTVGRGKVFIGASDGHLIALDQKTGKELWKVKLTDPKTCHGCNFTSPPILAGDVLIAGPTGGDLAQRSRLYALKADTGEKAWTMELLKDDPKSWPGDTIKVGGGGAWLPGQYDAKNDTFFIGTSNPAPDFNAELRSGDNLYTATVLALEPSTGRIKWHHQEVPNDAWDFDSAYEFVMFEKNGQELMMHLNKGGFVSVYDRKTGAVQDVWRIAEEMNWIKGVDPKTGALIGRNPPKSGQSEVFCPSALGVRSWNAGAYSPKTKLWYTNAYEICNRVVMKQQPIDQLAFSQGYYDVAELEIIPPPGKKASARLVAHDPVTGKQAWRLDFEAPGLAHVLATGGGLIFNGDPRGLLSAYDDRTGKTLWSFNVGSGMRGGIVSYSAGGKQYIVAATGFGSLFPGFASIPWPEFKNVRGGAALIAFTLE

SEQ ID NO: 49813 - DNA, 1689 bp, Rubrivivax gelatinosus PM1
  CDS (1)..(1689)
atgaagcgggatttcgcgagggccgtgctcggcgtggccctggcatgtctggcgcccctggcgctggcgcagacgatcgacgacctcaagcgcgacgcgacgacgcccggcgacgtgacgacctacggcatgggctgggggcagcagcgctactcggcgctggccaagatcaacaagaccaccgtcaagcgcctggtgccggcctggaaccttagcctcgacaactccgcgaacgcctcgacgcagccgctgctgatcggcggcgtgatgtacgtgtcgacgcacaacgccacggtggcgatcgacgccgagagcggtcgccagaagtggaaggtcgccatcgacctgccggccgacgtgaacggctacctctgctgcggcatccagagccgcggcatggccgcgctcgatggcgtgctctaccgcaccaccatcgatgcccacgtgctggccatcgacatggccagcgggaagacgctgtggaagcagaaggcggccgactacaagcagggctacagcatgacccacgcgccgctggtcgccggcggcgtgctgatcaccggcatctccggcggcgagtacggcacgcgtggcttcctcgatggctgggacctgaagaccggcgagaagaagtggcgcacctggaccgtgcccgctcccggcgagcccggctcggagacctggaacgccgaccgccacgacaagggcggtgcgcccacctggctgaccggcacctacgacccggagctcaacctcgtctactggggcaccggcaacggcgggccgtggaacccggcgtggcgcggcaaggattcgctctacatctgctccatcctcgcgctcgacccggccaccggcaagatcgtctggcactatcagacctcgcccggcgacccctacgactacgacgccaccaacgagctggtgctgggcgaactgccggtgaacggcgccgcccgcaaggtgctgatgcaggccaaccgcaacggctacttctacgtgctcgaccgcagcaacggcaagctgctatcggccacgcagttcgcgcagaaggtcaactgggcgagcggcatcgacatgaagaccggccgccccatcgacaccgagatgacgaaggcagtgcggtccaatgtcgagagcaaggacttcatcgaggcctggcccagtgccttcggtgcgaagaactggatgccgatgagcttcgacccgctgaagaagcgcgtctacctgaacacgctcaacttcggcatgaaggtcaagtacggcaccccggcctaccgccagggggcctggtacctggggctcgaactcggggggtgggtcgatccggacggaggcatgcgtggcgcgctggtcgcctgggatcccaccaccggcaggaagctgtgggagagcccgaccgccgcgccgtactggagcggcgtgctctccaccgctggcgggctggtgttcaccggcgcgcagaccggcgagttcatggccttcgacgccgacaccggcacgaagctgtggcagttccagaccggctcgggcatctccggcctgccgatcacctgggaactcaagggccagcagtacgtcaccgtgaccagcggcgccgccaccgtgtacggcttcctcggcggtgatgccaagctggcgcaggtgccggcgggctcgtcggtgtggaccttcaggctgatcgactga

SEQ ID NO: 49814 - protein, 562 aa, Rubrivivax gelatinosus PM1
MKRDFARAVLGVALACLAPLALAQTIDDLKRDATTPGDVTTYGMGWGQQRYSALAKINKTTVKRLVPAWNLSLDNSANASTQPLLIGGVMYVSTHNATVAIDAESGRQKWKVAIDLPADVNGYLCCGIQSRGMAALDGVLYRTTIDAHVLAIDMASGKTLWKQKAADYKQGYSMTHAPLVAGGVLITGISGGEYGTRGFLDGWDLKTGEKKWRTWTVPAPGEPGSETWNADRHDKGGAPTWLTGTYDPELNLVYWGTGNGGPWNPAWRGKDSLYICSILALDPATGKIVWHYQTSPGDPYDYDATNELVLGELPVNGAARKVLMQANRNGYFYVLDRSNGKLLSATQFAQKVNWASGIDMKTGRPIDTEMTKAVRSNVESKDFIEAWPSAFGAKNWMPMSFDPLKKRVYLNTLNFGMKVKYGTPAYRQGAWYLGLELGGWVDPDGGMRGALVAWDPTTGRKLWESPTAAPYWSGVLSTAGGLVFTGAQTGEFMAFDADTGTKLWQFQTGSGISGLPITWELKGQQYVTVTSGAATVYGFLGGDAKLAQVPAGSSVWTFRLID

SEQ ID NO: 49815 - DNA, 1956 bp, Rubrivivax gelatinosus PM1
  CDS (1)..(1956)
atgtcgatcagaaccacggcgctgctgacggcgacggccgctgcgtgcatcgctgcaagtgccgccgagaccggcaactggcgcgagtacaacggcgacaaggcgggatcccgcttcgagccgggcgtgaacgtcacgctgcagagcgtgaagtcgatgaaggtggcctggcgcgtgccactgcccggcaaccagttgccgatcgacaacccggagttgcgcacctgggtcaaccagtccacgccgctggcggtcaacggcgtgctgtactccagttcgccgctgggcatcgtgaccgcgctcgacggcgccaccggcaagacgctgtggacctgggacggcggcggttgggccgacggcacaccgccgaacctgggcttcatcagccgcggcgtgacctactgggaaaagggcgaggaccggcggctcttcgtcggcacgcccgacgcctacctcgtcgcactgaacgcgaagaccggcaagccgatcgagagctggggtgacaagggtcgcatcgatctgaccaagggcctgcgccgcccggtcgaccgctcgctggtgagcccgaccacgccgccgatcatctgcggcggacaggtgatccccagcctcgccgtcctcgactccttcgcgatcggccgcgacccgctgaagaaccacccgcccggcgacgtgcgcggcttcgacctgatgaccggcaagcagagctgggtgttccatgcgccgccgcagaagggcgagcccggcaacgagacgtgggaaggcgactcggcgcagtcgaccggcggcatgaacatgtggacgcgcgcgagctgcgacgacgagcaggggctggtctacctgccgctgtcgacgccggcgaacgacttctacggcggccagcgcaagggcgacggcctgttcggcgagtcgctggtggcgctgaacgccaagaccggcaagatcgcgtggtactaccagatcgtgcaccacggcatctgggactacgacctgccggccgcgccgaacctgatggacctcaccgtcgacggccgcaagatcaaggccgcggtgcaggtgaccaagcagggcttcgtgttcgcgttcgaccgagtcaacggcaagccgatctggccgatcgaggagaaggcggtgccgcagtccaccgtgcccggcgagaagtcgtcgccgacgcagcccttccccagcaagccggcgcccttcgtgcagcagggcgtaaccgaggacgacctgatcgacctgacgcccaagctgaaggaggaggcgaagaagatcctggcgcgctacaactacggcccgctctacttcccgccgacgctcgacaaggccggcacgctggaagtgccgggcgtgctcggcggtgccagctgggtgggcgccgcgcacaacccgaagtccaacgtgctctacgtgccctcgttcacgatcccgttcggcatcaagctgaagaaggggacgaccggcctgtacgactacaccggcacctgggccggtgtcggtggtccggacgggctgccgctgttcaagccgccgttcagcaccgtcaccgcgatcgacatgaacaccggcaagcacctgtggcgcatcccggccggccgcggcccggtcgatcacccggccctgaaggacctgaagctcgaccgcgtgggtgtgccgcgccagagccacatcgctctgaccgagaacgtgctgttcctcgcaccggagggcaccaacagcgtcatcggcctgtcggcacgcggcaacgcgctgatcacgcaggccacgaaggaggagcccgagcccttcctctacgcgcatgacgcgaagaccggcgcgctggttggcgaggtccgtctgcccggcggcgtgttcggcaacctgatgacctactccgccggcggcaagcagttcgtcgtcgcgccgatcgggggagccggcctcccggccgaactggtggccgtgcaggtgaactga

SEQ ID NO: 49816 - protein, 651 aa, Rubrivivax gelatinosus PM1
MSIRTTALLTATAAACIAASAAETGNWREYNGDKAGSRFEPGVNVTLQSVKSMKVAWRVPLPGNQLPIDNPELRTWVNQSTPLAVNGVLYSSSPLGIVTALDGATGKTLWTWDGGGWADGTPPNLGFISRGVTYWEKGEDRRLFVGTPDAYLVALNAKTGKPIESWGDKGRIDLTKGLRRPVDRSLVSPTTPPIICGGQVIPSLAVLDSFAIGRDPLKNHPPGDVRGFDLMTGKQSWVFHAPPQKGEPGNETWEGDSAQSTGGMNMWTRASCDDEQGLVYLPLSTPANDFYGGQRKGDGLFGESLVALNAKTGKIAWYYQIVHHGIWDYDLPAAPNLMDLTVDGRKIKAAVQVTKQGFVFAFDRVNGKPIWPIEEKAVPQSTVPGEKSSPTQPFPSKPAPFVQQGVTEDDLIDLTPKLKEEAKKILARYNYGPLYFPPTLDKAGTLEVPGVLGGASWVGAAHNPKSNVLYVPSFTIPFGIKLKKGTTGLYDYTGTWAGVGGPDGLPLFKPPFSTVTAIDMNTGKHLWRIPAGRGPVDHPALKDLKLDRVGVPRQSHIALTENVLFLAPEGTNSVIGLSARGNALITQATKEEPEPFLYAHDAKTGALVGEVRLPGGVFGNLMTYSAGGKQFVVAPIGGAGLPAELVAVQVN

SEQ ID NO: 49817 - DNA, 1686 bp, Rubrivivax gelatinosus PM1
  CDS (1)..(1686)
atgaatcactttcccagcggcaacaagaaacagctggcggcactcgccgcggccctgaccgtcggcctgttcgccgcggcacccgcgggcgctgcgggcagtggccccggcttcgacgaccccaacaactggccccagtaccaccgcagcttcaacgcgtggcgcttcagcccgctggaccagatcaacaagtccaacgtcagcaagctcaaggtggcctggatccaccaacccggcaccatcacccacggcctgcaggccacgccgatcgtgatcgacggtgtcatgtacaccatcgcgccggacaacaacgtgttcgcgctcgacgcggccaccggcaagatcatctggcgctacaccgccaagctcgacccgatcgtcaaggaagtgttctatggctcggccagccgcggcgtcaccgtgggccgcggcaaggtgttcatcggcacgctggacggccgcttcgtcgcgctcgaccagaagaccggcaaggagctgtggtcgacccagctcagcgacatgaagaaggactacggcgcgctgttctcctcgccgccgcaactggccggcgacacgctgttcggtggaaccaccggcggcgaccagccgatcatcggcaagatcttcgccgtcaacgccgacaccggcgcgcgcacctggaccttcgaggtgccgaaggacgacccgaagagctggcccggcgacagccgcaaggtcggcggcggctcggcctggctgccgggcacctacgacccgacgaccgacaccatctacatcggcactagcaacgctgcgccggacttcaaccacgacgaccgcaagggcgacaacctctacaccgccacgctgctggcgctcgaccccaagaccggcaaggtcaagtggcaccgccaggaggtcccgatggacacctgggacttcgacgcggcctacgaggcgctgctggtgccggacggcaagggcaagaacgtgctcgttcacctgaacaagaacggcttcgtctacgtcatggacaaggacaccggcgccatgcgcaatgcgtggcagtacaccgagaacatgaactgggccaagggcgtggatcccaagactggcctgccgatcgacccggtgtatccggagaccgacaagcagaagctgcactgtcccaacctgctgggtgcgcgcagctggaaccacggcgcctacaacccgaacaccaagctctggtactcgcacggcatggaggtctgcaacttcgtgaccagcgcgaagcagggcccggtgcccggcatcggcggtctgtcgctcggcctgtcggacatcaagctgaccgatcccccgggcaagaaggccgacggctggctcgccgccttcgatccgctgaccggcaagcaggcctggaaggtgcgcttcgacatgccgccgctcagctcggcactggccaccggcggcggcctggtgttcaccggcgacatgtacggcaacctgttcgccttcgacgccgacaatggcaaggagctgtggaagttcgcggccggctcgggcgctcgcggcggcccgatcagctactcggtcaagggcaagcagtacattgcgatcccgaccggcctgggctcgcacgcgccgggcttcctgaccggagccttcccgcagatccgcaacctgccgggtggcgctgcgctgctggtgttcgccgtcgactga

SEQ ID NO: 49818 - protein, 561 aa, Rubrivivax gelatinosus PM1
MNHFPSGNKKQLAALAAALTVGLFAAAPAGAAGSGPGFDDPNNWPQYHRSFNAWRFSPLDQINKSNVSKLKVAWIHQPGTITHGLQATPIVIDGVMYTIAPDNNVFALDAATGKIIWRYTAKLDPIVKEVFYGSASRGVTVGRGKVFIGTLDGRFVALDQKTGKELWSTQLSDMKKDYGALFSSPPQLAGDTLFGGTTGGDQPIIGKIFAVNADTGARTWTFEVPKDDPKSWPGDSRKVGGGSAWLPGTYDPTTDTIYIGTSNAAPDFNHDDRKGDNLYTATLLALDPKTGKVKWHRQEVPMDTWDFDAAYEALLVPDGKGKNVLVHLNKNGFVYVMDKDTGAMRNAWQYTENMNWAKGVDPKTGLPIDPVYPETDKQKLHCPNLLGARSWNHGAYNPNTKLWYSHGMEVCNFVTSAKQGPVPGIGGLSLGLSDIKLTDPPGKKADGWLAAFDPLTGKQAWKVRFDMPPLSSALATGGGLVFTGDMYGNLFAFDADNGKELWKFAAGSGARGGPISYSVKGKQYIAIPTGLGSHAPGFLTGAFPQIRNLPGGAALLVFAVD

SEQ ID NO: 49819 - DNA, 1857 bp, Rubrivivax gelatinosus PM1
  CDS (1)..(1857)
atgagcaagcatcccgtccgtcacgccctgtccgtcgcagcggcgctggccgtcctgggactgtcccagggtgcgcacgccgtcaagaacgtcacctgggaagacatctcgaacgacgaccgcacgagcaccgacgtcctgagctacggtctgggcctgaaggcccagcgctacagcccgctgaagcagatatcgaccgccaacgtgcagaagctcgtcccggcatggagccactccttcggcggcgagaagcagcgcggccaggaaggccaggtgctggtgcatgacggcgtgatctacgcgaccagttcctactctcgcttcacggcgctcgacgcgaagaccggccggcagctgtggacctacgaacaccgcctgcccgacgatatccgtccgtgctgcgacgtcgtcaaccgcggccccgccatctacggcgacaaggtctacttcggtacgctcgacgcacgcgtcgtggcgctggaccgcgccaccggcaaggtggtgtggaacgagaagttcggtgaccacaaggtgggctacacgatgaccggcgcgcccttcatcgtgaaggacaagaagtccggtcgcgtgctgctgatccacggctcgtcgggcgacgagttcggcgtcgtcggatggctgttcgcacgcgatcccgacaccggcgccgaggtctgggctcgcccgatggtcgagggccacatgggccgcctgaacggcaaggacagcacggtgaccggcgatgcgaaggccccctcgtggccgcgtgacaaagacggcaagctggtcgaggcgtggcaccagggcggcggcgcgccgtggcagaccgcgtcgttcgatgccgagaacaacaccatcgtgatcggcaccggcaacccggcgccgtggaacacctggaagcgcacgaaggaaggcgacgacccgcgcaactgggacagcctgttcacctcgggtcaggcctacgtcgatgcgtcgaccggcgaactcaagggcttcttccagcacacgccgaacgatgcctgggacttctcgggcaacaactcgatcgtgctgttcgagtacaaggacccgaagtccggcaagctggtgaaggccggcgcgcatgccgaccgcaacggctttttcttcgtgaccgaccgcgagaagctcgcgaccggcgccggctatccgaacaagccgaccgcgctgctcggtgcgtggccgttcgtcgacggcatcacctgggccaagggtttcgacctgaagaccggcaagccgatcgagaacaacaaccgtccgccggcccccaagcccggcgccgacaagggcgagtcgatcttcgtgtcgccgccgttcctgggcggcaccaactggatgccgatgagctacagcccggacaccggcctgttctacatcccggcgaaccactgggcgatggactactggaccgagcacctgacctacaaggccggctcggcctacctcggccagggcttccgcatcaagcggctgtacgaggaccacgtcggcacgctgcgggcaatcgacccggtgaccggcaagatcgcgtgggaacacaaggagaagctgccgctgtgggccggcacgatgacgacggccggcggcctgctgttcaccggcacctccgacggctacgtgaaggccttcgacagcaagaccggcaaggaactgtggaagttccagaccggctcgggcgtggtctcggtcccggtgacctgggagcaggacggcgagcagtacgtcggcatccagtcgggctacggcggcgccgtgcccctgtggggcggtgacatggccgagatgaccaagaaggtcacgcagggcggctcgatgtgggtcttcaagctgcccaagtag

SEQ ID NO: 49820 - protein, 618 aa, Rubrivivax gelatinosus PM1
MSKHPVRHALSVAAALAVLGLSQGAHAVKNVTWEDISNDDRTSTDVLSYGLGLKAQRYSPLKQISTANVQKLVPAWSHSFGGEKQRGQEGQVLVHDGVIYATSSYSRFTALDAKTGRQLWTYEHRLPDDIRPCCDVVNRGPAIYGDKVYFGTLDARVVALDRATGKVVWNEKFGDHKVGYTMTGAPFIVKDKKSGRVLLIHGSSGDEFGVVGWLFARDPDTGAEVWARPMVEGHMGRLNGKDSTVTGDAKAPSWPRDKDGKLVEAWHQGGGAPWQTASFDAENNTIVIGTGNPAPWNTWKRTKEGDDPRNWDSLFTSGQAYVDASTGELKGFFQHTPNDAWDFSGNNSIVLFEYKDPKSGKLVKAGAHADRNGFFFVTDREKLATGAGYPNKPTALLGAWPFVDGITWAKGFDLKTGKPIENNNRPPAPKPGADKGESIFVSPPFLGGTNWMPMSYSPDTGLFYIPANHWAMDYWTEHLTYKAGSAYLGQGFRIKRLYEDHVGTLRAIDPVTGKIAWEHKEKLPLWAGTMTTAGGLLFTGTSDGYVKAFDSKTGKELWKFQTGSGVVSVPVTWEQDGEQYVGIQSGYGGAVPLWGGDMAEMTKKVTQGGSMWVFKLPK

SEQ ID NO: 49821 - DNA, 2412 bp, Pseudomonas fluorescens PfO-1
  CDS (1)..(2412)
atgagcactgaaggtgcttcgagtcgaagccgtcttctgccgaacctgctcggcattctgcttctgctgatgggcctggccatgctggccgggggaatcaagctgagtacgctcggcggctcgctgtattacctgctggccggtatcggcatcacgctgaccggcattctgatgctgatgcgccgtcgcgcagcattgggcctgtacgccatcgtgctgttcgccagcactgtctgggcgctgtgggaagttggtctggactggtggcaactggtgccgcgtctggcgctgtggtttgtcctcggtttcgtgatgctgctgccgtggttccgtcgtccgctgctgctcgcaggccctgcgccgatgggcaccggcggtttgaccgtggctgtgattctggccggcgtcactgccctggccagcctgttcacccacccgggcgaaaccttcggcgaactgggtcgcgacaccgccgacaccaccagcaccgccccgcaaatgccggacggcgactggcaggcctacggccgcaccgaattcggtgaccgctactcgccactgaaacagatcaccccggccaacgtcggcaagctgcaagaagcctggcgcatccagaccggcgacctgccgactgccgacgacccggtcgagctgaccaacgaaaacaccccgctgaaagccaacggcatgctttacgcctgcactgcgcacagcaaagtgctggcactggacccggacaccggcaaggaactatggcgcttcgatccgcagatcaaaagcccggaaggcttcaagggcttcgcccacatgacctgccgtggcgtgtcgtactacgacgaagccgcgtacgccaagtctgaaaacgcggcgtccaccgtgatctccgaggccggcaaagccgtcgcccaggcctgcccgcgtcgcctgtacctgcctaccgccgatgcccgcctgatcgcactgaacgccgacaccggcaagatctgcgaaggcttcggcaccaacggtgtggttgacctgacccagggcatcggcccgttcaccgctggcggttactactccacctctcctgccgcgatcacccgtgatctggtgatcatgggcggtcacgtcaccgacaacgaatcgaccaacgagccgtccggcgtgatccgcgcctacgacgtgcgcgacggccatctggtctggaactgggacagcaacaacccggacgccaccgaacccttggccccgggccagacctacagccgcaactcggccaacatgtggtcgctggccagcgtcgatgaaaaactcggcatggtctatctgccattgggcaaccagacgcctgaccagtggggcggcgatcgcacccccggtgccgagaaattcagcgccggcctggtcgcgctggacctggcgaccggcaaggtgcgctggaactaccagttcacccaccacgacctgtgggacatggacgtcggcagccagccaaccctgctggacatgaaaaccgccgacggcatcaagcctgcgctgatcgccccgaccaagcagggcagcctgtacgtcctcgaccgtcgtgacggcacgccgatcatcccgatccgcgagatcccggtgccgcaaggcgccgtgaaaggcgaccacaccgccccgacccaggcccgttcggacctgaacctgctggccccggaactgaccgaaaaagccatgtggggcgccagcccgttcgaccagatgttgtgccgcatccagttcaaggaactgcgctacgaaggccaatacacgcctccgtcggaacagggcagcctgatctacccgggtaacgtcggcgtgttcaactggggcggtgtttctgtcgacccggttcgccagatgctgttcaccagcccgaactacatggctttcgtctccaagatgatcccacgtgccgacgtacccgccgacagcaagcgcgaaagcgaaacttccggcatccagaaaaacaccggtgcgccgtatgccgtgaccatgcacccgttcatgtcgccactgggcgtaccttgccaggccccggcctggggctacgtcgccggtatcgacctgaccaccggcaaagtcgtctggaaacgcaaaaacggtaccagccgcgacagctcgccaatcccgatcggcttcaccctgggcgtgccaagcatgggcggctcgatcgtcactgccggcggcgtcggcttcctcagcggcacgctggaccagtacctgcgcgcctacgacgtgaacaccggtaaagaactgtggaaatcgcgtctgccggccggcggccaggcgaccccaatgacctacaccggcaaggacggcaagcaatacgtcctgctcgtggtgggtggtcacggctcgctgggcaccaagatgggtgactatgtgattgcctacaaactgccggaataa

SEQ ID NO: 49822 - protein, 803 aa, Pseudomonas fluorescens PfO-1
MSTEGASSRSRLLPNLLGILLLLMGLAMLAGGIKLSTLGGSLYYLLAGIGITLTGILMLMRRRAALGLYAIVLFASTVWALWEVGLDWWQLVPRLALWFVLGFVMLLPWFRRPLLLAGPAPMGTGGLTVAVILAGVTALASLFTHPGETFGELGRDTADTTSTAPQMPDGDWQAYGRTEFGDRYSPLKQITPANVGKLQEAWRIQTGDLPTADDPVELTNENTPLKANGMLYACTAHSKVLALDPDTGKELWRFDPQIKSPEGFKGFAHMTCRGVSYYDEAAYAKSENAASTVISEAGKAVAQACPRRLYLPTADARLIALNADTGKICEGFGTNGVVDLTQGIGPFTAGGYYSTSPAAITRDLVIMGGHVTDNESTNEPSGVIRAYDVRDGHLVWNWDSNNPDATEPLAPGQTYSRNSANMWSLASVDEKLGMVYLPLGNQTPDQWGGDRTPGAEKFSAGLVALDLATGKVRWNYQFTHHDLWDMDVGSQPTLLDMKTADGIKPALIAPTKQGSLYVLDRRDGTPIIPIREIPVPQGAVKGDHTAPTQARSDLNLLAPELTEKAMWGASPFDQMLCRIQFKELRYEGQYTPPSEQGSLIYPGNVGVFNWGGVSVDPVRQMLFTSPNYMAFVSKMIPRADVPADSKRESETSGIQKNTGAPYAVTMHPFMSPLGVPCQAPAWGYVAGIDLTTGKVVWKRKNGTSRDSSPIPIGFTLGVPSMGGSIVTAGGVGFLSGTLDQYLRAYDVNTGKELWKSRLPAGGQATPMTYTGKDGKQYVLLVVGGHGSLGTKMGDYVIAYKLPE

SEQ ID NO: 49823 - DNA, 1674 bp, Burkholderia fungorum LB400
  CDS (1)..(1674)
ttgcccgccgcgtatgccgcggacgaagttcagaacagttcgaccaccacgagctcgccggtgccgtcgacgctgcaacccgtgagccaggaacagctcgaccgggcagccaccacgtcgaacgactggctgctttcgaacggttcgtacgcgcagacgcgctactaccgcggtgcacaaatcaacaaaacgaacgtgtcgaaactcaggccggctttcatcttccagacagccgtcaacgagtcgatggaaacggcgccgatcgtatcgaacggcgtgatgttcattaccacctcgtttaatcacgtgtatgcggtcgatgcggtgacgggcaaggaattctggcactacaagcacaagatgggcgcggtcactacgttttgttgcgggcccaacaatcgcggcgtggccatagccggcgaccgtctctacatgggcaccctcgacgcgaagctcgtcgcgctcgacgcaaaaaccggcagcgtgttgtggcaaacgcagatcgccgatcccgatgaaggctattcggaaacgatggcgccgaccgtggtcgacggcaaggtgttgatcggcacgaacggcggcgaatatggcattcgcggtttcctcaaggcgttcgacgcaaactccggtcaattgctgtggaccttctatacgattccggaaaccggccaggaaggtgtgtgggccacgaaggacgctaccggccgcgacgggaagcgcgacatcgacgccgagaaaaagcagcttgccgagaaaggcggcgacttctacaagacgctcggcggcggcgtgtggatggcgcccgcaatcgatcggcagacgcatacggtgttcttcgtcgtcggcaatccctcgcctgacctgtatggcgcaatccggccgggagacaacctctatacggattcgctcgtcgcgatcgatctggacaccggcaaatacaaatggcactaccagtatgtgccgcacgacgtgtgggacctggacgccgtgagcccgccgatgctgatcgacgtacgcgacaacaacggcaggatgattccgggcgtggtgcacggcggcaagaccggtcacgtgtacgttcacgatcgcgcgactggacggctgatccgctattcgcaggcgatgattccgcaggagaacatgtggacgttgccgaccgccgccggcgcgcggatgctgcctggcgcgaacggcggagtcgagtggtcgcctatggcattcgatccgcacacgcgtctcgtgtatgcggccaatctgcatcagccgatgacgtatcaggtcgaggacgccgcctatccgggcggcagcaagctgtggctgggcggcgcgttcaagacgatcgcgtccgaacagcaatggggcaagctgtccgccgtgaacgtcgatacgggtaaggtcgcgtgggactacaaaaccgagcagccgctcatcggcggcgtgctgacgacggcgggcggcctcgtattcaacggcgaaggcaacggcctgttccgcgcattcgattccgccacgggcaagaaactctgggagttccagtgcggcgccggcgtcaatgcgcccgcggtgtcatacatggtgcacggcaagcagtacatcgcggtcgcggcgggcggcaatacgcagctcgacttcaagcgcggcaacaccgtgctcgtctttgcgttgccatga

SEQ ID NO: 49824 - protein, 557 aa, Burkholderia fungorum LB400
MPAAYAADEVQNSSTTTSSPVPSTLQPVSQEQLDRAATTSNDWLLSNGSYAQTRYYRGAQINKTNVSKLRPAFIFQTAVNESMETAPIVSNGVMFITTSFNHVYAVDAVTGKEFWHYKHKMGAVTTFCCGPNNRGVAIAGDRLYMGTLDAKLVALDAKTGSVLWQTQIADPDEGYSETMAPTVVDGKVLIGTNGGEYGIRGFLKAFDANSGQLLWTFYTIPETGQEGVWATKDATGRDGKRDIDAEKKQLAEKGGDFYKTLGGGVWMAPAIDRQTHTVFFVVGNPSPDLYGAIRPGDNLYTDSLVAIDLDTGKYKWHYQYVPHDVWDLDAVSPPMLIDVRDNNGRMIPGVVHGGKTGHVYVHDRATGRLIRYSQAMIPQENMWTLPTAAGARMLPGANGGVEWSPMAFDPHTRLVYAANLHQPMTYQVEDAAYPGGSKLWLGGAFKTIASEQQWGKLSAVNVDTGKVAWDYKTEQPLIGGVLTTAGGLVFNGEGNGLFRAFDSATGKKLWEFQCGAGVNAPAVSYMVHGKQYIAVAAGGNTQLDFKRGNTVLVFALP

SEQ ID NO: 49825 - DNA, 1818 bp, Burkholderia fungorum LB400
  CDS (1)..(1818)
atgaacttacgcaccacggttcttgggctcgcgatcctcgcgtcggcagccttgagttcgttcgttgcacaggccgattcgcagctcgacgggctcatgaagaatccgtccaactgggccgcgcaggcgggcgactatgccaaccatcgctacagccctctcaagcagatcaacgaaaacaacgtcgggaaactacaggtcgcgtggaccatgtcgaccggcgtgctgcgcggccacgaaggcgcgccgctcgtgatcggcgacaccatgtatatccactcgccatttcctaacaaggtaatcgctatcaacctgaaggatcagacgttcatctggcagtacctgccgaaacaggacgatcaggtggtgtccgtgatgtgctgcgataccgtcaaccgcgggctcgcgtatggcgacggcaagatcttcctgcagcaggccgacaccaaactcgtcgcgttgaacgccaaaaccggcgacgtggtctggaccgcgcaaaacggtaatcccaaggcaggtgaaaccaacaccaacgcgccgcacgtattcggcgacaaggtgcttaccggcatttccggcggcgagttcggcgtacgcgggcgtctcatcgcgtacgacatcaagaccgggaaaccggcctggacggcctacagcacgggcccggacaaggacatgctgatcgatcccgacaagacgacgacgtatgccgacggcaagatggtgccggtgggcgcggactcgtcgctgaagtcgtggaagggggaccagtggaaactgggcggcggcaccacctggggctggtacgcgtgggatccgaaactcaaccttgtctactacggcaccggcaatccgggtacatggaatccgacgcagcgtccgggcgacaacaaatggtcgatgtccatctttgcgcgcgatctgaataccggtcaagccagatgggtctaccagatgacgccgcacgacgagtgggactatgacggcgtcaacgaaatgatcctgtcggacctgtcgatcgacggcaaaaaggttccggctatcgttcacttcgaccgtaacggtttcggctacacgttgaatcgcgagaccggccagttgctggttgcgcagaagttcgacccggcggtgaactgggccgatcacgtcgacatgaagagcggcaagccgattcgcaacgccgcctattcgacgcaggcagccggttcggaccacaacgtgaagggcatctgtccggcggcgctcggctcgaaggaccagcagcccgcggcgtacgaccccggttccagcctcttcctcgtgccgaccaaccacgtttgcatggactacgaaccgttcgatgtcgactacgtgtcgggccagccgtatgtgggcgccacgctgtctatgtatccgggcccgaacgacaacaactcgatgggtaacttcattgcctgggatgcttcgaagggcaagatcgtctggtccaagccggagcggttctcggtatggtcgggcgtgctggccaccgcaggcggcgtggctttctacggcacgctggaaggctacatcaaggcagtccgcatcaaggacggcaaggaactgtggcgcttcaagacgccgtcgggaatcatcggcaacgtctttacctacgagtatcagggcaagcagttcatcggcgtctactcgggtattggcggctgggccggtatcggcatggcggcgggtctcgagaagtcgacggaaggcctgggcgcggtgggcggttatcgcgagctcgcgaagtacacggcattgggcggcacgctcttcgtgttcgccattcccggcggcaacagctag

SEQ ID NO: 49826 - protein, 605 aa, Burkholderia fungorum LB400
MNLRTTVLGLAILASAALSSFVAQADSQLDGLMKNPSNWAAQAGDYANHRYSPLKQINENNVGKLQVAWTMSTGVLRGHEGAPLVIGDTMYIHSPFPNKVIAINLKDQTFIWQYLPKQDDQVVSVMCCDTVNRGLAYGDGKIFLQQADTKLVALNAKTGDVVWTAQNGNPKAGETNTNAPHVFGDKVLTGISGGEFGVRGRLIAYDIKTGKPAWTAYSTGPDKDMLIDPDKTTTYADGKMVPVGADSSLKSWKGDQWKLGGGTTWGWYAWDPKLNLVYYGTGNPGTWNPTQRPGDNKWSMSIFARDLNTGQARWVYQMTPHDEWDYDGVNEMILSDLSIDGKKVPAIVHFDRNGFGYTLNRETGQLLVAQKFDPAVNWADHVDMKSGKPIRNAAYSTQAAGSDHNVKGICPAALGSKDQQPAAYDPGSSLFLVPTNHVCMDYEPFDVDYVSGQPYVGATLSMYPGPNDNNSMGNFIAWDASKGKIVWSKPERFSVWSGVLATAGGVAFYGTLEGYIKAVRIKDGKELWRFKTPSGIIGNVFTYEYQGKQFIGVYSGIGGWAGIGMAAGLEKSTEGLGAVGGYRELAKYTALGGTLFVFAIPGGNS

SEQ ID NO: 49827 - DNA, 2430 bp, Burkholderia fungorum LB400
  CDS (1)..(2430)
atgtccagacaatcggcatcgccgggtttcatcgccgtcatcacactcctgtttactgcgctaaccgccctctatctgctgataggcggtgcatggctgctctcgctcggcgggtccgcgtattacgtcgtggtcgggttcgtgctgctcggcgtgacctggctgctgtaccgccgcagtccggcggcgctcacactctacgcactcgtgctggtcggcacggcggtctgggcgctgtgggagtcgggtcccgacttctgggcgcttgcgccgcgctccggcgtgctcgtcgtgttcggcgtgtggctgctgctgctcgtgagctggcgcctcgatgcgccgcgcaagctcggcgtaacgtcgctagtcggcgcgctcgtgatctgggccggcgtgctggtctacgcgagcttcaatgatccgcagacgatcaacggcacgctgagctcagtggccgccacgcccgccgccaatcccaacggcatcgatccgtccgactggcccgcctatggccgaacccaggaaggcacgcgctacgcgccgctgcagcagatcacgcccgaaaacgtcaagaacctgcaggtggcctggaccttccgcacaggcgatatgaaaggtccaaacgatccggtcgagatcaccaatgaagtcacgccgatcaagatcggcaatctgctctatctgtgctcgccccaccagatcctgttcgcgctcgatgcgaagaccggcgaacagaaatggaagttcgacccgaaactgcggcccgatccgtcgttccagcacgtgacctgccgcggcgtgtcgtatgtcgatctctcggcaagcgctgcgaccgcgcaacccaacgcgcccgccgcacccgcgagcgacaccgcgccggcggcatcggccgcatcggcggccagcggcgcctgcctgcgccgcatctatctgcccgtcaacgacggccacctctacgcgctcgacgcgcagacaggcgagcgctgcgcgggcttcggcaacaacggcgatctcgaccttcagcacgcgcagccggtcacgacgccgggcatgtacgagccgacttcgccgccgatcgtcacgaacacgacgatcatcgtggcgggcgcggtggaagacaacttctcgacgcgcgagccctcgggcgtgatccgcggcttcgacgtgcgcaccggccagctgcagtgggcgttcgatcccggcgcgcaagacccgaacaggattccgggcgcgggcgagcactacaccatcggttcgccgaactcgtgggcgccctccgcctacgacgcgaagctcgacatcatctatctgccgatgggcgtgaccacgcccgacatctggggcggcaaccgcacacccgagcaggagcgctatgcgagcggcctgctggcgctgcatgcgtcgacgggcaagctggcctggttctaccagaccgcgcaccatgacctgtgggacatggaccagccgtcgcagcccacactggcggacatcaccggcaaggacggcaagaccgtgccggtcgtgtatgcgcccgccaagaccggcaacctgttcgtgctcgatcgccgcaccggcaccccggtcgtacccgcgcccgaaatgccggtgccgcaaggcgccgcgcccggcgatcacgtttcgcccacgcaaccgttctccgatctcacattccgcccgaagaacctgctcaccgacgccgacatgtggggcgcgacgatgtacgaccagctcgtatgccgcgtcatgtttcacaagctgcggtatgaaggcacgttcacgccgccgtcgctgcagggcacgctggtgtttccgggcaacctcggcatgttcgagtggggcggcattgccgtcgacaccgaccggcagatcgccattgccaatccgattgcactgccgttcgtctcgcgcctgatcccacgcggcccaggcaacccgatgcaacccgagccgggcgcaaaaggcagcggcaccgaagcgggcatccagccgcaatacggcgtgccgtacggcgtgacgctgaacgcgttcctctcgccgttgggcttgccgtgcaaacagccggcctggggctacatctcggcggtcgatctgaagaccaacgagatcgtgtggaagaagcgcatcggcacggtgcgcgacagttcgccgattccgctgccgttcagaatgggcatgccgatgctcggcggtccgatcgtgacggcgggcggcgtcgtgttcatcggtgcgacggcggacaactacatccgcgcgttcgacgtgaacaacggcaaggaactgtggcgcgcgcgtctgccggcgggcggccaggccacgccgatgagctattccatcgacggccgccagtacatcgtgatcgccgcgggcgggcacggttcgttcggcaccaaactcggcgattacgtgatggcttacgcgttgccgcagtaa

SEQ ID NO: 49828 - protein, 809 aa, Burkholderia fungorum LB400
MSRQSASPGFIAVITLLFTALTALYLLIGGAWLLSLGGSAYYVVVGFVLLGVTWLLYRRSPAALTLYALVLVGTAVWALWESGPDFWALAPRSGVLVVFGVWLLLLVSWRLDAPRKLGVTSLVGALVIWAGVLVYASFNDPQTINGTLSSVAATPAANPNGIDPSDWPAYGRTQEGTRYAPLQQITPENVKNLQVAWTFRTGDMKGPNDPVEITNEVTPIKIGNLLYLCSPHQILFALDAKTGEQKWKFDPKLRPDPSFQHVTCRGVSYVDLSASAATAQPNAPAAPASDTAPAASAASAASGACLRRIYLPVNDGHLYALDAQTGERCAGFGNNGDLDLQHAQPVTTPGMYEPTSPPIVTNTTIIVAGAVEDNFSTREPSGVIRGFDVRTGQLQWAFDPGAQDPNRIPGAGEHYTIGSPNSWAPSAYDAKLDIIYLPMGVTTPDIWGGNRTPEQERYASGLLALHASTGKLAWFYQTAHHDLWDMDQPSQPTLADITGKDGKTVPVVYAPAKTGNLFVLDRRTGTPVVPAPEMPVPQGAAPGDHVSPTQPFSDLTFRPKNLLTDADMWGATMYDQLVCRVMFHKLRYEGTFTPPSLQGTLVFPGNLGMFEWGGIAVDTDRQIAIANPIALPFVSRLIPRGPGNPMQPEPGAKGSGTEAGIQPQYGVPYGVTLNAFLSPLGLPCKQPAWGYISAVDLKTNEIVWKKRIGTVRDSSPIPLPFRMGMPMLGGPIVTAGGVVFIGATADNYIRAFDVNNGKELWRARLPAGGQATPMSYSIDGRQYIVIAAGGHGSFGTKLGDYVMAYALPQ

SEQ ID NO: 49829 - DNA, 2094 bp, Novosphingobium aromaticivorans DSM 12444
  CDS (1)..(2094)
atggccgcactgctgccgctggcggcgtgcaacatcaagagcgagggcggcggggatgccgtcgccaacgccggcgtcaccgacgccctcatcgcccaggcgcccgaaggcgaatggctgagctatggccgcgattatggcgagcagcgcttctccccgctcacccagatcaatgacggcaacgtcggccagctcggtcttgcctggttccatgacctcgagaccgcgcgcgggcaggaagccacgccgctgatgcatgacggcacgctctacatctcgaccgcgtggtcgatggtgaaggcgttcgatgccaagaccggcgcgctcaagtggtcctacgatcccgaagtcccgcgcgagacgctggtccgcgcctgctgcgacgcggtcaatcgcggcgtcgcgctctatggcgacaaggtcttcgtcggcacgctcgacggtcgcctcgtcgcgctcgaccagaagaccggaaaggtcgtctggtccaaggtcgtcgtgcccaaccaggaggactacaccatcaccggcgccccgcgcgtggtgaagggcaaggttctgatcggtagcggcggctcggagtacaaggcgcgcggctatatcgccgcctacgacgtcaacaccggcaacgaagtgtggaagttccacaccgtccccggcaatccagcggacgggttcgagaacaaggcgatggaaaacgccgcccgcacgtgggctggcgaatggtggaagctcggcgggggcggcacggtgtgggattccatcacctatgatcccgccaccaacctcgtcctgttcggcaccggcaatgccgagccatggaacccggccgcagccgggcgcgagggcgacagcctctacacgtcctcgatcgtcgcggtgaatgccgataccggcgactatgtctggcatttccaggaaaccccggaagaccgctgggacttcgactccgcgcagcagatcacgctggccgacctgaccatcgatgggcagcggcgccacgtgatccttcatgcgcccaagaacggtcacgtctatgtgctcgacgccaggaccgggcagttcctgtcggcaacgcccttcgtgatggtcaactgggcgaccggtatcgatcccaagaccggcaaggccaccgtcaatcccgaagcccgctatgaaaagaccggcaagcccttcgtcagcctgcccggtgcggtcggcgcacactcctggcagccgcagagcttcagcccgaagaccggcctgctctaccttccggtgaacaacgcggcattcccctatgccgccgccaaggactggaaggccaccgacatcggcttccagaccggcctcgacggctatgtcacctcgatgcccgccgacgccaaggtccagggcgccgcgatgaaggcgaccaccggtacgctcgtggcgtgggacccggttgcgaagaaggccgcgtggaaggtcgaactgccgagcccgtcgaacggcggcattctctcgaccgctggcaatctcgtgttccagggcaccgcgggcggcgatttcgttgcctacaacgccgacaagggcaagcagctctggtcgttcccggcgcagagcggcatccttgccgcgccgatgacctatgcgatcgacggcgaacagtacgtcgcggtcatggtcggctggggcggcgtgtgggacgtcgccaccggcgtcctcgcgcacaaggccaagaagcagcgcaacatcagccgcctggtcgtgttcaagctcggcggcaaggccacgctgcccgctgctcccccgatggccaagatggtcctcgatccgccgccgttcaccggcacgcccgaacaggccaaggccggcggcgaactctacggacgctactgcaacgtctgccacggcgatgcggcggttgcgggcggcgtgaaccccgatctgcgtcactccgcggcgctcaatgcccccgaggcgatccgctcggtggtgatcgagggcgcgctgcagcacaacggcatggtctcgttcaagtcggcgctgaagcccgaggatgcggacaacatccgccactacctcatcaagcgcgccaacgaggacaaggctctcgaagccaagggcggctga

SEQ ID NO: 49830 - protein, 697 aa, Novosphingobium aromaticivorans DSM 12444
MAALLPLAACNIKSEGGGDAVANAGVTDALIAQAPEGEWLSYGRDYGEQRFSPLTQINDGNVGQLGLAWFHDLETARGQEATPLMHDGTLYISTAWSMVKAFDAKTGALKWSYDPEVPRETLVRACCDAVNRGVALYGDKVFVGTLDGRLVALDQKTGKVVWSKVVVPNQEDYTITGAPRVVKGKVLIGSGGSEYKARGYIAAYDVNTGNEVWKFHTVPGNPADGFENKAMENAARTWAGEWWKLGGGGTVWDSITYDPATNLVLFGTGNAEPWNPAAAGREGDSLYTSSIVAVNADTGDYVWHFQETPEDRWDFDSAQQITLADLTIDGQRRHVILHAPKNGHVYVLDARTGQFLSATPFVMVNWATGIDPKTGKATVNPEARYEKTGKPFVSLPGAVGAHSWQPQSFSPKTGLLYLPVNNAAFPYAAAKDWKATDIGFQTGLDGYVTSMPADAKVQGAAMKATTGTLVAWDPVAKKAAWKVELPSPSNGGILSTAGNLVFQGTAGGDFVAYNADKGKQLWSFPAQSGILAAPMTYAIDGEQYVAVMVGWGGVWDVATGVLAHKAKKQRNISRLVVFKLGGKATLPAAPPMAKMVLDPPPFTGTPEQAKAGGELYGRYCNVCHGDAAVAGGVNPDLRHSAALNAPEAIRSVVIEGALQHNGMVSFKSALKPEDADNIRHYLIKRANEDKALEAKGG

SEQ ID NO: 49831 - DNA, 2184 bp, Novosphingobium aromaticivorans DSM 12444
  CDS (1)..(2184)
atgatgcgccagcttctcgccaccctgttccttggcctcgccgcctgctccctcggcggcgcgactgtcctgaccgagggcgccggacgcgagtggcccggcccgggcggtgacgccggcaagacgcatcactcgcgcctgaccgccatcaacgcggagaacgtcggtcggctcggccttgcgtggcaagtcgaacttggcaccctgcgcgggcaggaggcgaccccggtcgtggtggacggcgtgctctacacctcgggcaccacgggccgcgcctatgcgttcgatgcggcgaccggcaaggagctgtggcggttcgagcccgaggtcgacatgcaggtcaaccgcacggtctgctgcgacatggtcaaccgtggcgtcgcggtggggcgcggcaaggtcttcgtcgccagtctcgatgggtggatgtacgcactcgatgcccgcaccggcgcggtcgtctggaagagcgacttcatcgagaaccgagccaagggcgacaattccaccggcgctcccgaaatcgcgggcgatgtcgtcgtcatcggcatgggcggcgcggagtacgacgtgcgcggctatgtcacggcgctcgatctcgataccggaaagctgcgctggcgttggcacgtggtgccccgcgatcccaagctggggccgcaggaaacgcccgaactcgaagccgcgctgaagacttgggacccgaacagccgctgggacatcggcggcggtggcagcccgtgggatgcgatcaactacgaccccgaaaccggcctggtccttgtcggcaccggcaatggcgggccttacgccacgtccaagcgctcgcctgcggggggcgacaacctctacctcgccagcctcgtcgcgctcgatccgaagaccgggcggatgaagtggcactaccaggaaacgccgggcgacaactgggacttcaccgccacccagccgatgatcttcacccgcatgaagatcgacggcgaggaccggccagtcgtgctccacgcgccgaagaacggctatctctacattctcgaccggcgcgacggaaaactgctgcgcgccaatcccatcgtccgcaccaactgggccaagggcatcgatcccgggaccggccgcccgatcctcgatcccgcggccgccgactataccaccggtcccaagatcgtgttcccggccacgaccggcgcacgcaactggcaccccgccagctacgatccagcgaccgggctctacatcggcgcggtgctcgacatgggcaatctcatcttcatgacgccgggggccaagccgctcaaggcgcgcgggctcaacaacgatgccgcgctcatcttcacgccggacgtcaaggaagcgcttgccgccttcccgcctgaattcggcgatgccgtgcgcaagttgcctgcctatcaggaggcgctgaagcagcctgccaccgcgcagatccgcgccatcgatccgctaaccgggaagaccgtctgggcggccgataccgccggctggcaggatcgcggcggcgtgctgaccacgtcttcgggccttaccatccatggcggcgtcaccggcaagctcttcgtgcgcgatacgaaaaccggcaagctcctgaaggaaatagacaccggcactccgatcatggccgcgccgatgacttacgaggttggcggcgtgcagtacatcgccgtcatggccgggtggggcgggggcggctatcccttcgtcccgcgctattccgcagcctatacgcgcggcaacatgaaccggctgctggtgttcaaggtggggggcggcaaggtgccgttgccggacctgctcccgccgctggaagtggcgccggaaccgccggcacaggccgcgggcgtgacggcggcgaccatcgcgcgcgggcagggcctgttcttcggcaattgcgcgatctgtcacgccaaccagccccgctcgatcacgccggacttgcgccggatgcagcctgccacgcacgagatgttccgcgagatcgtgctcgaaggcctgctcacgcccaatggcatgccgcgctggaacgacatcctctcgaccgacgatgccgacgcgatccacgcctacctgatcgacctccagggcaagacgcgcgcggacgaactggccaagcagaaggccggcaagccgctcgatgggcctagtctgacgatcctgagcaattactga

SEQ ID NO: 49832 - protein, 727 aa, Novosphingobium aromaticivorans DSM 12444
MMRQLLATLFLGLAACSLGGATVLTEGAGREWPGPGGDAGKTHHSRLTAINAENVGRLGLAWQVELGTLRGQEATPVVVDGVLYTSGTTGRAYAFDAATGKELWRFEPEVDMQVNRTVCCDMVNRGVAVGRGKVFVASLDGWMYALDARTGAVVWKSDFIENRAKGDNSTGAPEIAGDVVVIGMGGAEYDVRGYVTALDLDTGKLRWRWHVVPRDPKLGPQETPELEAALKTWDPNSRWDIGGGGSPWDAINYDPETGLVLVGTGNGGPYATSKRSPAGGDNLYLASLVALDPKTGRMKWHYQETPGDNWDFTATQPMIFTRMKIDGEDRPVVLHAPKNGYLYILDRRDGKLLRANPIVRTNWAKGIDPGTGRPILDPAAADYTTGPKIVFPATTGARNWHPASYDPATGLYIGAVLDMGNLIFMTPGAKPLKARGLNNDAALIFTPDVKEALAAFPPEFGDAVRKLPAYQEALKQPATAQIRAIDPLTGKTVWAADTAGWQDRGGVLTTSSGLTIHGGVTGKLFVRDTKTGKLLKEIDTGTPIMAAPMTYEVGGVQYIAVMAGWGGGGYPFVPRYSAAYTRGNMNRLLVFKVGGGKVPLPDLLPPLEVAPEPPAQAAGVTAATIARGQGLFFGNCAICHANQPRSITPDLRRMQPATHEMFREIVLEGLLTPNGMPRWNDILSTDDADAIHAYLIDLQGKTRADELAKQKAGKPLDGPSLTILSNY

SEQ ID NO: 49833 - DNA, 2049 bp, Polaromonas sp. JS666
  CDS (1)..(2049)
atggctgagggagccaagggcttgacggcgcacattgcggccgtgaccaagaaggtcgatggtgcgtttatgcgcgccaacgaggccaagaccgctgattggccaagcactgggctggactatgccgagacacggttcagcaaacttgatcaggtcaatgcttccaacgtcaaggatatgggactggtctggtcgtacaacctggaatcgacccggggtgtcgaggccacgccgctggtggtggacggcatcatgtacgtgaccgcgtcctggagtattgttcacgccgtggatgtgcgcacagggaaacgcatctggacctatgacccaaaaatcaaacgtgagttcggttacaaaggctgttgtgacgtggttaaccgtggcgtggccttgcacaagggccgcgtctacgttgccgcctttgacggccggttgatcgcgctggatgccgcatccggcaaagtggcgtgggaacaggacaccgtcattgatcacagccgttcctacaccagcacgggcgcaccacggattttcaaagacaaggtcatcattggcaatggtggtgccgaatacggcgtgcgcggctatatcacggcctacgatgccgccagcggcaaacaaaaatggcgatggtttacggtaccaggggatccaagcaagccttttgaagacgcttccatggccgcggcggccaaaacctgggaccccagcggcaagtactgggaggcgggcggcggtggcaccgcctgggactcgatggcctttgacccagccttgaatctgatgtacgtcgggaccggcaacggctcaccctggagtcgcgccaagcgcagccccgcaggtggcgacaacctttacctggcctccatcgttgcactcaatccggacaccggcaagtacgtctggcattaccaggaaacccccggcgacaactgggactacacgtcgacccagccgatgatcctggccgacctcaagattgaaggcaagccgcgcaaggtgatcctgcacgcacccaagaacggtttcttcttcgtgatcgaccgcaccaacggcaagttcatctcggcaaaaaactttgttgatgtgaactgggccaccggctatgacgcgacgggtcgccccatcgagaccgccgaggcgcgccccacggatcggccgtttgacgccattccaggcccctatggcgcgcacaactggcattccatgtcattcaacccacagaccgggttggtctacttgccgacgcaaaatatacctatcaacctgatggacgacaagaactggagcttcaattccaacaagccaggtcaaccaggctccggtacgggttggaatactggcaatttgatcaatgtaacgccgccgaaaagcaagccgtttggacgcctgattgcctgggatccggttcaaaaaaaagaagcatggcgccaggaacaggtgtcgccctggaacggcggtacgctgaccacggccggcaacctggtttttcagggcacggcagacgggcgatttattgcctataacgcccagaacggcgagaagttgtgggaatccccgacgggcaccggtgtgattgcggcaccggtcacctacctggtggatggcaagcagtacgtgtcgattgccgtgggatggggcggctcttacggggtttcccagcgcgcctccgaacgacaaggcttgggcacggtctatacctttgccgtgggtggcaaagcgcctatgccggagtttgttgcttaccgaatgggcgaactggtggctggcgtgaaatacgatccggcccaggtgccggcgggtactgcgctgtatgtgagcaactgcgttctctgccatggtgttcccggcgtggaccgcggcggcagcattcccaacctcggctacatgaacgcggccttcatcgaaaacctcgacaagttcatcttcaaaggaccggccatgagccggggcatgccggacttcacgggcaagctgagcgtggacgatgtggagaagatcaaggccttcatccagggtacggcagacgcgatacgccccaagaaatga

SEQ ID NO: 49834 - protein, 682 aa, Polaromonas sp. JS666
MAEGAKGLTAHIAAVTKKVDGAFMRANEAKTADWPSTGLDYAETRFSKLDQVNASNVKDMGLVWSYNLESTRGVEATPLVVDGIMYVTASWSIVHAVDVRTGKRIWTYDPKIKREFGYKGCCDVVNRGVALHKGRVYVAAFDGRLIALDAASGKVAWEQDTVIDHSRSYTSTGAPRIFKDKVIIGNGGAEYGVRGYITAYDAASGKQKWRWFTVPGDPSKPFEDASMAAAAKTWDPSGKYWEAGGGGTAWDSMAFDPALNLMYVGTGNGSPWSRAKRSPAGGDNLYLASIVALNPDTGKYVWHYQETPGDNWDYTSTQPMILADLKIEGKPRKVILHAPKNGFFFVIDRTNGKFISAKNFVDVNWATGYDATGRPIETAEARPTDRPFDAIPGPYGAHNWHSMSFNPQTGLVYLPTQNIPINLMDDKNWSFNSNKPGQPGSGTGWNTGNLINVTPPKSKPFGRLIAWDPVQKKEAWRQEQVSPWNGGTLTTAGNLVFQGTADGRFIAYNAQNGEKLWESPTGTGVIAAPVTYLVDGKQYVSIAVGWGGSYGVSQRASERQGLGTVYTFAVGGKAPMPEFVAYRMGELVAGVKYDPAQVPAGTALYVSNCVLCHGVPGVDRGGSIPNLGYMNAAFIENLDKFIFKGPAMSRGMPDFTGKLSVDDVEKIKAFIQGTADAIRPKK

SEQ ID NO: 49835 - DNA, 1902 bp, Hyphomicrobium methylovorum
  CDS (1)..(1902)
atgggcatgaaaaaagtcgttagcacaccaatgctgatgtcggcgtcctgtatggcaattgctgttgctctgcaggtcggcgtcgcatccagcgcttacgcgaatgataagctcatcgagctttcgaagagcaacgaaaactgggtaatgcccggtaagaactacgattcgaacaactacagcgaatctacgcaggttaacgctgaaaacgttaagcagctcaagcatgcttggtcgttctcgacgggcgaacttcatggtcatgaaggtgcgccgctcgtgatcggcgacatgatgtacgttcactcatcgttcccgaacaagacgttcgctctcaacctcaatgacccgggccacatcctgtggcagcacagcccgaagcaggaccctgctgctcgctcagtcgcttgctgcgatctcgtgaaccgcggtctggcttactggccgggcgacgacaagacgcctgctctggttatcaagacgcagctcgacggccatctcgtggctctcaatgccaagactggcgaagagttctggaaggttgagaacggcgacatcaaggtcggtcagacgctgacgcaggctccgtatgtcgttcatgacttggcgatcgtcggttcgtcgggcgctgagctcggtgttcgcggccacgtcactgcttacaacgtcaagacgggtgagcaggcttggcgttactacgcaaccggtcccgatgaagaaatcggtctggctgacgacttcaacagcgctaacccgcactacggccagaagggcctcggaacggcgacctgggaaggcgatgcctggaagatcggcggcggcacgaactggggctggtacgcatacgatcctcaagccaacctgatctactacggatcgggcaacccggctccgtggaacgaaacgatgcgtcccggcgacaacaagtggaccatgacgatcacggcccgcgacgctgacaccggtaagatgaagttcggctaccagaagaccccgcacgacgagtgggacttcgctggcgtgaacgtcatcatgctgtctgagcagacggacaaggaaggcaagaagcgtaagctcctgacccatcccgaccgtaacggcatcgtctacacgctcgatcgtgagaacggcgacctgatctcggccgacaaactcgacgacaccgtcaacgtgttcaagcacgtcgacctgaagtcgggcctcccggttcgcgatcctgagttcggcacgcgcatggaccataagggcaccgaaatctgcccgtcggccatgggttaccacaaccagggtcacgactcttacgatcccacgaagcagctgttcttcatgggcatcaaccacatctgcatggactgggaaccatttatgcttccctatcgtgccggccagttcttcgtcggtgcaactctgtggatgtatcctggcccgaagggcgatcgccagaactacctcggtctcggacagatcaaggcgtacaacgcgatcaccaacacctacaagtgggagcacatggagcgcttctcggtctggggcggcacgctcgcgaccgcaggcaacctggtgttctacggaacgctcgatggcttcctcaaagctcgtaactcggacaccggcgaactgctttggaagcacaagctgccttccggcgtgatcggttacccgatgacgtacgaacataagggcgtgcagtacatcgccgttatgtcgggcgttggtggttggccgggcgttggcctcgtgttcgaccttcaggatccgacggccggtctcggtgcggttggcgccttcaagaacctgcaacgctacacgcagatgggcggcagcctcgaagtgttctcgcttgatggcaagaacccctacgacgacgtgaacgtggcgaattggacgaagggctgtatctag

SEQ ID NO: 49836 - protein, 633 aa, Hyphomicrobium methylovorum
MGMKKVVSTPMLMSASCMAIAVALQVGVASSAYANDKLIELSKSNENWVMPGKNYDSNNYSESTQVNAENVKQLKHAWSFSTGELHGHEGAPLVIGDMMYVHSSFPNKTFALNLNDPGHILWQHSPKQDPAARSVACCDLVNRGLAYWPGDDKTPALVIKTQLDGHLVALNAKTGEEFWKVENGDIKVGQTLTQAPYVVHDLAIVGSSGAELGVRGHVTAYNVKTGEQAWRYYATGPDEEIGLADDFNSANPHYGQKGLGTATWEGDAWKIGGGTNWGWYAYDPQANLIYYGSGNPAPWNETMRPGDNKWTMTITARDADTGKMKFGYQKTPHDEWDFAGVNVIMLSEQTDKEGKKRKLLTHPDRNGIVYTLDRENGDLISADKLDDTVNVFKHVDLKSGLPVRDPEFGTRMDHKGTEICPSAMGYHNQGHDSYDPTKQLFFMGINHICMDWEPFMLPYRAGQFFVGATLWMYPGPKGDRQNYLGLGQIKAYNAITNTYKWEHMERFSVWGGTLATAGNLVFYGTLDGFLKARNSDTGELLWKHKLPSGVIGYPMTYEHKGVQYIAVMSGVGGWPGVGLVFDLQDPTAGLGAVGAFKNLQRYTQMGGSLEVFSLDGKNPYDDVNVANWTKGCI

SEQ ID NO: 49837 - DNA, 1806 bp, Methylobacterium extorquens
  CDS (1)..(1806)
atgagagcggtacatctcctcgcactcggtgcgggtctcgcggctgcaagcccggccctcgccaacgaaagcgttctgaagggcgtcgccaacccggcggagcaggtgctccagacggtcgattacgccaacacccgctattccaagctcgaccagatcaacgccagcaacgtcaagaacctccaggttgcctggaccttctcgaccggcgtgctgcgcggccacgagggctccccgctcgtcgtcggcaacatcatgtacgtccacacccccttcccgaacatcgtctacgcgctggacctcgaccagggcgccaagatcgtgtggaagtacgagccgaagcaggatccgtccgtgatcccggtcatgtgctgtgacacggtcaaccgtggtctggcctacgccgacggcgcgatcctcctgcaccaggccgacaccacgctcgtctcgctcgacgccaagtccggcaaggtgaactggtcggtcaagaacggcgacccgtccaagggtgagaccaacaccgccaccgttctcccggtgaaggacaaggtcatcgtcggcatctccggcggcgagttcggcgtgcagtgccacgtcaccgcctacgacctgaagtccggcaagaaggtgtggcgcggctactcgatcggcccggacgatcagctgatcgtcgaccccgagaagaccacctcgctcggcaagccgatcgccaaggactcctcgctgaagacctgggaaggcgatcagtggaagaccggcggcggctgcacctggggctggttctcctacgatcccaagctcgacctgatgtactacggctcgggcaacccctccacctggaaccccaagcagcgtccgggcgacaacaagtggtcgatgaccatttgggcgcgtaaccccgacaccggcatggccaagtgggtctaccagatgaccccccacgacgagtgggacttcgacggcatcaacgagatgatcctcacggatcagaagttcgacggcaaggaccgtccgctgctgacgcacttcgatcgtaacggcttcggctacacgctcgaccgcgccaccggtgaagtgctcgtcgccgagaagttcgatccggtcgtgaactgggccaccaaggtcgacctggacaagggttccaagacctacggccgtccgctggtcgtgtcgaagtactcgaccgagcagaacggtgaagacgtgaactcgaagggcatctgcccggcggctctcggcaccaaggaccagcagccggcggccttctcgcccaagaccggcctgttctacgtccccaccaaccacgtctgcatggactacgagccgttccgggtgacctacaccccgggccagccctacgtcggtgcgaccctctccatgtacccggctcctggctcgcatggcggcatgggcaacttcatcgcctgggacaacctccagggtaagatcaagtggtccaaccccgagcagttctcggcttggggcggcgcgctcgccacgtccggtgacgtcctgttctacggcaccctcgaaggcttcctgaaggccgtcgactcgaagacgggtaaggaactgtacaagttcaagaccccgtcgggcatcatcggcaacgtgatgacctacgagcacaagggcaagcagcacgtcgccgtcctctcgggcgttggtggctgggccggcatcggcctcgcggccggcctgaccgacccgaacgccggcctcggcgcggtgggtggctatgcggccctgtcgagctacaccaacctcggtggccagctcacggtcttctcgctgccgaacaactaa

SEQ ID NO: 49838 - protein, 601 aa, Methylobacterium extorquens
MRAVHLLALGAGLAAASPALANESVLKGVANPAEQVLQTVDYANTRYSKLDQINASNVKNLQVAWTFSTGVLRGHEGSPLVVGNIMYVHTPFPNIVYALDLDQGAKIVWKYEPKQDPSVIPVMCCDTVNRGLAYADGAILLHQADTTLVSLDAKSGKVNWSVKNGDPSKGETNTATVLPVKDKVIVGISGGEFGVQCHVTAYDLKSGKKVWRGYSIGPDDQLIVDPEKTTSLGKPIAKDSSLKTWEGDQWKTGGGCTWGWFSYDPKLDLMYYGSGNPSTWNPKQRPGDNKWSMTIWARNPDTGMAKWVYQMTPHDEWDFDGINEMILTDQKFDGKDRPLLTHFDRNGFGYTLDRATGEVLVAEKFDPVVNWATKVDLDKGSKTYGRPLVVSKYSTEQNGEDVNSKGICPAALGTKDQQPAAFSPKTGLFYVPTNHVCMDYEPFRVTYTPGQPYVGATLSMYPAPGSHGGMGNFIAWDNLQGKIKWSNPEQFSAWGGALATSGDVLFYGTLEGFLKAVDSKTGKELYKFKTPSGIIGNVMTYEHKGKQHVAVLSGVGGWAGIGLAAGLTDPNAGLGAVGGYAALSSYTNLGGQLTVFSLPNN

SEQ ID NO: 49839 - DNA, 2361 bp, Pantoea citrea
  CDS (1)..(2361)
atgtctcgggtctctactatacttcatgggttaacacggatattttcgctattctgtgccgcatggctgctgattggcggcgtgtggctattatctgtcggagggagtgcttactaccttatctgcggtatagccatggcgatattttctatattgttatggaagcgcagaagcagtgcattttacctctattcgcttatcctgattctgtcagccctctgggcatggcgggaggcggggactgacttctggaacctggttccacgtctggatatctggatactgtttggtatctggttgatattgccgttcagttaccggcgttttaacactgccggtaaaaaaccattgctggcaatggtgattggcctcgggattaatgccctgctgctgctgggcgcgtcactgcacgacccacaggaaatcaacggtgtgcttaatgtcagtgataagccgccagccgaatctgcggcgtctgcagcagactggccggcctatggacgtactcaggaaggggtccgttattctccgctgacacaaatcaacgataaaaacgttcaacaattacaggttgcctggcagttccataccggtgaccataaaacagcgaatgacccgggtgagatcactaatgaagtgacaccgctgaaagtcggtaatatgctgtacctctgtacaccgcatcagatactgattgccctggatgctgccagtggcagagagaaatggcgttttgatccgcagctcaaatctgatccgacattccagcatattacctgccggggtgtttcctatcatgaaatcaaatctgttcagggcgactcatcagcgccggccgcctgttcacggcgtattttcctgccggttgatgacggtcgtctgttcgcggttgatgccttaaccggacaacgttgcagtaattttgctaataatggtgaactgaacctgcaacacctgcagccgaacgcttatccgggagggtatgagccaacctcaccgcccatcattactgataaagtggtgatcattgccggttctgtcactgataacttgtctacccgtgaaccatcaggggtcatccgcggtttcgatatcgacagcgggaaactcttatgggtatttgatccgggagcaaaagaccctaatgccgtgcctgctgacgggcagacatttgtggcgaactcaccaaactcctgggcgccggcggcttatgacgcgcagagggatattatttatctgcctatgggggtttcgaccccggatatctggggcggtgccgtaacgcgttgcaggaacgttttgccagcggtttactggctctgcatgcctcaactggcaagctggcatggttttaccagacggtacaccatgcaatcattctgggacatggatttaccctcacagccaaccctggcagatattaccgatgagcagggtaagaccgtgccggtggtctatgtgccggccaaaacgggtaatatttttgttctgaaccgtgacaccggaaaacccgtcgttcctgcccctgaaacaccggtaccgcagggaccggcgaaaggcgaccatctgtctccaacccagcctttttctgagctgactttccgtcctaagaataagctgcagggtagggatatgtggggcgcaaccatgtttgaccagctgatgtgccgggtgatgttccataaactgcgctatgaagggccgtttaccccgccgtctgagcagggtaccctggttttcccaggtgatttcgggatgtttgaatggggcggtatctctgttaacaccgatcagcagtttgcgattgctaatccgatggcgatgccttttatttctaaactgatcccacgcggaccaggcaatcccatagaacccggggctgatggtgccgccggttccggttcagagtccggggtacagcatatgtatggtgtgccttacggagttgaactgaatccgttcctgtcaccgttgggcttaccttgtctgcaaccttcatggggctttgtctcagcgatcaatttacgtaatcaccagatcatctggaaaaaacggattggtactgttcgtgacagtgcgccggtacctctaccctttaaaatgggtgttccaatgttgggcggtccggtgacaacggcaggtaatatcttctttgttgctggcacactggacaactacctgcgggcgtacagtgtccgtgacggcaaactgctgtggcaggctcgtctgccggcaggtggacaagcgacaccaatgacgtatgaggttgatggtaagcaatatgtcgtgattatggccggcggacatggttcttttgggacccggctgggcgattcactgatcgcttataaactaccgtaa

SEQ ID NO: 49840 - protein, 786 aa, Pantoea citrea
MSRVSTILHGLTRIFSLFCAAWLLIGGVWLLSVGGSAYYLICGIAMAIFSILLWKRRSSAFYLYSLILILSALWAWREAGTDFWNLVPRLDIWILFGIWLILPFSYRRFNTAGKKPLLAMVIGLGINALLLLGASLHDPQEINGVLNVSDKPPAESAASAADWPAYGRTQEGVRYSPLTQINDKNVQQLQVAWQFHTGDHKTANDPGEITNEVTPLKVGNMLYLCTPHQILIALDAASGREKWRFDPQLKSDPTFQHITCRGVSYHEIKSVQGDSSAPAACSRRIFLPVDDGRLFAVDALTGQRCSNFANNGELNLQHLQPNAYPGGYEPTSPPIITDKVVIIAGSVTDNLSTREPSGVIRGFDIDSGKLLWVFDPGAKDPNAVPADGQTFVANSPNSWAPAAYDAQRDIIYLPMGVSTPDIWGGAVTRCRNVLPAVYWLCMPQLASWHGFTRRYTMQSFWDMDLPSQPTLADITDEQGKTVPVVYVPAKTGNIFVLNRDTGKPVVPAPETPVPQGPAKGDHLSPTQPFSELTFRPKNKLQGRDMWGATMFDQLMCRVMFHKLRYEGPFTPPSEQGTLVFPGDFGMFEWGGISVNTDQQFAIANPMAMPFISKLIPRGPGNPIEPGADGAAGSGSESGVQHMYGVPYGVELNPFLSPLGLPCLQPSWGFVSAINLRNHQIIWKKRIGTVRDSAPVPLPFKMGVPMLGGPVTTAGNIFFVAGTLDNYLRAYSVRDGKLLWQARLPAGGQATPMTYEVDGKQYVVIMAGGHGSFGTRLGDSLIAYKLP

SEQ ID NO: 49841 - DNA, 2229 bp, Acetobacter pasteurianus
  CDS (1)..(2229)
atgacccgccccgcctccgccaagagacgttcactgctaggaattctcgcggccggaacaatctgtgccgctgctttgccttacgcggcagtccctgcccgcgctgacggtcagggtaatacgggggaagcgatcatccatgcagatgatcaccccgaaaactggctttcttatggtcgcacctacagcgaacagcgctatagcccgcttgatcagatcaaccgctccaacgtgggtgatctcaagctggcttggtactacacgctggataccaaccgcggtcaggaagcaaccccgctggttgtagatggcattatgtatgccacaaccaactggtccaaaatggaagcgctggacgctgccacaggtaaactgctttggcagtatgaccccaaagtgccaggcaacattgctgacaaaggctgctgtgatacggttaaccgtggtgcaggctattggaacggcaaggttttctggggcacgtttgatggccgcctggttgctgccgatgccaaaaccggtaaaaaggtttgggaagttaacaccatcccagccgatgcctctctgggcaagcagcgctcctacacagtggatggcgcggtacgtgtagcaaaaggccttgtgctgattggtaacggtggctctgaatttggtgcccgtggctttgtttctgcttttgatgccgaaaccggcaagctgaaatggcgcttctacactgttcccaacaacaagaacgaacctgaccatgcggtagcagacaatgttctgatgagcaaagcctacaaaacctggggccccaaaggcgcttgggtgcgtcagggcggtggtggcaccgtatgggattcgctggtttatgatccggtgagcgacctgatctatctggctgttggtaacggatctccttggaactataagtatcgttccgaaggcattggttccaacctgttcctgggcagcattgttgcactgaaacctgaaaccggtgaatatgtctggcatttccaggcaaccccaatggatcagtgggattacacctcggttcagcagatcatgacgctggatatgcctgttaacggtgaaatgcgccacgtgatctggcatgcacctaaaaacggcttcttctacgtgctggatgccaagaccggtgaattcctggctggcaaaaactatgtttaccagaactgggctaacggccttgacccgttgaccggccgcccgatctacaacccggatgggctgtacaccctcaccggcaagttctggtatggtatcccaggcccactgggtgcacataacttcatgggaatggcctatagccccaagacgcacttggtctatctgccagcacaccagattccgtttggttataaaaaccaggttggtggctttaaaccgcatccggatgcctggaacgttggtttggacatgaccaaaaacggtctgcccgacaccccagaagcccgtacggcttacatcaaggatctgcacggctggctgctggcctgggatccggtgaagatggaaacggtctggaagattgaccataaaggtccgtggaacggcggcgttctggccaccggtggtgatctcctgttccaggggctggcaaatggtgaattccacgcctatgacgctacaaacgggagcgacctttacaagtttgacgcacagagcggcattattgcctcgcctatgacctatagcgtcaacggcaagcagtatgttgctgttgaagtgggttggggcggcatttacccgatttccatggggggtgtgggccgtacttccggctggacagttaaccactcctacatcgctgtgttctctctggacggcaaagccaagctgccggctctgaacaaccgtggcttcctgcccgtaaaaccaccagcacagtatgaccagaaggtcgttgataatggatacttccagtatcagacctactgccagacctgtcatggtgataacggcgaaggtgcaggcatgctgcctgatctgcgttgggccggtgccatccgccaccaggatgccttctacaatgtggttggtcgcggtgcgctgacggcttacgggatggatcgctttgataccagcatgacgccggatgaaattgaagcaatccgtcagtatctgatcaaacgggcgaacgacacgtatcagcgtgaagtggatgctcggaagaatgacaaggatattcccgaaaacccgacacttggcattaacccctaa

SEQ ID NO: 49842 - protein, 742 aa, Acetobacter pasteurianus
MTRPASAKRRSLLGILAAGTICAAALPYAAVPARADGQGNTGEAIIHADDHPENWLSYGRTYSEQRYSPLDQINRSNVGDLKLAWYYTLDTNRGQEATPLVVDGIMYATTNWSKMEALDAATGKLLWQYDPKVPGNIADKGCCDTVNRGAGYWNGKVFWGTFDGRLVAADAKTGKKVWEVNTIPADASLGKQRSYTVDGAVRVAKGLVLIGNGGSEFGARGFVSAFDAETGKLKWRFYTVPNNKNEPDHAVADNVLMSKAYKTWGPKGAWVRQGGGGTVWDSLVYDPVSDLIYLAVGNGSPWNYKYRSEGIGSNLFLGSIVALKPETGEYVWHFQATPMDQWDYTSVQQIMTLDMPVNGEMRHVIWHAPKNGFFYVLDAKTGEFLAGKNYVYQNWANGLDPLTGRPIYNPDGLYTLTGKFWYGIPGPLGAHNFMGMAYSPKTHLVYLPAHQIPFGYKNQVGGFKPHPDAWNVGLDMTKNGLPDTPEARTAYIKDLHGWLLAWDPVKMETVWKIDHKGPWNGGVLATGGDLLFQGLANGEFHAYDATNGSDLYKFDAQSGIIASPMTYSVNGKQYVAVEVGWGGIYPISMGGVGRTSGWTVNHSYIAVFSLDGKAKLPALNNRGFLPVKPPAQYDQKVVDNGYFQYQTYCQTCHGDNGEGAGMLPDLRWAGAIRHQDAFYNVVGRGALTAYGMDRFDTSMTPDEIEAIRQYLIKRANDTYQREVDARKNDKDIPENPTLGINP

SEQ ID NO: 49843 - DNA, 1674 bp, uncultured bacterium 582
  CDS (1)..(1674)
atgcctataccgcacctaaatggcgcttttgttgcaatgttagcgctcagtctgatagctccagaaaccactttggctcaatcaacctcagaccttataaacgataccaaagacacaaccactattttaacttatggaatgggctatgggcaaactcggcacagcgggctgaggggaataaatctcgacaatatagggcggctcagaccagaatggacctattcgcttagtgatacgcgcgggcaggaaacctttccgctcatccatgacggaaaaatgtacgtcacgacccacgcatcgacgatggcattggatctggtgactggtcgacagatttggaaaacgcttgtggattaccctgcggatactccgcgtgtcgcgtgttgtggtatcgtaaaccggggtgttgcgctttatgaaggcaaagtgtttcgcaccacgctggacgcccatgttatcgcgctggacgctgagaccggcaatgaattatggcggacgcaatccattgatcacaagaccggatattcgatgaccgtcgcgccaatgatggcagatggtgttctgattacggggatctctggtggcgaatacggtattcgtggctatctcgaagggtatgatcctgacaccggagtgcgggtctggcgtacctataccattcctgctccgggagaaccgggcagtgagacatggcaggatggtggggatgcctggacgcgtggaggggcaccaacgtggttaaccgggtcgtatgatcctgaattgaatactgtattttggggtaccggaaatccgtcgtcttggaatgcggcgacacgcccgggagataatctttatgcctcctctatcctcgcgcttgatcccaaaactggcaccatcaagtggcactatcaaaccacgccgaatgacccgtttgatttcgacactgtgaatgagcttgttcatgctgacatagacggacgcaaagttctgatgcaggcgaaccgcaatgggtttttctatgttttggacagggcaaccggcgaattgattgcggctcctaagtttgtcgacaaactcaattgggcagacagcattgatctggaaactagacggccaaaagaaaccgatgtggcaatgaaggcgcggtcgggcgaacagattacattctggccatcggcgttgggtggcaagaactggtcccctatggcctataaccccaagacccggacaatctttgccaacaccaacaagtttggtatgcattacaaggcggtcgagccacaatatcgtccgggcgtgttttattttggtgctgaattcagctgggattggcctgacggagaccgcggcgaattgcgagcttttgacccaatgactggcgtggttaaatggtctgacagcattgcaatcccgcgatattcgggcgttttgtcaaccggcgggggattggtattcaccggcaatatggacggtgaatttgaagcctttaacgctgagactggtgataaagtttggacctatagcaccggttcggggatcatcggtcaaccggtaacctgggagcgtgagggcaaacaatatatcacagtcgcaaatggaagtggtggggtctattcacttttttcaggggatgaacggcttgcttcggtgccggctggcggcaacatctggacgttctctatcgtcgagtaa

SEQ ID NO: 49844 - protein, 557 aa, uncultured bacterium 582
MPIPHLNGAFVAMLALSLIAPETTLAQSTSDLINDTKDTTTILTYGMGYGQTRHSGLRGINLDNIGRLRPEWTYSLSDTRGQETFPLIHDGKMYVTTHASTMALDLVTGRQIWKTLVDYPADTPRVACCGIVNRGVALYEGKVFRTTLDAHVIALDAETGNELWRTQSIDHKTGYSMTVAPMMADGVLITGISGGEYGIRGYLEGYDPDTGVRVWRTYTIPAPGEPGSETWQDGGDAWTRGGAPTWLTGSYDPELNTVFWGTGNPSSWNAATRPGDNLYASSILALDPKTGTIKWHYQTTPNDPFDFDTVNELVHADIDGRKVLMQANRNGFFYVLDRATGELIAAPKFVDKLNWADSIDLETRRPKETDVAMKARSGEQITFWPSALGGKNWSPMAYNPKTRTIFANTNKFGMHYKAVEPQYRPGVFYFGAEFSWDWPDGDRGELRAFDPMTGVVKWSDSIAIPRYSGVLSTGGGLVFTGNMDGEFEAFNAETGDKVWTYSTGSGIIGQPVTWEREGKQYITVANGSGGVYSLFSGDERLASVPAGGNIWTFSIVE

SEQ ID NO: 49845 - DNA, 2253 bp, uncultured bacterium 581
  CDS (1)..(2253)
ttgagacgcactttcaaggtctctttatgcctacttatttttgcaattattggcgcctgcgacaccaaatctgaagctggaaatgggtccagtaacactaactcgatctccaataataacgtcactgatcagcaacccagcaacaacccacttcagtcggggagttggctaaccggcggcggcgattatcggcaagcctacttttccccgcttaagcatattaatcgtagcaatgtcactgagcttggctacgcatggcacatcgatctcccctctgaacatggctatgaagccactccattaatggtcgatggcgtactctacggcagcggcccccaaggcatagcctttgccgtggacgcctcaaacgggcgctctctgtggcagtttaaccctgaaatagacccgcaattcatgcgtaaagtttgttgcggtgtggttaatcgaggcgttgcactatctggggaaacggtattcgtcgccgccctcgatggccacctttttgccctcgataaaattgacggcacggtggtgtggcgtgctgatacatttatggatcgcaagcggggttataccattaccggcgcaccctacattgcgggcgatctggtgattattggtaatgccggcgccgaattcgacgcgcggggctatatcaccgcctacgataggcatacaggcgagcaacgctggcgattttttaccgttccaaatagtcccaacccaccctttgaacacccagagctggaagtcgcagccgccacttgggacccggacagtttgtggcaggtcggattggggggcacggtttgggatgctatggcctttgacccacagctcaatttactttacgtgggcactggaaacgccgctccctacccgcgcaaattaaggagtccagttggcggcgataatctgtacctagcttcaattcttgctattaatcctgacgacgggcgattggtttggcactaccagaccacccccggagacaactgggactttaccgccactcaaaagatgattctggccgacttgaccattgaaggtaaaagccgccaggttctcatgcaggcccctaaaaatggatttttctacgtattagatcgtgtcaccggcgagctgatttctgcggaaccctacgcacaggtcagctgggcaagtcatattgatcttgacacgggacgcccggtagaaacggcgcaggctgaatattttgacgaaccaaagctaatttttccaggcccccaaggtgctcacaactggcagccgatgtcgtatagcccacaaactgggctggtctacatacccgcaaaagaggccggtgctatttggactatgccggaagaggcctttacctaccaagaaggtgggttgaatagccactcgcaatatatttttacgacccctggtgagtggggtttagacagcgcactggccaaaacacttccctctttaaaggtattgggtgcaggacaacccgacaccaccatccgcggatttttaagggcttggaacccggtaacccaaacactcgcttgggaacgcgaaacctcgggaccttggataggcaacatgaacgccttctggaacggtggtggcgtgctcagcactgcgggtaatctcgtttttcaaggacgtggcacgggcgaattagcagctcttgacgcctatacaggtgaaacactgcatcaaatcgcagtcggcgcgagcatgatggctgcaccaatgagttatagcgttgacggcattcagtacgttgcaatattgacaggtgttggtggtggcaatggtaacgactacgttccaggtatggccgcctacacctacggtaatgctggacgcttgatcgcgttcaaattgggcggaggaactgtgccaaaacgaccagaggttgttcacgcaggggccagcactgcacctccggcagtagctcgacgaggctccccacaacaaattatggagggggaatcgctttttcttcgaaactgcgccaagtgccatgccaacatcgatggtcgtggcgctggaatacccgacttacggcgcatgagcgccgatacccatagagcatttagacagatcgttctcgaaggcacactcgtagaacgtggcatgggcaacttctctgacctactcaatgcagatcaggtcgaggccctgcatacttacctgatcgacgaagcctggcagttattttctcgcaatgttccaaccggggagtggcactctggcgagcaagagcttccgtga

SEQ ID NO: 49846 - protein, 750 aa, uncultured bacterium 581
MRRTFKVSLCLLIFAIIGACDTKSEAGNGSSNTNSISNNNVTDQQPSNNPLQSGSWLTGGGDYRQAYFSPLKHINRSNVTELGYAWHIDLPSEHGYEATPLMVDGVLYGSGPQGIAFAVDASNGRSLWQFNPEIDPQFMRKVCCGVVNRGVALSGETVFVAALDGHLFALDKIDGTVVWRADTFMDRKRGYTITGAPYIAGDLVIIGNAGAEFDARGYITAYDRHTGEQRWRFFTVPNSPNPPFEHPELEVAAATWDPDSLWQVGLGGTVWDAMAFDPQLNLLYVGTGNAAPYPRKLRSPVGGDNLYLASILAINPDDGRLVWHYQTTPGDNWDFTATQKMILADLTIEGKSRQVLMQAPKNGFFYVLDRVTGELISAEPYAQVSWASHIDLDTGRPVETAQAEYFDEPKLIFPGPQGAHNWQPMSYSPQTGLVYIPAKEAGAIWTMPEEAFTYQEGGLNSHSQYIFTTPGEWGLDSALAKTLPSLKVLGAGQPDTTIRGFLRAWNPVTQTLAWERETSGPWIGNMNAFWNGGGVLSTAGNLVFQGRGTGELAALDAYTGETLHQIAVGASMMAAPMSYSVDGIQYVAILTGVGGGNGNDYVPGMAAYTYGNAGRLIAFKLGGGTVPKRPEVVHAGASTAPPAVARRGSPQQIMEGESLFLRNCAKCHANIDGRGAGIPDLRRMSADTHRAFRQIVLEGTLVERGMGNFSDLLNADQVEALHTYLIDEAWQLFSRNVPTGEWHSGEQELP

SEQ ID NO: 49847 - DNA, 2391 bp, Enterobacter asburiae
  CDS (1)..(2391)
atggcaattaacaatacaggctcgcgacgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctatacgcagccctgctgctcggcaccatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggagatcaacggcaccttaagcgccgatgccacacctgctgaagctatctcccccgtagccgatcaggactggcctgcctatggtcgtaatcaggaaggtcaacgcttttcgccgctgaaacaaattaacgccgataacgtccataatctgaaagaagcctgggtgttccgtactggcgatgtgaagcagccgaacgatccgggtgaaatcaccaatgaagtgacgccgattaaagtgggcgacaccctttacctgtgtaccgctcaccagcgcctgtttgcgcttgatgccgccagcggcaaagagaaatggcattacgatcctgagctgaaaaccaacgagtctttccagcacgtaacctgccgtggtgtctcttatcatgaagccaaagcagaaaccgcttcgccggaagtgatggcggattgcccgcgtcgtatcattcttccggtcaatgatggtcgactgattgcgattaacgctgaaaacggcaaactgtgcgaaaccttcgccaataaaggcgtgctcaatctgcaaagcaatatgccagacaccaaaccgggtctgtatgaaccgacttcgccaccgattatcaccgataaaaccatcgtgatggccggttcagttaccgataacttctcaacccgcgaaacgtctggcgtgatccgtggttttgatgtcaacaccggggagctgctgtgggccttcgacccgggcgcgaaagatcctaacgcgatcccatcggatgaacacacctttacctttaactcaccgaactcctgggcaccggcagcgtatgacgcgaagctggacctggtctacctgccgatgggcgtgaccacgccggatatctggggcggtaaccgtacgccggagcaggaacgttacgccagctccatcgtggcgctgaacgcaacgaccggtaaactggcatggagctaccagaccgttcaccacgatctgtgggatatggatatgccgtcccagccgacgctggcggacattaccgttaacggtaaaaccgtaccggtgatttacgccccggcgaaaaccggtaacatcttcgtgcttgatcgtagcaacggtaagctggttgttcctgcgccggaaaaaccggttccgcagggtgcggccaaaggcgactacgtcaccaaaacgcagccgttctctgacctgagcttccgtccgaagaaagatctcagcggtgcagacatgtggggtgccaccatgtttgaccagctggtatgccgcgtgatgttccaccagctgcgctacgaagggattttcacccccccgtcagagcagggtacgctggtcttcccgggtgacctggggatgttcgaatggggtgggatctccgttgaccctaaccgtcaggtcgccatcgctaacccaatggcgctgccgttcgtttcccgcctgatccctcgtggtccgggtaacccaatggagcagccgaaagatgcgaaaggcagcggtaccgaagccggtatccagccgcagtatggcgttccttatggtgtgaccctgaatccgttcctttctccgttcggtctgccgtgtaaacagcctgcctggggttacatctccggtctggatctgaagaccaacaagatcgtctggaagaaacgtattggtacgccacaggacagcatgccgttcccgatgcctgttccagtgcctttcaatatgggtatgccaatgctgggtggcccaatctccaccgccggtaacgtgctgttcatcgcggcaaccgcagataactacctgcgcgcgtacaacatgaccaacggtgagaaactgtggcaaggccgtctgccagccggtggacaggcaacgccgatgacctatgaagtgaatggcaagcagtacgttgtcatctctgcgggtggtcacggttcgtttggcacgaagatgggcgactatattgtggcttatgcgctgccggatgatgtgaagtaa

SEQ ID NO: 49848 - protein, 796 aa, Enterobacter asburiae
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSIVALNATTGKLAWSYQTVHHDLWDMDMPSQPTLADITVNGKTVPVIYAPAKTGNIFVLDRSNGKLVVPAPEKPVPQGAAKGDYVTKTQPFSDLSFRPKKDLSGADMWGATMFDQLVCRVMFHQLRYEGIFTPPSEQGTLVFPGDLGMFEWGGISVDPNRQVAIANPMALPFVSRLIPRGPGNPMEQPKDAKGSGTEAGIQPQYGVPYGVTLNPFLSPFGLPCKQPAWGYISGLDLKTNKIVWKKRIGTPQDSMPFPMPVPVPFNMGMPMLGGPISTAGNVLFIAATADNYLRAYNMTNGEKLWQGRLPAGGQATPMTYEVNGKQYVVISAGGHGSFGTKMGDYIVAYALPDDVK

SEQ ID NO: 49849 - DNA, 1767 bp, Rhizobium sp
  CDS (1)..(1767)
atgcaaagattgatgctgactgccgtgacgctcctgtcactggcgggactggcctcggcggaggtgacggaggaggacctcgccaaggatgccactacggtcggcgacgtgctcaccaacggcatgggaagggggctgcagcgttactcgcccctcgaaacgctgaacaagacgaacgtcaagaacctgctgcctgcctggggtttcagcctcggcggcgaaaagcagcgcggacaggaaagccagccgatcgtctatgatggcgtgatgtatatcaccgcctcctacagccggctttacgccatcgatatcaagaccggaaaggagctctggcagttcgacgcccgcttgcccgagggtatcctgccctgttgcgacgtgatcaaccgcggtgccgccatctacggcgacaatatctatttcggcaccctggatgcccgtctcgtcgccctcaaccgcaagacgggcgatgtggtctggaacaagaagatcgccaattacaaggaaggctacagctacacggccgcgcccttgatcgtgaacggcctcatcatcaccggcaattccggtggcgagttcggtatcgtcggcgaggtccaggcccgcgatgccaagaccggcgaactggtatggacccgtccggtcatcgaagggcacgtcgggagttacaagggcaaggatagctcgatgaccgggacgctgaatgcgacctggcccggcgacctttggaagacaggcggcggcgccacctggctcggcggatcttacgacgccgataccgatacgctggtcttcggcaccggcaaccccgctccttggaacagccatctgcgcaacgccggcaagccggtcgagggcaacaagggcgacaacctctacgccgcgagccgcctcggcatcaatccggagaatggcgagatcaagtggcacttccagacgacgccgagggaaggctgggatttcgacggtgtgaatgaagtcgtgcccttcatctccaaggacggcacgaagcgctttgcgaccgccgaccggaacggcttcttctacgttctcaaccgcgaggacggaaagttcgtcgccgcctatcctttcgttaagaacatcacctgggcgaagggtatcgacgagaccggtcggccgatctatgccgaggaaaaccgccccggcgatccgtcttcggcggccgacggcggcaaggggcagcaggtcttttcggttccctccttcctcggcggcaagaactggatgccgatggcctacagccagaagagcgagctcttttacgtgccctcgaacgaatggggtatggatatctggaatgagccgatctcctacaagaagggggccgcctacctcggggccggcttcaccatcaagccgctgttcgaagactatatcggctcgctgaaggcgatcgacccgaacagcggcgagatcaagtgggaatacaagaacgccgcgcccctgtggggcggtgtcatggccactgccggggggctggtcttcgtcggaacgcccgagggcgaattcaaggcgctcgacgacgagaccggcgaagagctctggtccttccagaccggctcgggcgtggtcggccagccgatcacctgggagcaggacggcgagcaatatgtgtcggtgatctccggttggggcggcgcggtccccctttggggcggcgaagtcgccaagaaggtcaactatctcaaccaaggtggcatggtttggaccttccgcttgccgaagcagctggctttggcaaaatag

SEQ ID NO: 49850 - protein, 588 aa, Rhizobium sp
MQRLMLTAVTLLSLAGLASAEVTEEDLAKDATTVGDVLTNGMGRGLQRYSPLETLNKTNVKNLLPAWGFSLGGEKQRGQESQPIVYDGVMYITASYSRLYAIDIKTGKELWQFDARLPEGILPCCDVINRGAAIYGDNIYFGTLDARLVALNRKTGDVVWNKKIANYKEGYSYTAAPLIVNGLIITGNSGGEFGIVGEVQARDAKTGELVWTRPVIEGHVGSYKGKDSSMTGTLNATWPGDLWKTGGGATWLGGSYDADTDTLVFGTGNPAPWNSHLRNAGKPVEGNKGDNLYAASRLGINPENGEIKWHFQTTPREGWDFDGVNEVVPFISKDGTKRFATADRNGFFYVLNREDGKFVAAYPFVKNITWAKGIDETGRPIYAEENRPGDPSSAADGGKGQQVFSVPSFLGGKNWMPMAYSQKSELFYVPSNEWGMDIWNEPISYKKGAAYLGAGFTIKPLFEDYIGSLKAIDPNSGEIKWEYKNAAPLWGGVMATAGGLVFVGTPEGEFKALDDETGEELWSFQTGSGVVGQPITWEQDGEQYVSVISGWGGAVPLWGGEVAKKVNYLNQGGMVWTFRLPKQLALAK

SEQ ID NO: 49851 - DNA, 2073 bp, Pseudomonas putida
  CDS (1)..(2073)
atgaaaaaacctttgcgtacttcattgctgatgctgtgcctggccaccccgctggcagcccttgccgccggggtggacgaggccgccatccgcgccaccgaacaggccggcggcgagtggctcagccacggccgcacctatgccgaacaacgcttcagcccgctcaaacagatcgacgccagcaacgtcaggtcactgggcctggcctggtacatggacctggacaacacccgcggcctggaggcgacaccgctgttccacgacggggtgatctacacctcgatgtcctggagccgggtgatcgcggtcgacgccgccagcggcaaggagctgtggcgctacgaccccgaggtggccaaggtcaaggcccgtacctcgtgctgcgacgcggtcaaccgcggcgtggcactctggggcgacaaggtctacgtcggcaccctggacgggcgtctgatcgccctcgacgccaagaccggcaaggccatctggagccagcagaccaccgacccggccaagccctacagcatcaccggcgcgccacgggtggtcaaaggcaaggtcatcatcggcaacggcggcgccgaatacggcgtgcgcggcttcgtctcggcctatgacgccgacaccggcaaactggcctggcgcttctacaccgtaccgggcgacccggcgctgccctacgagcaccccgaactgcgcgaagcggccaagacctggcagggcgaccagtactggaagctcggcggtggcggcacggtgtgggacagcatggcctacgaccccgagctggacctgctctacgtcggcaccggcaacggctcgccgtggaaccgcgaggtgcgcagcccgggcggtggcgacaacctgtacctgtcgtcgatcctcgccatccgccccgacaccggcaagctggcctggcactaccaggtcaccccgggcgacagctgggacttcaccgccacccagcagatcaccctggccgagctgaacatcgacggcaaaccgcgcaaggtcctgatgcaggcgcctaaaaacggcttcttctacgtgctcgaccgcaccaacggcaagctgatctcggccgagaagttcggcaaggtcacctgggccgagaaggtcgacctcgccaccggccggccggtcgaggcccctggggtgcgctacgaaaaagagcccatcgtgatgtggcccagccccttcggcgcgcacaactggcattcgatgtcgttcaaccccggcaccggcctggtgtacatcccctaccaggaagtgcccggtgtgtaccgcaacgaaggcaaggacttcgttacccgcaaggcattcaacaccgccgccggctttgccgacgccaccgacgtgccggccgccgtggtcagcggcgccttgctggcctgggacccggtcaagcagaaggccgcctggaaggtgccgtaccccacgcactggaacggcggcaccctgagcaccgccggcaacctggtgttccagggcactgcggcggggcagatgcatgcctattccgccgacaagggcgaggcgctgtggcagttcgaggcgcaaagcggcatcgttgccgcgcccatgaccttcgaactggccgggcgtcagtacgtggcgatcatggccggctggggcggcgtggccaccctgaccggcggcgagtcgatgaacctgccgggcatgaagaaccgcagccgcctgctggtgttcgccctcgatggcaaggcgcagttgccgccaccggccccggcgcccgccaaggtcgagcgcgtgccccagcccgtcaccgcagcacccgagcaggtgcaggccggcaagcagctgtatggccagttctgcagcgtgtgccacggcatgggcaccatcagcggcggtttgattcccgacctgcgccagtccagcgacgccacccgcgagcacttccagcagatcgtcctgcagggcgcgctcaagccactgggcatgccgtcgttcgacgactcgctcaagcccgaggaggtcgagcagatcaagctctacgtgatgtcgcgcgagtacgaggactacatggcgcggcacaaagccgcaccctga

SEQ ID NO: 49852 - protein, 690 aa, Pseudomonas putida
MKKPLRTSLLMLCLATPLAALAAGVDEAAIRATEQAGGEWLSHGRTYAEQRFSPLKQIDASNVRSLGLAWYMDLDNTRGLEATPLFHDGVIYTSMSWSRVIAVDAASGKELWRYDPEVAKVKARTSCCDAVNRGVALWGDKVYVGTLDGRLIALDAKTGKAIWSQQTTDPAKPYSITGAPRVVKGKVIIGNGGAEYGVRGFVSAYDADTGKLAWRFYTVPGDPALPYEHPELREAAKTWQGDQYWKLGGGGTVWDSMAYDPELDLLYVGTGNGSPWNREVRSPGGGDNLYLSSILAIRPDTGKLAWHYQVTPGDSWDFTATQQITLAELNIDGKPRKVLMQAPKNGFFYVLDRTNGKLISAEKFGKVTWAEKVDLATGRPVEAPGVRYEKEPIVMWPSPFGAHNWHSMSFNPGTGLVYIPYQEVPGVYRNEGKDFVTRKAFNTAAGFADATDVPAAVVSGALLAWDPVKQKAAWKVPYPTHWNGGTLSTAGNLVFQGTAAGQMHAYSADKGEALWQFEAQSGIVAAPMTFELAGRQYVAIMAGWGGVATLTGGESMNLPGMKNRSRLLVFALDGKAQLPPPAPAPAKVERVPQPVTAAPEQVQAGKQLYGQFCSVCHGMGTISGGLIPDLRQSSDATREHFQQIVLQGALKPLGMPSFDDSLKPEEVEQIKLYVMSREYEDYMARHKAAP

SEQ ID NO: 49853 - DNA, 2223 bp, Gluconobacter oxydans
  CDS (1)..(2223)
atgcgccggccttaccttctagcaacagccgcaggactcgcccttgcctgttcgccgctcatcgctcatgcacagtttgctcccgcaggggctggcggcgaaccttcctcgtcagttcctgggccaggaaatgcgagcgagcccaccgaaaactctccgaaaagtcagagctacttcgcaggaccgtcgccctatgccccgcaggctcctggcgtaaacgcagccaacctgccggacattgagtcaatcgatccctcgcaggtcccggccatggctccgcagcagagtgccaatccggcacgtggagactgggttgcttacggacgtgacgatcatcagacgcgatactctccgctttcggaaatcacgcctgagaacgcaagcaagctcaaggtcgctttcgtctaccacacggggagttatccgcgtccgggacaggtgaacaaatgggccgccgaaaccacgccgatcaaggttggtgacggtctctacacatgttccgccatgaacgacatcatcaagctggatccggctacgggtaagcagatctggcgtcggaacgtggatgtcaaataccactccattccctataccgctgcctgtaagggtgtgacgtatttcacgtcctccgtggtgccggaaggccagccctgccacaatcgccttatcgaaggcacgctggatatgcgtctgattgcggttgacgcggagacaggggatttctgccctaatttcggtcatggtggtcaggtcaacctgatgcagggtctgggtgagtctgttccgggcttcgtctccatgacggcacctccaccggtcatcaacggcgtcgtggttgtaaaccacgaagtgctcgacggtcagcgccgctgggctccgtccggtgtgatccgtggttacgatgctgaaagtggcaaattcgtatgggcctgggacgtcaacaattccggacgatcacagccagcctaccgggtaaccgtcattacagccgtggaacgccgaattcctgggctacctgacaggcgacaacgaggagggtctcgtttacgtcccgacaggaactctgctgctgactattacagcgccctgcgtagtgatgctgaaaacaaggtgtcctccgctgttgtcgccattgacgtcaagacgggttctccgcgctgggtcttccagacggctcataaggacgtctgggattatgacatcggttcacaggcgaccctgatggatatgcctggcccggatggccagacggttcctgctctcatcatgccgaccaagcgtggccagacgttcgtgcttgaccgtcgtaccggcaagccaattctgccggttgaagaacgcccagctccgtcccctggtgttattccgggtgacccgcgttctccgacgcagccatggtccgtcgggatgccggcccttcgcgtgccggatctgaaagagacagacatgtggggtatgtcccccatcgatcagctcttctgccgtatcaagttccgccgtgcgaactatgtgggtgagttcacaccaccgagcgttgacaagccgtggattgaatatccgggctataacggtggcagtgactggggctccatgtcctatgatccgcagtccggcatcctgattgcgaactggaacatcacaccgatgtacgaccagctcgtaacccgcaagaaggcagactccctcggcctgatgccgatcgatgaccccaacttcaagccaggtggcggtggtgccgaaggtaacggcgccatggacggaacgccttacggtatcgtcgtgacaccgttctgggatcagtacacgggcatgatgtgcaaccgtccgccctacggtatgatcacagccatcgacatgaagcacggccagaaggttctgtggcagcatccgctcggaacggctcgcgccaacggtccatggggtctgccaacaggtctgccatgggaaatcggcactccgaacaatggtggttcggttgtgaccggtggcggtctgatcttcatcggtgcggcaacggataaccagatccgcgcgattgatgaacacactggcaaggttgtctggagcgcagtcctccccggcggcggtcaggccaatccgatgacgtatgaagccaatggtcaccagtacgttgccatcatggctggcggtcatcacttcatgatgacgccagtgtctgaccagcttgtggtttacgcactgccggatgccatcaagcagtaa

SEQ ID NO: 49854 - protein, 740 aa, Gluconobacter oxydans
MRRPYLLATAAGLALACSPLIAHAQFAPAGAGGEPSSSVPGPGNASEPTENSPKSQSYFAGPSPYAPQAPGVNAANLPDIESIDPSQVPAMAPQQSANPARGDWVAYGRDDHQTRYSPLSEITPENASKLKVAFVYHTGSYPRPGQVNKWAAETTPIKVGDGLYTCSAMNDIIKLDPATGKQIWRRNVDVKYHSIPYTAACKGVTYFTSSVVPEGQPCHNRLIEGTLDMRLIAVDAETGDFCPNFGHGGQVNLMQGLGESVPGFVSMTAPPPVINGVVVVNHEVLDGQRRWAPSGVIRGYDAESGKFVWAWDVNNSGRSQPAYRVTVITAVERRIPGLPDRRQRGGSRLRPDRNSAADYYSALRSDAENKVSSAVVAIDVKTGSPRWVFQTAHKDVWDYDIGSQATLMDMPGPDGQTVPALIMPTKRGQTFVLDRRTGKPILPVEERPAPSPGVIPGDPRSPTQPWSVGMPALRVPDLKETDMWGMSPIDQLFCRIKFRRANYVGEFTPPSVDKPWIEYPGYNGGSDWGSMSYDPQSGILIANWNITPMYDQLVTRKKADSLGLMPIDDPNFKPGGGGAEGNGAMDGTPYGIVVTPFWDQYTGMMCNRPPYGMITAIDMKHGQKVLWQHPLGTARANGPWGLPTGLPWEIGTPNNGGSVVTGGGLIFIGAATDNQIRAIDEHTGKVVWSAVLPGGGQANPMTYEANGHQYVAIMAGGHHFMMTPVSDQLVVYALPDAIKQ

SEQ ID NO: 49855 - DNA, 2229 bp, Acetobacter pasteurianus
  CDS (1)..(2229)
atgacccgccccgcctccgccaagagacgttcactgctaggaattctcgcggccggaacaatctgtgccgctgctttgccttacgcggcagtccctgcccgcgctgacggtcagggtaatacgggggaagctatcatccatgcagatgatcaccccgaaaactggctttcttatggtcgcacttacagcgaacagcgctatagccccctagatcagatcaaccgctccaacgtgggtgatcttaaactggcttggtactatacgctggataccaaccgcggtcaggaagcaactccgctggttgttgatggcattatgtatgccacaaccaactggtccaaaatggaagcgctggacgctgccacagggaagctgctttggcagtatgaccccaaagtgccagacaacattgctgacaaaggctgctgtgatacggttaaccgtggtgcaggctattggaacggcaaggttttctggggcacgtttgatggccgtctggtcgctgccgatgcaaaaaccggtaaaaaagtgtgggaagttaataccatcccagccgatgcctctctgggcaagcagcgctcctacacagtggatggcgcggtacgcgtagcgaagggcctggtgctgattggtaacggtggtgccgagttcggcgcacggggttttgtttccgcttttggtgccgaaaccggcaagctgaaatggcgcttctacaccgttccgaacaacaagaacgaaaccgatcacgctgcatcagataatattctgatgaaaaaagcctacaaaacctggggccccaaaggcgcttgggaacgccaaggtggcggtggcaccgtatgggattttctggtttatgatccggtcagtgacctgatctatctggctgttggtaacgggtttccctggaactataagtatcgttccgaaggcattggttccaacctgttcctgggcagcattgtcgcactgaagcctgaaaccggtgaatatgtctggcacttccaggcgaccccgatggatcagtgggattacacctcggttcagcagatcatgacccttgatatgccagtgaatggcgaaatgcgccacgtgatcgtgcatgcacctaaaaacggcttcttctacgttctggatgccaaaaccggtgaattcctgtccggcaaaaactacgtttaccagaactgggccaatggcctggaccctctgacaggtcgcccgatctacaatccggatggtctgtataccctgaacggcaagttctggtacggtatccccggcccactgggtgcgcataactttatggccatggcctatagccccaaaacgcacctggtctatatcccggctcaccaaattccgtttggttataaaaaccaggttggtggctttaagccgcatgcggattcctggaacgtgggtctggacatgaccaagaacggtctgcctgataccccagaagcccgtaccgcttacatcaaggatctgcacgggtggctgctggcatgggatccggtcaagatggaaacggtctggaagattgaccacaaaggtccgtggaacggcggcattctggccaccggtggtgatcttctgttccagggcttggccaatggtgaattccacgcctatgacgccacgaacggtagcgacctttacaagtttgacgcacagagcggcattatcgctccgcctatgacctatagcgtcaacggcaagcagtatgttgccgtcgaagtgggctggggcggcatctacccaatttccatgggtggtgtaggccgtacttctggctggacagttaaccactcctacattgctgcgttctctctggatggcaaagccaagctgccggctctgaacaaccgcggcttcctgcccgtaaaaccacctgcacagtatgaccagaaggtcgttgataacggttacttccagtatcagacctactgccagacctgccatggtgataacggcgaaggtgcgggcatgctgcctgatctgcgttgggccggtgctatccgccaccaggatgccttctacaatgtagttggtcgcggtgcgctgacggcttacgggatggatcgctttgacaccagcatgacgccggatgaaattgaagctatccgtcagtatctgatcaaacgggcaaacgacacgtatcagcgtgaagtggatgctcggaagaatgacaagaatatccccgaaaacccgacacttggcattaacccctaa

SEQ ID NO: 49856 - protein, 742 aa, Acetobacter pasteurianus
MTRPASAKRRSLLGILAAGTICAAALPYAAVPARADGQGNTGEAIIHADDHPENWLSYGRTYSEQRYSPLDQINRSNVGDLKLAWYYTLDTNRGQEATPLVVDGIMYATTNWSKMEALDAATGKLLWQYDPKVPDNIADKGCCDTVNRGAGYWNGKVFWGTFDGRLVAADAKTGKKVWEVNTIPADASLGKQRSYTVDGAVRVAKGLVLIGNGGAEFGARGFVSAFGAETGKLKWRFYTVPNNKNETDHAASDNILMKKAYKTWGPKGAWERQGGGGTVWDFLVYDPVSDLIYLAVGNGFPWNYKYRSEGIGSNLFLGSIVALKPETGEYVWHFQATPMDQWDYTSVQQIMTLDMPVNGEMRHVIVHAPKNGFFYVLDAKTGEFLSGKNYVYQNWANGLDPLTGRPIYNPDGLYTLNGKFWYGIPGPLGAHNFMAMAYSPKTHLVYIPAHQIPFGYKNQVGGFKPHADSWNVGLDMTKNGLPDTPEARTAYIKDLHGWLLAWDPVKMETVWKIDHKGPWNGGILATGGDLLFQGLANGEFHAYDATNGSDLYKFDAQSGIIAPPMTYSVNGKQYVAVEVGWGGIYPISMGGVGRTSGWTVNHSYIAAFSLDGKAKLPALNNRGFLPVKPPAQYDQKVVDNGYFQYQTYCQTCHGDNGEGAGMLPDLRWAGAIRHQDAFYNVVGRGALTAYGMDRFDTSMTPDEIEAIRQYLIKRANDTYQREVDARKNDKNIPENPTLGINP

SEQ ID NO: 49857 - DNA, 1800 bp, Methylobacillus sp
  CDS (1)..(1800)
atgaaaggcagagtaacccacgtcggtatcagcgctgctgtcagcagtctgctggtgcttgcgacgatgcaaggtgctcaggcaaaccaagatctgcaaaatctgacaaagaacgcagacaactgggctttgcaaaccggtaactacactggtcagcacaatagcacactgagccaaatcaataaaggcaacgtcaagaacctgaaggcagcttggtctttctccaccggcgtgttgcacggtcatgaaggcgcgccattggtgattggcgacatgatgtacatccacagtgcgttccctaacaacacattcgctgttaacttgaatgaccctggcgtgattgcctggcagcacaagccaaagcaaatcgcttccgttaaggctgttgcatgttgcgacatcgttaaccgcggtttggcttacggcgacggcaagatcgtcaagactcagctggacggcaagctggttgccctcgatgccaagtccggtaaggtcgtgtgggaaatcgaagtatgtgatcctaaggttggtgcaacactgacccaagctccattcattgtaaagaatactgttctggttggctgctccggtgctgagctgggtgttcgtggtgctgttaactccttcaacctgaagaccggcgaactgcaatggcgtgcctttgcaactggtcctgacgaagaagtgcgcttggccaagaacttcaacagcgacaatccacactacggtcaattcggcctgggtctgaaaacctgggaaggtgatgcatggaagatcggtggcggcaccaactggggctggtacgcttacgatcctaagctgaacctgttctactacggttccggtaacccagcgccatggaacgaaaccatgcgtcctggcgacaacaagtggaccatgactatctgggcgcgtgacctggacacaggcgaagccaagtggggttaccaaaagactcctcacgacgagtgggacttcgctggcgtgaaccaaatgatcctttccgatcacaaggttgatggcaaggtaactcctctgctgacccacatcgaccgtaacggcatcatgtacacgctgaaccgtgacaacggtaacctggtccaggctgccaaggttgatccagccgtaaacgtgttcaagaaagttgacctcaagacaggtacgccagtacgtgaccctgagttcagcacacgcatggaccacaagagcaccaacgtatgtccttccgccatgggtttccacaaccaaggtctggatgcattggatcttgacgagcctatcgtttacgcaggcctgaaccacatttgtatggattgggagcccttcatgctgccctaccgtgccggtcagttcttcgtaggtgcaaccctggcgatgtaccctggacctagcggcccaaccaagaaggaaatgggtcaagtacgcgccatggacatcgtgacaggcaagtacaagtggaccaagtgggagaagttcgctgtttggggcggtactctcgctaccaagggcggcctggttgcctacaacacgcttgatggctacatcaaggccctggacaaggacaacggcaaggaactgtggaagttcaagatgccatccggtggtatcggtgctcctatgacctaccagttcaagggtaagcaatacatcggctccatgtacggtgtaggtggttggcctggcgttggtctggtattcgacctgaccgatcctagcgctggtctgggtgctgtaggtgccttcaaggagctgcagaaccacactcaaatgggcggtggcctgatggtgttcagcctgtaa

SEQ ID NO: 49858 - protein, 599 aa, Methylobacillus sp
MKGRVTHVGISAAVSSLLVLATMQGAQANQDLQNLTKNADNWALQTGNYTGQHNSTLSQINKGNVKNLKAAWSFSTGVLHGHEGAPLVIGDMMYIHSAFPNNTFAVNLNDPGVIAWQHKPKQIASVKAVACCDIVNRGLAYGDGKIVKTQLDGKLVALDAKSGKVVWEIEVCDPKVGATLTQAPFIVKNTVLVGCSGAELGVRGAVNSFNLKTGELQWRAFATGPDEEVRLAKNFNSDNPHYGQFGLGLKTWEGDAWKIGGGTNWGWYAYDPKLNLFYYGSGNPAPWNETMRPGDNKWTMTIWARDLDTGEAKWGYQKTPHDEWDFAGVNQMILSDHKVDGKVTPLLTHIDRNGIMYTLNRDNGNLVQAAKVDPAVNVFKKVDLKTGTPVRDPEFSTRMDHKSTNVCPSAMGFHNQGLDALDLDEPIVYAGLNHICMDWEPFMLPYRAGQFFVGATLAMYPGPSGPTKKEMGQVRAMDIVTGKYKWTKWEKFAVWGGTLATKGGLVAYNTLDGYIKALDKDNGKELWKFKMPSGGIGAPMTYQFKGKQYIGSMYGVGGWPGVGLVFDLTDPSAGLGAVGAFKELQNHTQMGGGLMVFSL

SEQ ID NO: 49859 - DNA, 2253 bp, uncultured proteobacterium
  CDS (1)..(2253)
ttgagaagcgctttcaaggtctctttatgcctgcttatttttgcaattattggcgcctgcgacaccaaatctgaagctggaaatgggtcaagtaacactaactcgatctcaaataataacgtcactgatcagcaacccaacgacaacccacttcagtcggggagttggctaaccggcggcggcgattatcggcaagcctacttttccccgcttaagcatattaatcgtagcaatgtcactgagcttggctacgcatggcacatcgatctcccctctgaacatggctatgaagccactccattaatggtcgatggcgtactctacggcagcggcccccaaggcatagcctttgccgtggacgcctcaaacgggcgctctctgtggcagtttaaccctgaaatagacacgcaattcatgcgtaaagtttgttgcggtgtggttaatcgaggcgttgcactatctggggaaacggtattcgtcgccgccctcgatggccacctttttgccctcgataaaattgacggcacggtggtgtggcgtgctgatacatttatggatcgcaagcggggttataccattaccggcgcaccctacattgcgggcgatctggtgattattggtaatgccggcgccgaattcgacgcgcggggctatatcaccgcctacgataggcatacaggcgagcaacgctggcgattttttaccgttccaaatagtcccaacccaccctttgaacacccagagctggaagtcgcagccgccacttgggacccggacagtttgtggcaggtcggattggggggcacggtttgggatgctatggcctttgacccacagcacaatttactttacgtgggcactggaaacgccgctccctacccgcgcaaattaaggagtccagttggcggcgataatctgtacctagcttcaattcttgctattaatcctgacgacgggcgattggtttggcactaccaaaccacccccggagacaactgggactttaccgccactcaaaagatgattctggccgacttgaccattgaaggtaaaagccgccaggttctcatgcaggcccctaaaaatggatttttctacgtattagatcgtgtcaccggcgagctgatttctgcggaaccctacgcacaggtcagctgggcaagtcatattgatcttgacacgggacgcccgctagaaacggcgcaggctgaatattttgacgaaccaaagctaatttttccaggcccccaaggtgctcacaactggcagccgatgtcgtatagcccacaaactgggctggtctacatacccgcaaaagaggccggtgctatttggactatgccggaagaggcctttacctaccaagaaggtgggttgaatagccactcgcaatatatttttacgacccctggtgagtggggtttagacagcgcactggccaaaacacttccccctttaaaggtattgggtgcaggacaacccgacaccaccatccgcggatttttaagggcttggaacccggtaacccaaacactcgcttgggaacgcgaaacctcgggaccttggataggcaacatgaacgccttctggaacggtggtggcgtgctcagcactgcgggtaatctcgtttttcaaggacgtggcacgggcgaattagcagctcttgacgcctatacaggtgaaacactgcatcaaatcgaagtcggcgcgagcatgatggctgcaccaatgagttatagcgttgacggcattcagtacgttgcaatattgacaggtgttggtggtggcaatggtaacgactacgttccaggtatggccgcctacacctacggtaatgctggacgcttgatcgcgttcaaattgggcggaggaactgtgccaaaacgaccagaggttgttcacgcaggggccagcactgcacctccggcagtagctcgacgaggcaccccacagcaaattatggagggggaatcgctttttcttcgaaactgcgccaagtgccatgccaacatcgatggtcgtggcgctggaatacccgacttacggcgcatgagcgccgatacccatagagcatttagccagatcgttctcgaaggcacactcgtagaacgtggcatgggcaacttctctgacctactcaatgcagatcaggtcgagtccttgcatacttacctgatcgacgaagcgtggcagttattttctcgcaatgttccagccggggagtggcactctgccgagcaagaacttccgtga

SEQ ID NO: 49860 - protein, 750 aa, uncultured proteobacterium
MRSAFKVSLCLLIFAIIGACDTKSEAGNGSSNTNSISNNNVTDQQPNDNPLQSGSWLTGGGDYRQAYFSPLKHINRSNVTELGYAWHIDLPSEHGYEATPLMVDGVLYGSGPQGIAFAVDASNGRSLWQFNPEIDTQFMRKVCCGVVNRGVALSGETVFVAALDGHLFALDKIDGTVVWRADTFMDRKRGYTITGAPYIAGDLVIIGNAGAEFDARGYITAYDRHTGEQRWRFFTVPNSPNPPFEHPELEVAAATWDPDSLWQVGLGGTVWDAMAFDPQHNLLYVGTGNAAPYPRKLRSPVGGDNLYLASILAINPDDGRLVWHYQTTPGDNWDFTATQKMILADLTIEGKSRQVLMQAPKNGFFYVLDRVTGELISAEPYAQVSWASHIDLDTGRPLETAQAEYFDEPKLIFPGPQGAHNWQPMSYSPQTGLVYIPAKEAGAIWTMPEEAFTYQEGGLNSHSQYIFTTPGEWGLDSALAKTLPPLKVLGAGQPDTTIRGFLRAWNPVTQTLAWERETSGPWIGNMNAFWNGGGVLSTAGNLVFQGRGTGELAALDAYTGETLHQIEVGASMMAAPMSYSVDGIQYVAILTGVGGGNGNDYVPGMAAYTYGNAGRLIAFKLGGGTVPKRPEVVHAGASTAPPAVARRGTPQQIMEGESLFLRNCAKCHANIDGRGAGIPDLRRMSADTHRAFSQIVLEGTLVERGMGNFSDLLNADQVESLHTYLIDEAWQLFSRNVPAGEWHSAEQELP

SEQ ID NO: 49861 - DNA, 1896 bp, Pseudomonas putida
  CDS (1)..(1896): y means t/u or c
atgacaataagatcgctacccgccctttcccctctggccctgagcgtgcgcgtcctgctactggccggtggcctggccctgggcaatgtggcaacagcggccactgcacctgctgcacctgccggcaagagcgtcacctgggaagacatcgccaacgaccacctgaccaccaaggacgtgctgcagtacggcatgggcaccaatgcccagcgctggagcccgctggcccaggtcaatgaccagaacgtgttcaagctgactccggcctggtcgtactccttcggcgacgagaagcagcgcggccaggaatcccagctatcgtcaagcgacggcgtggtctacgtcaccggctcgtactcgcgggtgtttgccctcgatgccaagaccggcaaacgcctgtggacctacaaccaccgcctgcccgacaacattcgcccgtgctgcgacgtggtcaaccgcggggcggccatcttcggcgacaagatctacttcggcaccctggacgcgcggctcatcgccctcgacaagcacactggcaaagtcgtgtggaacaagaagttcggcgaccacagcgccggctacaccatgaccggcgccccggtgctgatcaaagacaagaccagcggcaaggtgctgctgatccatggcagctcgggcgatgaattcggcgtggtcggccagttgttcgcgcgcgacccggacaccggtgaagaagtgtggatgcggcccttcgtcgagggccacatgggccgcctgaacggcaaggacagcacccccaccggcgacgtcaaggcgccatcctggccagacgacccaaccaccgaaaccggcaaggtcgaagcctggagccacggcggcggcgccccttggcaaagcgcgagcttcgaccccgaaaccaacaccatcattgtcggcgctggcaaccctggcccctggaatacctgggcgcgcacgtcgaaggacggcaacccgcatgacttcgacagcctgtacacctccggccaggtcggcgtcgacccgagcaccggcgaggtcaagtggttctaccagcacacccccaacgatgcctgggacttctccggcaacaacgagctggtgctgttcgactacaaggacaagaacggcaacgtggtcaaggccaccgcccacgccgaccgcaacggcttcttctatgtggtcgaccgcaacaacggcaagctgcagaacgccttccccttcgtcgacaacatcacctgggccagccatatcgacctgaagaccgggcgcccggtagaaaacycaggccaacgcccggccaagccgctgccgggtgaaaccaagggcaagccggtggaagtctcgccaccgttcctgggtggcaagaactggaacccgatggcctacagccaggacaccgggctgttctacatccccggcaaccagtggaaagaggaatactggaccgaggaggtgaactacaagaagggctcggcttatctgggcatgggcttccgtatcaagcgcatgtacgacgaccacgtcggcacgttgcgcgccatggacccgaccaccggcaagctggtgtgggagcacaaggagcacctgccgctgtgggcgggcgtactggcaaccaagggcaacctggtgttcaccggcactggcgacggcttcttcaaggccttcgacgccaagacgggcaaagagctgtggaagttccagaccggcagcggcatcgtctcgccgcctatcacctgggagcaggacggcgagcagtacatcggcgtgaccgtgggctacggcggcgccgtgccgctgtggggcggcgacatggccgagctgaccaaaccggtggctcagggtggttcgttctgggtgttcaagatcccgagctgggacaacaagactgcgcagcgctga

SEQ ID NO: 49862 - protein, 631 aa, Pseudomonas putida
  misc_feature (427)..(427): Xaa can be Ser or Pro
MTIRSLPALSPLALSVRVLLLAGGLALGNVATAATAPAAPAGKSVTWEDIANDHLTTKDVLQYGMGTNAQRWSPLAQVNDQNVFKLTPAWSYSFGDEKQRGQESQLSSSDGVVYVTGSYSRVFALDAKTGKRLWTYNHRLPDNIRPCCDVVNRGAAIFGDKIYFGTLDARLIALDKHTGKVVWNKKFGDHSAGYTMTGAPVLIKDKTSGKVLLIHGSSGDEFGVVGQLFARDPDTGEEVWMRPFVEGHMGRLNGKDSTPTGDVKAPSWPDDPTTETGKVEAWSHGGGAPWQSASFDPETNTIIVGAGNPGPWNTWARTSKDGNPHDFDSLYTSGQVGVDPSTGEVKWFYQHTPNDAWDFSGNNELVLFDYKDKNGNVVKATAHADRNGFFYVVDRNNGKLQNAFPFVDNITWASHIDLKTGRPVENXGQRPAKPLPGETKGKPVEVSPPFLGGKNWNPMAYSQDTGLFYIPGNQWKEEYWTEEVNYKKGSAYLGMGFRIKRMYDDHVGTLRAMDPTTGKLVWEHKEHLPLWAGVLATKGNLVFTGTGDGFFKAFDAKTGKELWKFQTGSGIVSPPITWEQDGEQYIGVTVGYGGAVPLWGGDMAELTKPVAQGGSFWVFKIPSWDNKTAQR

SEQ ID NO: 49863 - DNA, 2088 bp, Pseudomonas sp
  CDS (1)..(2088)
atgtcggctaataagaatatatggatcataaggcttggcgtggcatttgtttgtgtcgctatcggagctgcccaggcaaatgaaaaagacggctctgcggtgaccagcggtaattggagcctgctaggaggcggaaatgagcagcactattttagtgcgctaaaggatgtgaataagtcaaacgtcaaaaacctcggtctaagctggtttacggatatggaggccggtgatggattggtaggaaacccgttagttgctgatggagtgatttatcaaggtgggcccccaggaaagatttacgctaacgacctaaagaccggtaaaaatctttggacctataccccagaagtgcagtacgacaaagacacatcttggactggcttttgggggacgcatgttaaccgggggctagccgtagacgacgataatgtctatatcggctcctactgtaagcttctcgctgtgagcaggacaactcacaaactgacctggtcgtcccaatcgtgcgatccaaaaaaaatgcaggcgattaccggcgcgcctagggtcggcggtggcaaggtcttcataggtaacgcctcgggtgatttcggcggcgatcgtggacatctagatgcgttcgacgccaaaacgggtaaacatctgtggcgcttctacactatgccaggcgatccgtccaagccttttgaaaacgatctcttggctaaggcttcaaaaacatggggtaccgattactggaaatataccaaaggtggtgtcagcccctgggacgccataacttacgatgaagcaagcgacactctctattttggcactgatgggccatcgccctggtcaccagctcaacgggcccccgatgcgggagatgagttgttttcgcactcgatcattgcggtagatgcaagcacgggagcttacaagtggcattttcagaccgtgcaaaatgacgggagcaatatgagtgccactatgcacatcatgcttgctgatttgcccgttgaaggagtttcaaagcgtgtggtcatgaccgccccgaaaaatggttatttctatgtgcttgacgcgagtactggtaaatttatcagtgcggatcattatgttcctgtaaattggacgaagggtttagatcccaaaacggggcgtccgatcccttcaaacgaagcgaattattgggagcgtcctggtgagatgaccattcctcttcctggtgatgtgggtggacataactgggaggcgatggcttataatcctgaattgcgtacggtttatattccttctaccttagttcctgttaccgtggtggctagcaaggatactggcgaattagatttagattattactatgggatgcggccagacgcgaccatcaagacgcaaggtgaccttgttgcgtgggatccattgctgcagaaagaaaagtggcgcgctaaacgaagtttgccagtaaacgggggagttcttgccactgctggaggattggtatttcagggaactggtgacggccactttgaggcgtttgatgctaatactggcgaaaagctttggtcgttccatgtcggtggttccatcttggctgcgccgacgactgtcgaagtagatggtgatcaatatctcatcgtagcgagcggcaacggtggcgcatccggtatgcgaggtatacctcgcctcatgaacaatttgcaaagtcaaggtcctgctcgcttgttggcgtttcgattaggaggaaagacggagttgcctatcacttcaacgccagattttcctaaaccacagtatccgaagcccacgagcgccatggctgagagtggacgacatatatttaatgccaacgcgtgtggtgcttgccacggtttcaatgcggagggctccacgccaggattacctgatctgcgtcgttcggacaaattagacctagcagtaatgaaatctattgtcattgatggtgcgtttaagcctcttgggatgccggggcatcctcacatctcggatgcggatttgcaggcgctacaggcgttcattctgcagaaagcgtggaccgcttatgatactcaacaaaccctaaagactagcgatacgggcgcgcaatag

SEQ ID NO: 49864 - protein, 695 aa, Pseudomonas sp
MSANKNIWIIRLGVAFVCVAIGAAQANEKDGSAVTSGNWSLLGGGNEQHYFSALKDVNKSNVKNLGLSWFTDMEAGDGLVGNPLVADGVIYQGGPPGKIYANDLKTGKNLWTYTPEVQYDKDTSWTGFWGTHVNRGLAVDDDNVYIGSYCKLLAVSRTTHKLTWSSQSCDPKKMQAITGAPRVGGGKVFIGNASGDFGGDRGHLDAFDAKTGKHLWRFYTMPGDPSKPFENDLLAKASKTWGTDYWKYTKGGVSPWDAITYDEASDTLYFGTDGPSPWSPAQRAPDAGDELFSHSIIAVDASTGAYKWHFQTVQNDGSNMSATMHIMLADLPVEGVSKRVVMTAPKNGYFYVLDASTGKFISADHYVPVNWTKGLDPKTGRPIPSNEANYWERPGEMTIPLPGDVGGHNWEAMAYNPELRTVYIPSTLVPVTVVASKDTGELDLDYYYGMRPDATIKTQGDLVAWDPLLQKEKWRAKRSLPVNGGVLATAGGLVFQGTGDGHFEAFDANTGEKLWSFHVGGSILAAPTTVEVDGDQYLIVASGNGGASGMRGIPRLMNNLQSQGPARLLAFRLGGKTELPITSTPDFPKPQYPKPTSAMAESGRHIFNANACGACHGFNAEGSTPGLPDLRRSDKLDLAVMKSIVIDGAFKPLGMPGHPHISDADLQALQAFILQKAWTAYDTQQTLKTSDTGAQ

SEQ ID NO: 49865 - DNA, 1872 bp, Pseudomonas butanovora
  CDS (1)..(1872)
atgaaaaagtcgcatgcaaagcccttcgcgctgcgcgccatcgtcgtcgccaccgcagcggcgttgtcgctgccggccgccgcagtcaccgacgtcacctgggaggacatcgccaacgaccacaagaccaccggcgacgtgctgacctacggcctgggcctgaaggcgcagcgccacagcccgctcaaggcgatcaacaccgacaacgtcgccaacctggtgccggcctggagcttctccttcggcggtgaaaaacagcgcggccaggaagcacaggttctggtgcacgatggcgtgatctacgccaccgcctcctactcccgcatcttcgccatcgacgcccgcagcggcaagcgcctgtgggaatacaacgcccgcctgccggacgacatccgcccctgctgcgacgtggtcaaccgcggcgccgccatctacggcgacaaggtcttcttcggcactctggatgcggccatggtcgcgctcgaccgcaagaccggcaaggtcgtgtggcggaagaagttcggcgaccacaaggtgggctacaccatgaccggcgcccccttcgtcatcaaggaccagaagtccggccgcacgctgctggtgcacggctcatccggcgacgaattcggcgtggtcggctggctgttcgcgcgcgacccggacaccggtgaggaagtctgggcccgtccgatggtcgaaggccacatgggccgcctgaacggcaaggacagcacccccaccggcgaccccaaggcaccgagctggccggacgatcccaactcgcccaccggcaaggtcgaagcctggagccagggcggcggcgcaccatggcagaccgccagcttcgacgtcgaaaacaacatggtcgtcatcggcgccggcaaccccgcaccgtggaacacctggaagcgcaccgcgccgggcgacgacccgcgcaactgggacagcctgttcacctccggccaggcctatgtcgacgccagcaccggcgagctgaagggcttctaccagcacaccccgaacgacgcctgggacttttccggcaacaactccgtcgtgctgttcgagtacaaggacccgaagaccggcaagatggtcaatgcctcggcccacgccgaccgcaacggcttctttttcgtcaccgaccgcgacatgctggccaagggcgccggctatcccaacaagccgacctcgctgatcggcgcctggcccttcgtggacggcatcacctgggcgtcgggcttcgacctcaagaccggcaaaccgatcgagaaggacaaccgtccgccgcagccgaaggaaggcgcggacaagggtgagtcgatcttcgtctcgccgcccttcctcggcggcaccaactggcacccgatgtcgtacagcccggacaccggcctgttctacatcccggccaaccactgggcgatggactactggaccgagaacgtcacctacaaggccggctccgcctatctgggccagggcttccgcatcaagaacttgttcgacgaccacgtcggcatcctgcgcgcgatcgacccgtcaccggcaagatcgctgggagcacaaggaagagttcccgctgtggccggcaccttgaccaccgccggcggctgggtcttyaccggcacttcggacggctacytgaaggccttcgacgccaagaacggcaaggaactgtggaagttccagaccggctcgggcgtggtctcggtaccggtgacctgggaaatggacggcgagcagtacgtcgccatccagtcgggctacggcggcgcggtaccgctgtggggcggcgacatggccgagctgaccaagcaggtcacccagggcggttcgatgtgggtgttcaagctgccgaaagccagccgctga

SEQ ID NO: 49866 - protein, 623 aa, Pseudomonas butanovora
MKKSHAKPFALRAIVVATAAALSLPAAAVTDVTWEDIANDHKTTGDVLTYGLGLKAQRHSPLKAINTDNVANLVPAWSFSFGGEKQRGQEAQVLVHDGVIYATASYSRIFAIDARSGKRLWEYNARLPDDIRPCCDVVNRGAAIYGDKVFFGTLDAAMVALDRKTGKVVWRKKFGDHKVGYTMTGAPFVIKDQKSGRTLLVHGSSGDEFGVVGWLFARDPDTGEEVWARPMVEGHMGRLNGKDSTPTGDPKAPSWPDDPNSPTGKVEAWSQGGGAPWQTASFDVENNMVVIGAGNPAPWNTWKRTAPGDDPRNWDSLFTSGQAYVDASTGELKGFYQHTPNDAWDFSGNNSVVLFEYKDPKTGKMVNASAHADRNGFFFVTDRDMLAKGAGYPNKPTSLIGAWPFVDGITWASGFDLKTGKPIEKDNRPPQPKEGADKGESIFVSPPFLGGTNWHPMSYSPDTGLFYIPANHWAMDYWTENVTYKAGSAYLGQGFRIKNLFDDHVGILRAIDPSPARSLGAQGRVPAVAGTLTTAGGWVFTGTSDGYLKAFDAKNGKELWKFQTGSGVVSVPVTWEMDGEQYVAIQSGYGGAVPLWGGDMAELTKQVTQGGSMWVFKLPKASR

SEQ ID NO: 49867 - DNA, 1890 bp, Methylobacterium nodulans
  CDS (1)..(1890)
atgctgggtaagattgtggttcgttgtcggacgggggtgtcagtggctgccctggcggcgctgctgccgctcgccggcccttcggcgctcgcgaacgacaagctcgtcgagctgtcgaagagcgacggaaactgggtgatgcccgggaagaactacgactccgacaactacagcaagctgaagcagatcaacgccgagaacgtcaagaacctgaaggtgtcgtggcagttctcgaccggactgctgaacggccacgaaggcgcgccgctcgtcgtcgacggcacgatgtacgtgcacacctcgttcccgaacaacaccttcgcgctcggcctggacgatccgggcaagatcctgtggcaggacaagcccaagcagaacccggcggcgcgctcggtggcctgctgcgacctcgtcaaccgcggcctcgcctattggccgggcgacggcaagaccccgtccctgatcctcaagacgctgctcgacggccacgtcgtggccctcaacgcccagacgggcgagaccgtctggaagatcgagaattccgatatccgggtcggctcgacgctcaccatcgccccctatgtggtcaaggacaaggtgatcatcggctcctcgggcgccgaactcggcgtgcgcggctatctcaccgcctacgacgtccgcacgggcgagcagaagtggcgcgcctacgccacgggtccggattccgacctgctgctggccaaggacttcaacatccacaacgcccattacggccagaaggggctcggcacctcgacctgggagggcgacgcctggaagatcggcggcggcaccaactggggctggtacgcctatgaccccggcaccaacctgatctatttcggcaccggcaacccggcgccctggaacgagaccatgcgtccgggcgacaacaagtggacgatgaccatcttcgcccgcgacgtcgataccggcgaggccaagttcggctaccagaagacgccgcacgacgagtgggattacgcgggcgtcaacgtgatgatgctctcgacccagaaggaccggagcggcaaggagcgcaagctgctgacgcatccggaccgcaacggcatcgtctacaccctcgaccgcaccaacggcgacctgatctccgcccacaagatcgacgacaccgtcaacgtcttcaagaccgtcgacctcaagtcgggcctgccggtgcgcgatccggaatacggcacccggatggaccatctcgccaaggacatctgtccctccgcgatgggctatcacaaccagggccacgattcctatgatccggagcgcaagctcttctacatgggcatcaaccacatctgcatggattgggagcccttcatgctgccctaccgcgccgggcagttcttcgtcggcgcgacgctcaacatgtatccgggcccgaagggcgaccgccagaacgccgagggcctcggccagatcaaggcctacgacgccatcaccggcaagttcaaatgggagaagatggagcgtttcgcggtctggggcggaacgctcgccaccgccggcaacgtggtcttctacggaaccctggacggcttcatcaaggcgcgccactccgacacgggtgaactgctctggaaggcgaagctgccctcgggcgcgatcggctatcccgttacctacacccacaagggcacccagtacgtggcgatctactacggcgtcggcggttggccgggcgtcggcctcgtcttcgacctgcaggatccgaccgccggcctcggcgcggtcggcgccttcaagaagctcgccaactacacccagatgggcggtggcgtgaccgtgttctccctcgacggcaagggtccctacgacgacccgaataccggcgagtacgtggcggccaactga

SEQ ID NO: 49868 - protein, 629 aa, Methylobacterium nodulans
MLGKIVVRCRTGVSVAALAALLPLAGPSALANDKLVELSKSDGNWVMPGKNYDSDNYSKLKQINAENVKNLKVSWQFSTGLLNGHEGAPLVVDGTMYVHTSFPNNTFALGLDDPGKILWQDKPKQNPAARSVACCDLVNRGLAYWPGDGKTPSLILKTLLDGHVVALNAQTGETVWKIENSDIRVGSTLTIAPYVVKDKVIIGSSGAELGVRGYLTAYDVRTGEQKWRAYATGPDSDLLLAKDFNIHNAHYGQKGLGTSTWEGDAWKIGGGTNWGWYAYDPGTNLIYFGTGNPAPWNETMRPGDNKWTMTIFARDVDTGEAKFGYQKTPHDEWDYAGVNVMMLSTQKDRSGKERKLLTHPDRNGIVYTLDRTNGDLISAHKIDDTVNVFKTVDLKSGLPVRDPEYGTRMDHLAKDICPSAMGYHNQGHDSYDPERKLFYMGINHICMDWEPFMLPYRAGQFFVGATLNMYPGPKGDRQNAEGLGQIKAYDAITGKFKWEKMERFAVWGGTLATAGNVVFYGTLDGFIKARHSDTGELLWKAKLPSGAIGYPVTYTHKGTQYVAIYYGVGGWPGVGLVFDLQDPTAGLGAVGAFKKLANYTQMGGGVTVFSLDGKGPYDDPNTGEYVAAN

SEQ ID NO: 49869 - DNA, 1806 bp, Rhizobium meliloti
  CDS (1)..(1806)
atgaaccgacttcttacaatgcttgccattatgtcgataggcggcggtgcacaggtcgctttcgccaacgatgagttgcagaagctcatcgatgaccccaatcaatgggccatccagaccggcgattatgccaacctgcgctactccaagctcgaccagatcaacaaggacaacgtaggcaaacttcaggttgcctggaccttctcgaccggcgttctgcgtggtcacgaaggttcgccgctcgtcatcggcgacctgatgtacgtccatacgccgttcccgaacacggtctacgcgctggatctcagcaaggatggccagatcgtctggaaatacgagccgaagcaggatccgaacgtgatcccggtgatgtgttgcgacaccgtcaatcgcggcgtggcctatgcggataacaagatcttcctgcatcaggccgatacgacagtcgtggcactcgacgccaagaccggcaaagtcatctggagcgtcaagaacggcgatgctaccaagggcgagacgaataccgccaccgtcatgccggtgaaggacaagattctcgtcggcatatccggcggcgagttcggcgtccgcggtcacgtgacggcctattcgatggcagacgggaaggtcctgtggcgtggttactccatggggccggacagcgatacgctgatcgatcctgaaaagaccacccatctgggcaagccggtcggcaaggactccggcctcaccacctgggaaggcgatcagtggaagatcggcggcggcacgacctggggctggtactcctacgatccggaagaaaatctggtatattacggaaccggcaacccttcgacctggaacccgacccagcggccgggcgacaatcggtggtcgatgaccatcttcgcgcgtgatgtcgataccggcatggccaaatggctctatcagatgacgccccatgacgaatgggactatgacggcgtcaacgagatgatcctgacgggacagcatatcgacggtaaggaccgcaagctgctgacccacttcgaccggaacggcttcggctatacgatggaccgcgtcactggcgaactgctcgtggccgagaaatacgatcccacggtcaactgggcaactgaagtggtcatggatccgaagtccgacaaatacggtcggcctcaggtcgtggcacagtattcgaccgagcaaaacggcgaagacaccaacaccaccggcgtctgcccggcggcactcggcaccaaggaccagcagcctgcggcctattcgcctaagaccgagctgttctatgtgcccaccaaccacgtctgcatggactacgagccgttccgggtaagctacaccgccggccaaccctatgtcggggccacgctttcgatgtacccgccgaaggacagccacggcggcatgggcaatttcattgcctgcgacaacaaggaaggcaagatcaagtggtctctgccggagcctttctcggtctggtccggcgctctggcgacagccggcgatgtggtcttctacggaacgctcgagggctatctcaaggcggtcgacgcggcaaccggcaaggagctctatcgcttcaagacgccttccggggtgatcggcaacgtgatgacctatgcccgtgaaggcaagcagtacgtggcggtgctctccggtgtcggcggctgggccggtatcggtctggcagcgggcctgaccaacccgactgaaggtctgggagccgtcggaggctactcggacctcagcaactacaacgcactcggcggtacgctcaccgagttcaagctgccggagtaa

SEQ ID NO: 49870 - protein, 601 aa, Rhizobium meliloti
MNRLLTMLAIMSIGGGAQVAFANDELQKLIDDPNQWAIQTGDYANLRYSKLDQINKDNVGKLQVAWTFSTGVLRGHEGSPLVIGDLMYVHTPFPNTVYALDLSKDGQIVWKYEPKQDPNVIPVMCCDTVNRGVAYADNKIFLHQADTTVVALDAKTGKVIWSVKNGDATKGETNTATVMPVKDKILVGISGGEFGVRGHVTAYSMADGKVLWRGYSMGPDSDTLIDPEKTTHLGKPVGKDSGLTTWEGDQWKIGGGTTWGWYSYDPEENLVYYGTGNPSTWNPTQRPGDNRWSMTIFARDVDTGMAKWLYQMTPHDEWDYDGVNEMILTGQHIDGKDRKLLTHFDRNGFGYTMDRVTGELLVAEKYDPTVNWATEVVMDPKSDKYGRPQVVAQYSTEQNGEDTNTTGVCPAALGTKDQQPAAYSPKTELFYVPTNHVCMDYEPFRVSYTAGQPYVGATLSMYPPKDSHGGMGNFIACDNKEGKIKWSLPEPFSVWSGALATAGDVVFYGTLEGYLKAVDAATGKELYRFKTPSGVIGNVMTYAREGKQYVAVLSGVGGWAGIGLAAGLTNPTEGLGAVGGYSDLSNYNALGGTLTEFKLPE

SEQ ID NO: 49871 - DNA, 2088 bp, Pseudomonas stutzeri
  CDS (1)..(2088)
atgcctaacctcacccaatcacgccgtctcgtctgcctactgaccgcgctgctggtcgccgccggcgcccaggccgccaaggtcgacgaggccgccatccgtgccagcgagcaagacggcagcgaatggctcagccatggccgcacctacgccgagcagcgtttcagcccgctcaagcagatcgacgccggcaacgtcggcaagctgggcctggcctggtacttggatctggaaaacaaccgtggcctggaggccaccccgctggtgtccgacggcgtgctctacgcctcgctgtcctggagccgggtgatggccgtggacctgcgcagcggcaagcgcctgtggcagttcgatccccaggtggatcgcggccactcccgctacacctgctgcgacgcggtcaaccgcggcgtcgccctgtggaacggcaaggtctacgtcggcgccctggacggccgcctgatcgccctggacgccaagaccggccgcgagctgtggagcgagcagaccaccgacccggccaagccctacagcatcaccggcgcgccgcgggtggtgaagggcaaggtgatcatcggcaacggcggcgccgagtacggcgtgcgcggcttcttctccgcctacgatgccgagaccggcaagatggcctggcgtttctacacggtgccgggcgatccggcccagccctacgagcaccctgagctggccgaagcggccaagacctggaagggcgaccagtactggaagctcggcggcggcggcaccgtgtgggacagcatggcctacgacccggagctggacctgctgtacatcggcaccggcaacggttcgccgtggaaccgcgagatccgcagtccgggcggcggcgacaacctgtacctgtcgtcgatcctggccctgcgcccggacagcggcaagctgctctggcactaccagaccacaccgggcgaaacctgggacttcaccgccacccagcagatcaccctggccaccctggagctggacggcaagccgcgcaaggtgctgatgcaggcgccgaagaacggcttcttctatgtgctcgatcgcgccaccggcgaactgctctcggcggaaaagttcggcaaggtgacctgggccgagaaggtcgatctggccaccggccgcccggtggaggtgcccggctcgcgctacgagaaggagcaggtggtgatgtggccgagctcgttcggcgcgcacaactggcactccatgtcgttcaacccgcagaccgggctgatgtacatcccctaccaggaaatccccggcgtctatcgcaacgagggggccacgttcaaaaagatcgacggcttgaacaccggtaccggcttcagcgacacccacgagataccccgcgatgcggtgagcggcgccctgctggcctgggacccggtacgccagcgcgaggcctggcgcgtgccgcatagcttctactggaacggcggcaccctgagcaccgccggcaacctggtgttccagggcaccgccgacggccagctgcacgcctactcggcggacaagggacagcgcctgtggagcttcgccgcgcagaccggcatagtcgccgcccccatcagcttcagcctggacggcgaacagtacgtggcggtcatggccggctggggcggcgcggcgccgctgatcggcggcgacgcggcgctggcgcccggggtgcgcaacctcagccgcctgctggtgttcaagctcggcggccagagcagcctgccgccgctgccgcaggcgaccacggccgccgtgcagcgcacgccgcaagcggtccaagcgagtgccgcggacctggacgccggcaagctgctgtacggcaactactgctcgatgtgtcacggcgtcggcgccgtcagcggcggcctgatccccgacctgcgccatacggatcaatggcgccgcgacaacttccagcagatcgtccgggacggcatcctccgtccgctgggcatgccatccttcaagaactcgctgagcgcggccgaggtggaacagatcaaggcctatgtgatgagccgcgagtacgaggaccatctcaaggcgcagcaagccgccagaccctga

SEQ ID NO: 49872 - protein, 695 aa, Pseudomonas stutzeri
MPNLTQSRRLVCLLTALLVAAGAQAAKVDEAAIRASEQDGSEWLSHGRTYAEQRFSPLKQIDAGNVGKLGLAWYLDLENNRGLEATPLVSDGVLYASLSWSRVMAVDLRSGKRLWQFDPQVDRGHSRYTCCDAVNRGVALWNGKVYVGALDGRLIALDAKTGRELWSEQTTDPAKPYSITGAPRVVKGKVIIGNGGAEYGVRGFFSAYDAETGKMAWRFYTVPGDPAQPYEHPELAEAAKTWKGDQYWKLGGGGTVWDSMAYDPELDLLYIGTGNGSPWNREIRSPGGGDNLYLSSILALRPDSGKLLWHYQTTPGETWDFTATQQITLATLELDGKPRKVLMQAPKNGFFYVLDRATGELLSAEKFGKVTWAEKVDLATGRPVEVPGSRYEKEQVVMWPSSFGAHNWHSMSFNPQTGLMYIPYQEIPGVYRNEGATFKKIDGLNTGTGFSDTHEIPRDAVSGALLAWDPVRQREAWRVPHSFYWNGGTLSTAGNLVFQGTADGQLHAYSADKGQRLWSFAAQTGIVAAPISFSLDGEQYVAVMAGWGGAAPLIGGDAALAPGVRNLSRLLVFKLGGQSSLPPLPQATTAAVQRTPQAVQASAADLDAGKLLYGNYCSMCHGVGAVSGGLIPDLRHTDQWRRDNFQQIVRDGILRPLGMPSFKNSLSAAEVEQIKAYVMSREYEDHLKAQQAARP

SEQ ID NO: 49873 - DNA, 2097 bp, Alcaligenes eutrophus
  CDS (1)..(2097)
atgcatagcaacaagctacgcctgttagtgtgcgtgatggccgcggccagcgtggcgctgccggcgccgatggcattcggcgccaatgccgccgcgcgcgtggacggcgccgccattcgcgccaacgaggccggcacgcccaactggcccagctacggcctggattacgccgagacccgcttcagcaagctcgagcaggtcaacgcgggcaacgtcaggaacctggggctggcgtggtcctacgacctggaatcgacgcgcggcgtggaggcgacgccgctggtggtcgacggcgtgatgtatgtctccgcgccgtggagcgtggtgcatgccatcgacgcccgcaccggcaagcgcctgtggacctacgacccgcaggtgccgcgcgaccaggcctacaagggctgctgcgacgtggtcaatcgcggcgtggcgctgtaccagggcaaggtcttcgtcggcgcgttcgacggccggctggtggccatcgacgcagccaccggcaagaaggtctgggagcaggacaccatcgtcgaccgcagcaagtcctacaccatcaccggcgcgccgcgcgtctacaacggcaaggtgatcatcggcaacggcggcgcggagtatggcgtgcgcggctatatcaccgcctacgatgccgagaccggcaagcagcaatggcgctggtacacggtgccgggcgaccccgccaggccattcgagaacgaagccatggcaaaggccgcggccacctgggatcccagcggcaagtactggatcaacggcggcggcggcacggtgtggaacaccatggcgttcgatcccgagctcaacctgatgtacatcggcaccggcaatgccggcccgtggagccgcaagctgcgcagcccgaagggtggcgacaacctctacgcggcctccgtggtggcgctgaaccccgacaccggcgaatacgtctggcactaccaggaaaccccgggcgacaactgggactacacctcgacccaggacatcatcctggccgacctgaagatcgacggccagccgcgcaaggtgatcctgcatgcgcccaagaacggcttcttcttcgtgatcgaccggaccaacggcaaattcatctcggcgaagaacttcgtcgacgtcaactgggcctcgggctatgacaagaacggccggccggtcgagacgccgcaggcggacacctccggcaagccggccgacgtcgtgccggggccgttcggcgcgcacaactggcattcgatgtcgttccacccgaaactcgggctggccttcatcccggcgcagcacgtgccgctgacgctggccgacaacaaggagtgggtgcacaaccagaaggactcgcccgaggcgcatcgcggcgtgggctggaacctgggcatgctggtcaatgccgagccgcccaggagcaagccgatgggccggctgatcgcgtgggatccgctggcgcagaaggcggtatggcaccgggaccatgccgggccgtggaacggcggcacgctcgcgaccgccggcaacctggtgttccagggcaccgcggacggacggctggtggcgtatcacgccgccaccggcgagaagctgtggcaggcgccgaccggctcgggcgtggtggcggcaccggtgacctatctgctcgacggcaggcagtacgtctcggtggcggtgggctggggcggcgtgtatggcctgagccagcgcggcagcgacagacaggccccggggcgggtctacacctttgtcctcaacggcaagacgccgatgcccgcgtcggcgccttacgcgatggcaccgctgctgagcggggtgaagtacgatccggccaaggtcgccgacgggcagaagctctatgtcaacaactgcgttttctgccatggcgtgcccggcgtcgacaagggcggcaatatccccaacctggcctatgtcggcgcgccgatgatcgagcacctcgacaagatcctgttcaacgggccgttcgtgcagaagggcatgccggatttcaccggcaagctgactgccgaggacgtggtcaagatccaggcgttcatccagggcaccgccgacgcggtgcggcccaggaagccatga

SEQ ID NO: 49874 - protein, 698 aa, Alcaligenes eutrophus
MHSNKLRLLVCVMAAASVALPAPMAFGANAAARVDGAAIRANEAGTPNWPSYGLDYAETRFSKLEQVNAGNVRNLGLAWSYDLESTRGVEATPLVVDGVMYVSAPWSVVHAIDARTGKRLWTYDPQVPRDQAYKGCCDVVNRGVALYQGKVFVGAFDGRLVAIDAATGKKVWEQDTIVDRSKSYTITGAPRVYNGKVIIGNGGAEYGVRGYITAYDAETGKQQWRWYTVPGDPARPFENEAMAKAAATWDPSGKYWINGGGGTVWNTMAFDPELNLMYIGTGNAGPWSRKLRSPKGGDNLYAASVVALNPDTGEYVWHYQETPGDNWDYTSTQDIILADLKIDGQPRKVILHAPKNGFFFVIDRTNGKFISAKNFVDVNWASGYDKNGRPVETPQADTSGKPADVVPGPFGAHNWHSMSFHPKLGLAFIPAQHVPLTLADNKEWVHNQKDSPEAHRGVGWNLGMLVNAEPPRSKPMGRLIAWDPLAQKAVWHRDHAGPWNGGTLATAGNLVFQGTADGRLVAYHAATGEKLWQAPTGSGVVAAPVTYLLDGRQYVSVAVGWGGVYGLSQRGSDRQAPGRVYTFVLNGKTPMPASAPYAMAPLLSGVKYDPAKVADGQKLYVNNCVFCHGVPGVDKGGNIPNLAYVGAPMIEHLDKILFNGPFVQKGMPDFTGKLTAEDVVKIQAFIQGTADAVRPRKP

SEQ ID NO: 49875 - DNA, 1800 bp, Methylovorus sp
  CDS (1)..(1800)
atgaaggcaagaataacagctactggctttgccgttgctggattggcattgtcagcgatgctgccatctgttgcggcggcagcggatagcctggaagcgctgggggcgaaccccaataactggacgatgcagactggggattacacggggcagcattacagccgcctttcacaaatcacgacgggtaacgtcaagaaccttgaaagcggcctgggtcatttctccaccggcttgctgactggtcatgaaggtgcaccactggtgatcggcgacatgatgtacatcaatacgccatttcccaacaatacgtttgcgctgaatctggccgagcctgaaaaaatcgtctggcagcacaaacccaagcaggatgcttcggtcaaggccgtggcctgctgtgacatcgtcaaccgtggcctggcctacgatgatggtcacatcttcaagacccagctcgatggtcacctggttgcatcggatgccaagaccggtaaagaactctggaagatggaaaactgcgatcctgcagtaggttccaccattacccaggcgcctttcgctgttaagggcaaggtgctggtcggttgctccggtgcggaactgggcgtgcgcggttacgtcaccgcttatgaccagaaaaccggcgagctggtatggcgttcatttgccaccggcccagacaacgagctcaacctggccaaagacttcaacaaggacaatcctcactacggtcagatgggcctcggtaccaagacctgggaaggcgaaggctggaaaatcggcggcggcaccaactggggctggtatgcctatgatcccaagctgaacctgttctactacggttccggcaaccctgcaccatggaatgaaaccatgcgcccaggcgacaacaagtggaccatgaccatctgggcacgtgatgtagatactggcgctgccaagtggggctaccagaagacgcctcatgacgagtgggacttcgccggtgttaaccagatgatcctgaccgaccaggcagtaaacggcaagacgcagcctctgctgacccacgttgaccgtaacggcatcatgtacacgctgaaccgtcaaaccggttccatcgtacaggctgccaaggtggatcctgcggtgaacgtattcaagaaggtagacctgaagaccggcctgccagtgcgtgatcctgaattcagcacccgcatggaccacaagggtaccaatatctgcccatctgccatgggtttccacaaccagggtttggatgcctacgatcctgacagccgtaccttctacttcggcctgaaccacatttgtatggattgggagcccttcatgctgccataccgtgcaggtcagttcttcgttggcgcaacgctggcgatgtaccccggccctaacggcccaaccaagaaggaaatgggtcaagtgctcgccatggacggcgtgaccggtgaagtgaagtggaccaagtgggagaaattctccgtttggggcggcaccttggcaaccaagggtggcctggtgttctacaacactctcgacggcaacatcaaggcactcgacaagaccaacggcaaggaaatctggaagttcaagatgccttccggtgcgattggcgcgccaatgagctatgcctacaagggtaagcagtacatcgcgaccaactacggtgtaggcggctggcctggtgtgggtctggtgtttgacctgaccgatccaagtgctggtctgggtgcggtaggtgccttcaaggaactccagaactacacccagatgggcggtggtgtgatggtgttcggtctgtaa

SEQ ID NO: 49876 - protein, 599 aa, Methylovorus sp
MKARITATGFAVAGLALSAMLPSVAAAADSLEALGANPNNWTMQTGDYTGQHYSRLSQITTGNVKNLESGLGHFSTGLLTGHEGAPLVIGDMMYINTPFPNNTFALNLAEPEKIVWQHKPKQDASVKAVACCDIVNRGLAYDDGHIFKTQLDGHLVASDAKTGKELWKMENCDPAVGSTITQAPFAVKGKVLVGCSGAELGVRGYVTAYDQKTGELVWRSFATGPDNELNLAKDFNKDNPHYGQMGLGTKTWEGEGWKIGGGTNWGWYAYDPKLNLFYYGSGNPAPWNETMRPGDNKWTMTIWARDVDTGAAKWGYQKTPHDEWDFAGVNQMILTDQAVNGKTQPLLTHVDRNGIMYTLNRQTGSIVQAAKVDPAVNVFKKVDLKTGLPVRDPEFSTRMDHKGTNICPSAMGFHNQGLDAYDPDSRTFYFGLNHICMDWEPFMLPYRAGQFFVGATLAMYPGPNGPTKKEMGQVLAMDGVTGEVKWTKWEKFSVWGGTLATKGGLVFYNTLDGNIKALDKTNGKEIWKFKMPSGAIGAPMSYAYKGKQYIATNYGVGGWPGVGLVFDLTDPSAGLGAVGAFKELQNYTQMGGGVMVFGL

SEQ ID NO: 49877 - DNA, 2373 bp, Pantoea citrea
  CDS (1)..(2373)
atgtcacaggaatccagaggcctgcgcctcatcacactagcaatatcagtgttctgcaccttgtggctgataatcggcggtggctggttactggcaattggcggcagcgcatactatctcatcagcggcatcgttatggcggtgttcactgtaatgttgttaaagaaaagaagctgtgctttttatctttactcactcattctgctgggcacagctatctgggcctggtgcgaatccggccttgatttctgggctctggctccgcgtctcgatatctgggtactgtttggtatctggatgattttgccgtttgtttatcgccaactggcggctcccaaccgtaaagctactgcgctgatggtgattgctatcgtcatcaacctggccatggtcgttggcgcctttttcggcaaagacccgcaggcagtctacggtgacctgaatgttcaggctcctgcaactcagccagtgtctgccggtaaagactggaccgcttatggtggtactcaggccggtgaccgttactcttcattaagtcagattaacgaaagcaatgtcaaaaatctgcaggtggcatggacctaccagtctggtgacgtaaaacgccctgatgatccgggtgagatcactaacgaatcaactccactgaaagtaggtaatctcctttatacctgtacagcgcaccagattctggtcgcgattgatgctgcaacaggtaaagaaaaatggcgttttgaccctaaaatcaaatatgaccctaccttccagcacatgacctgtcgtggtgtttcctatcatgactttaatacggcaacagatcctcagagtgctccggtttctccggcggcctgttcacgtcgtatctatctgccggttaacgatggtcgtctgattgcggtggatgctgaaaatggtcaactgtgtaaagactttggtaataatggtgagctggatctgcagcatcagcagccgaatgctttcccgggcggctatgaaccaacatcacctccggtaattaccgataaagtaattgtgattgccggggccgttaccgataactactcaacccgtgagccgtcaggtgttatccgtggttttgacgtgaaaaccggtaaactgctgtgggcattcgatccgggtgccaaagatccgaacgcaattcctgcggacggtcagcactgttcagcgaactcaccaaactcctgggcaccagctgcttacgatccgaaactggatttggtatatctgccgatgggtgtgaccacgccggatatctggggtggaaaccgtactcctgagcaggaacattatgcgagtggtatcctggcactgaatgccaccacaggtaaagaagcctggttctaccagactgtccaccacgatctgtgggacatggatattccggcgcagccttcactggcagatattaccgataaagacggcaacaaagttcctgtcatctacgttccgaccaaagtaggtaacatctttgttctgaaccgtgcaaccggtcagctggtggtaccggctcctgagcgtgcggtaccgcaaggtgctgctaaaggcgaccatacctctgcgactcagccgttccctgaactgaccttccgtccggaagcgaaactgaccgacagtaagatgtggggcggtacgatgtttgaccagatgatctgtcgtatcatgttcaaacgtctgcattataacgggactttcactccaccttcagagcagggcaccctggtattcccgggtaacctgggtatgtttgaatggggtggtatttcggtcaacagtggtagcgagtttgccattgctaacccaatgcaactgccgtttgtttcaaaactgatcccacgtggtccaaacaacccaatggaaccgggtaaaaacggtgccggtggttccggtggtgaagccggtctgcaacacatgtatggcgtgccttttggtgtggaactgaatccgttcctgtcaccattcggtctgccatgcatggaaccttcatggggctttgtttcagccgttaacctgaaaactaaccagattgtgtggaaaaaacgtattggtactatccgtgacagcggtggcccgattccgttaccaccgattactgtaggtactccgatgctgggtgctcctatcactacagccggtaatatcttctttatcgccgctactctggatgactacatccgtgcctatagtgtgcgtgacggtaaactgctgtggcaggcacgtctgccggcgggtggtcaggcaacaccaatgacctatgaagtagacggtaagcagtatctggtaattgttgccggcggacacggttcgttcggtacgaaaatgggcgattacattattgcttataaattgccttaa

SEQ ID NO: 49878 - protein, 790 aa, Pantoea citrea
MSQESRGLRLITLAISVFCTLWLIIGGGWLLAIGGSAYYLISGIVMAVFTVMLLKKRSCAFYLYSLILLGTAIWAWCESGLDFWALAPRLDIWVLFGIWMILPFVYRQLAAPNRKATALMVIAIVINLAMVVGAFFGKDPQAVYGDLNVQAPATQPVSAGKDWTAYGGTQAGDRYSSLSQINESNVKNLQVAWTYQSGDVKRPDDPGEITNESTPLKVGNLLYTCTAHQILVAIDAATGKEKWRFDPKIKYDPTFQHMTCRGVSYHDFNTATDPQSAPVSPAACSRRIYLPVNDGRLIAVDAENGQLCKDFGNNGELDLQHQQPNAFPGGYEPTSPPVITDKVIVIAGAVTDNYSTREPSGVIRGFDVKTGKLLWAFDPGAKDPNAIPADGQHCSANSPNSWAPAAYDPKLDLVYLPMGVTTPDIWGGNRTPEQEHYASGILALNATTGKEAWFYQTVHHDLWDMDIPAQPSLADITDKDGNKVPVIYVPTKVGNIFVLNRATGQLVVPAPERAVPQGAAKGDHTSATQPFPELTFRPEAKLTDSKMWGGTMFDQMICRIMFKRLHYNGTFTPPSEQGTLVFPGNLGMFEWGGISVNSGSEFAIANPMQLPFVSKLIPRGPNNPMEPGKNGAGGSGGEAGLQHMYGVPFGVELNPFLSPFGLPCMEPSWGFVSAVNLKTNQIVWKKRIGTIRDSGGPIPLPPITVGTPMLGAPITTAGNIFFIAATLDDYIRAYSVRDGKLLWQARLPAGGQATPMTYEVDGKQYLVIVAGGHGSFGTKMGDYIIAYKLP

SEQ ID NO: 49879 - DNA, 2229 bp, Acetobacter aceti
  CDS (1)..(2229)
atgacccgccccgcctccgccaagagacgttcactgctaggaattctcgcggccggaacaatctgtgccgctgctttgccttacgcggcagtccctgcccgcgctgacggtcagggtaatacgggggaagctatcatccatgcagatgatcaccccgaaaactggctttcttatggtcgcacttacagcgaacagcgctatagccccctagatcagatcaaccgctccaacgtgggtgatcttaagctgcttgggtactatacgctggataccaaccgcggtcaggaagcaactccgctggttgttgatggcattatgtatgccacaaccaactggtccaaaatggaagcgctggacgctgccacaggtaagctgctttggcagtatgaccccaaagtgccaggcaacattgctgacaaaggctgctgtgatacggttaaccgtggtgcaggctattggaacggcaaggttttctggggcacgtttgatggccgtctggtcgctgccgatgcaaaaaccggtaaaaaggtgtgggcagttaacaccatcccagccgatgcctctttgggcaagcagcgctcctacacagtggatggcgcggtacgcgtagcgaagggcctggtcctgattggtaacggtggtgccgaatttggtgcccgtggctttgtttccgcttttgatgccgaaaccggcaagctgaaatggcgcttctacaccgttccgaacaataagaacgaacccgaccacgccgcatcagataatattctgatgaacaaagcctacaaaacctggggccccaaaggcgcttgggtacgccagggtggcggtggcaccgtatgggattctctggtttatgatccggtcagtgacctcatctatctggctgttggtaacggatctccctggaactataagtatcgttccgaaggcattggttccaacctgttcctgggcagcattgtcgcactgaagcctgaaaccggtgaatatgtctggcacttccaggcaaccccgatggatcagtgggattacacctcggttcagcagatcatgacactggatatgccagtgaaaggcgaaatgcgccacgtgatcgtgcatgcacctaaaaacggcttcttctacgttctggatgccaaaaccggtgaattcctgtccggcaaaaactacgtttaccagaactgggccaatggtctggaccctctgacaggtcgcccgatgtacaacccggatggtctgtataccctgaacggcaagttctggtacggtatccccggcccactgggtgcgcataactttatggccatggcctacagccccaaaacgcatctggtttatatcccggctcaccagattccgtttggttataaaaatcaggttggtggctttaagccgcatgcggattcctggaacgttggtctggacatgaccaagaacggtctgcctgataccccagaagcccgtaccgcttacatcaaggatctgcacggctggctgctggcatgggatccggtcaagatggaaacggtctggaagattgaccacaaaggtccgtggaacggcggcatcctggccaccggcggtgatcttctgttccagggcttggccaatggtgaattccacgcctatgacgccacgaacggtagcgacctttacaagtttgacgcacagagcggcattatcgctccgcctatgacctatagcgtcaacggcaagcagtatgttgctgttgaagtgggctggggcggcatttacccaatttccatgggtggtgtaggccgtacttctggctggacagttaaccactcctacattgctgcgttctctctggatggcaaagccaagctgccggctctgaacaaccgcggcttcctgcccgtaaaaccacctgcacagtatgaccagaaggtcgttgataacggttacttccagtatcagacctactgccagacctgccatggtgataacggcgaaggtgcaggcatgctgcctgatctgcgttgggccggtgctatccgccaccaggatgccttctacaatgtagttggtcgcggtgcgctgacggcttacgggatggatcgctttgacaccagcatgacgccggatgaaattgaagcaatccgtcagtatctgatcaaacgggcaaacgacacgtatcagcgtgaagtggatgctcggaagaatgacaagaatattcccgaaaacccgacacttggcattaacccctaa

SEQ ID NO: 49880 - protein, 742 aa, Acetobacter aceti
MTRPASAKRRSLLGILAAGTICAAALPYAAVPARADGQGNTGEAIIHADDHPENWLSYGRTYSEQRYSPLDQINRSNVGDLKLLGYYTLDTNRGQEATPLVVDGIMYATTNWSKMEALDAATGKLLWQYDPKVPGNIADKGCCDTVNRGAGYWNGKVFWGTFDGRLVAADAKTGKKVWAVNTIPADASLGKQRSYTVDGAVRVAKGLVLIGNGGAEFGARGFVSAFDAETGKLKWRFYTVPNNKNEPDHAASDNILMNKAYKTWGPKGAWVRQGGGGTVWDSLVYDPVSDLIYLAVGNGSPWNYKYRSEGIGSNLFLGSIVALKPETGEYVWHFQATPMDQWDYTSVQQIMTLDMPVKGEMRHVIVHAPKNGFFYVLDAKTGEFLSGKNYVYQNWANGLDPLTGRPMYNPDGLYTLNGKFWYGIPGPLGAHNFMAMAYSPKTHLVYIPAHQIPFGYKNQVGGFKPHADSWNVGLDMTKNGLPDTPEARTAYIKDLHGWLLAWDPVKMETVWKIDHKGPWNGGILATGGDLLFQGLANGEFHAYDATNGSDLYKFDAQSGIIAPPMTYSVNGKQYVAVEVGWGGIYPISMGGVGRTSGWTVNHSYIAAFSLDGKAKLPALNNRGFLPVKPPAQYDQKVVDNGYFQYQTYCQTCHGDNGEGAGMLPDLRWAGAIRHQDAFYNVVGRGALTAYGMDRFDTSMTPDEIEAIRQYLIKRANDTYQREVDARKNDKNIPENPTLGINP

SEQ ID NO: 49881 - DNA, 2220 bp, Acetobacter europaeus
  CDS (1)..(2220)
atgatttctgccgttttcggaaaaagacgttctctgagcagaacgcttacagccggaacgatatgtgcggctctcatctccgggtatgccaccatggcatccgcagatgacgggcagggcgccacgggggaagcgatcatccatgccgatgatcaccccggtaactggatgacctatggccgcacctattctgaacagcgctacagcccgctggatcagatcaaccgttccaatgtcggtaacctgaagctggcctggtatctggaccttgataccaaccgtggccaggaaggcacgcccctggttattgatggcgtcatgtacgccaccaccaactggagcatgatgaaagccgtcgacgccgcaaccggcaagctgctgtggtcctatgacccgcgcgtgcccggcaacattgccgacaagggctgctgtgacacggtcaaccgtggcgcggcatactggaatggcaaggtctatttcggcacgttcgacggtcgcctgatcgcgctggacgccaagaccggcaagctggtctggagcgtcaacaccattccgcccgaagcggaactgggcaagcagcgttcctatacggttgacggcgcgccccgtatcgccaagggccgcgtgatcatcggtaacggtggttccgaattcggtgcccgtggcttcgtcacggcgttcgatgcggaaaccggcaaggtcgactggcgcttcttcacggctccgaaccccaagaacgaaccggaccacactgcatccgacagcgtgctgatgaacaaggcctaccagacctggagcccgaccggcgcctggacccgccagggtggcggcggcacggtatgggattccatcgtgtatgaccccgtggccgacctggtctacctgggcgttggcaacggttcgccgtggaactacaagtaccgttccgaaggcaagggcgacaacctgttcctgggcagcatcgtcgcactgaagccggaaaccggcgaatacgtctggcatttccaggaaacgccgatggaccagtgggacttcacctcggtccagcagatcatgacgcttgacctgccgatcaatggtgaaacccgccacgtcatcgtccatgcgccgaagaacggcttcttctacatcatcgatgcgaagaccggtgagttcatctcgggcaagaactacgtctatgtgaactgggccagcggccttgatcccaagaccggccgtccgatctacaaccccgatgcgctctacacccttacgggcaaggaatggtacggcattccgggtgaccttggcggccataacttcgcggccatggcgttcagccccaagaccgggctggtctatattccggcgcagcaggttccgttcctgtacaccaatcaggtcggtggcttcacgccgcaccccgacagctggaacctgggtctggacatgaacaaggtcggtattcccgactcgcctgaagccaagcaggccttcgtgaaggacctgaagggctggatcgtggcctgggatccgcagaagcaggctgaagcatggcgcgtggaccacaaggggccgtggaacggcggtatcctggcaactggcggcgacctgctgttccagggcttggcgaacggcgaattccatgcctatgacgcgacgaacggttccgacctgttccacttcgcggcggacagcggcatcatcgcaccgcctgtgacctaccttgccaatggcaagcagtatgttgcggttgaagtgggctggggcggcatctatccgttcttccttggtggcctggcccgtaccagcggctggaccgtcaaccactcgcgcatcattgccttctcgctcgatggcaagtccggcccgctgcccaagcagaatgaccagggcttcctgcccgtcaagccgccggcacagttcgacagcaagcgtaccgataacggttacttccagttccagacctattgcgccgcctgtcatggcgataacgcagaaggtgccggtgtgctgcctgacctgcgctggtccgggtccatccgtcatgaggacgcgttctacaatgttgtcggccgcggcgcgcttaccgcctacggtatggatcgcttcgacggtaacatgaacccgaccgagattgaggacatccgccagttcctgatcaagcgtgcgaacgagacctatcagagggaagttgatgcccggaagaacgctgacggtatccccgagcagctgccgtaa

SEQ ID NO: 49882 - protein, 739 aa, Acetobacter europaeus
MISAVFGKRRSLSRTLTAGTICAALISGYATMASADDGQGATGEAIIHADDHPGNWMTYGRTYSEQRYSPLDQINRSNVGNLKLAWYLDLDTNRGQEGTPLVIDGVMYATTNWSMMKAVDAATGKLLWSYDPRVPGNIADKGCCDTVNRGAAYWNGKVYFGTFDGRLIALDAKTGKLVWSVNTIPPEAELGKQRSYTVDGAPRIAKGRVIIGNGGSEFGARGFVTAFDAETGKVDWRFFTAPNPKNEPDHTASDSVLMNKAYQTWSPTGAWTRQGGGGTVWDSIVYDPVADLVYLGVGNGSPWNYKYRSEGKGDNLFLGSIVALKPETGEYVWHFQETPMDQWDFTSVQQIMTLDLPINGETRHVIVHAPKNGFFYIIDAKTGEFISGKNYVYVNWASGLDPKTGRPIYNPDALYTLTGKEWYGIPGDLGGHNFAAMAFSPKTGLVYIPAQQVPFLYTNQVGGFTPHPDSWNLGLDMNKVGIPDSPEAKQAFVKDLKGWIVAWDPQKQAEAWRVDHKGPWNGGILATGGDLLFQGLANGEFHAYDATNGSDLFHFAADSGIIAPPVTYLANGKQYVAVEVGWGGIYPFFLGGLARTSGWTVNHSRIIAFSLDGKSGPLPKQNDQGFLPVKPPAQFDSKRTDNGYFQFQTYCAACHGDNAEGAGVLPDLRWSGSIRHEDAFYNVVGRGALTAYGMDRFDGNMNPTEIEDIRQFLIKRANETYQREVDARKNADGIPEQLP

SEQ ID NO: 49883 - DNA, 2217 bp, Acetobacter polyoxogenes
  CDS (1)..(2217)
atgatttctgccgttttcggaaaaagacgttctctgagcagaacgcttacagccggaacgatatgtgcggctctcatctccgggtatgccaccatggcatccgcagatgacgggcagggcgccacgggggaagcgatcatccatgccgatgatcaccccggtaactggatgacctatggccgcacctattctgaccagcgctacagcccgctggatcagatcaaccgttccaatgtcggtaacctgaagctggcctggtatctggaccttgataccaaccgtggccaggaaggcacgcccctggttattgatggcgtcatgtacgccaccaccaactggagcatgatgaaagccgtcgacgccgcaaccggcaagctgctgtggtcctatgacccgcgcgtgcccggcaacattgccgacaagggctgctgtgacacggtcaaccgtggcgcggcatactggaatggcaaggtctatttcggcacgttcgacggtcgcctgatcgcgctggacgccaagaccggcaagctggtctggagcgtcaacaccattccgcccgaagcggaactgggcaagcagcgttcctatacggttgacggcgcgccccgtatcgccaagggccgcgtgatcatcggtaacggtggttccgaattcggtgcccgtggcttcgtcagcgcgttcgatgcggaaaccggcaaggtcgactggcgcttcttcacggttccgaaccccaagaacgaaccggacgctgcatccgacagcgtgctgatgaacaaggcctaccagacctggagcccgaccggcgcctggacccgccagggtggcggcggcacggtatgggattccatcgtgtatgaccccgtggccgacctggtctacctgggcgttggcaacggttcgccgtggaactacaagtaccgttccgaaggcaagggcgacaacctgttcctgggcagcatcgtcgcactgaagccggaaaccggcgaatacgtctggcatttccaggaaacgccgatggaccagtgggacttcacctcggaccagcagatcatgacgcttgacctgccgatcaatggtgaaacccgccacgtcatcgtccatgcgcgcaagaacggcttcttctacatcatcgatgcgaagaccggtgagttcatctcgggcaagaactacgtctatgtgaactgggccagcggccttgatcccaagaccggccgtccgatctacaaccccgatgcgctctacacccttacgggcaaggaatggtacggcattccgggtgaccttggcggccataacttcgcggccatggcgttcagccccaagaccgggctggtctatattccggcgcagcaggttccgttcctgtacaccaatcaggtcggtggcttcacgccgcaccccgacagctggaacctgggtctggacatgaacaaggtcggtattcccgactcgcctgaagccaagcaggccttcgtgaaggacctgaagggctggatcgtggcctgggatccgcagaagcaggctgaagcatggcgcgtggaccacaaggggccgtggaacggcggtatcctggcaactggcggcgacctgctgttccagggcttggcgaacggcgaattccatgcctatgacgcgacgaacggttccgacctgttccacttcgcggcggacagcggcatcatcgcaccgcctgtgacctaccttgccaatggcaagcagtatgttgcggttgaagtgggctggggcggcatctatccgttcttccttggtggcctggcccgtaccagcggctggaccgtcaaccactcgcgcatcattgccttctcgctcgatggcaagtccggcccgctgcccaagcagaatgaccagggcttcctgcccgtcaagccgccggcacagttcgacagcaagcgtaccgataacggttacttccagttccagacctattgcgccgcctgtcatggcgataacgcagaaggtgccggtgtgctgcctgacctgcgctggtccgggtccatccgtcatgaggacgcgttctacaatgttgtcggccgcggcgcgcttaccgcctacggtatggatcgcttgcacggtaacatgaacccgaccgagattgaggacatccgccagttcctgatcaagcgtgcgaacgagacctatcagagggaagttgatgcccggaagaacgctgacggtatccccgagcagctgccgtaa

SEQ ID NO: 49884 - protein, 738 aa, Acetobacter polyoxogenes
MISAVFGKRRSLSRTLTAGTICAALISGYATMASADDGQGATGEAIIHADDHPGNWMTYGRTYSDQRYSPLDQINRSNVGNLKLAWYLDLDTNRGQEGTPLVIDGVMYATTNWSMMKAVDAATGKLLWSYDPRVPGNIADKGCCDTVNRGAAYWNGKVYFGTFDGRLIALDAKTGKLVWSVNTIPPEAELGKQRSYTVDGAPRIAKGRVIIGNGGSEFGARGFVSAFDAETGKVDWRFFTVPNPKNEPDAASDSVLMNKAYQTWSPTGAWTRQGGGGTVWDSIVYDPVADLVYLGVGNGSPWNYKYRSEGKGDNLFLGSIVALKPETGEYVWHFQETPMDQWDFTSDQQIMTLDLPINGETRHVIVHARKNGFFYIIDAKTGEFISGKNYVYVNWASGLDPKTGRPIYNPDALYTLTGKEWYGIPGDLGGHNFAAMAFSPKTGLVYIPAQQVPFLYTNQVGGFTPHPDSWNLGLDMNKVGIPDSPEAKQAFVKDLKGWIVAWDPQKQAEAWRVDHKGPWNGGILATGGDLLFQGLANGEFHAYDATNGSDLFHFAADSGIIAPPVTYLANGKQYVAVEVGWGGIYPFFLGGLARTSGWTVNHSRIIAFSLDGKSGPLPKQNDQGFLPVKPPAQFDSKRTDNGYFQFQTYCAACHGDNAEGAGVLPDLRWSGSIRHEDAFYNVVGRGALTAYGMDRLHGNMNPTEIEDIRQFLIKRANETYQREVDARKNADGIPEQLP

SEQ ID NO: 49885 - DNA, 2274 bp, Gluconobacter oxydans
  CDS (1)..(2274)
atgacttctggtctactgacgccgatcaaggttacgaaaaagcgccttctcagctgcgctgccgcgctggcattttcagcagctgtacctgtcgcttttgcgcaggaagataccggcacagcaatcacgagctccgataacggcggccatcccggggactggctgtcctacggccgttcctattccgagcagcgctacagcccgctcgaccagatcaatacggagaatgtcggcaagctgaagctcgcctggcactatgatctggacacgaaccgcggccaggaaggcactcccctgatcgtcaacggcgtcatgtacgccacgaccaactggagcaagatgaaggcgctggatgcagcgaccggcaagctcctgtggtcctacgatccgaaggttccgggcaacatcgccgaccgtggctgctgtgacacggtcagccgtggcgccgcctactggaacggcaaggtctatttcggcacgttcgacggccgtctgatcgcactcgacgccaagaccggcaagctggtctggagcgtctacacgatccccaaggaggcccagctcggccaccagcggtcctacacggttgacggtgccccccgtatcgccaagggcaaggtcctgatcggcaacggtggtgcagaattcggtgcccgcggcttcgtctctgccttcgacgcggaaaccagcaagctcgactggcgcttcttcaccgttccgaaccccgagaacaagccggacggcgcagcttccgacgacatcctgatgtccaaggcctacccgacctggggcaagaacggcgcctggaagcagcagggcggcggcggtaccgtctgggattcgctcgtctatgacccggtgacggacctcgtctacctgggcgtcggcaacggctcgccgtggaactacaagttccgctccgaaggcaagggcgacaacctcttcctgggcagcatcgtcgcgatcaatcctgacaccggcaagtatgtctggcacttccaggaaacgccgatggacgagtgggattacacctccgtccagcagatcatgacgctcgacatgccggtcaacggcgagatgcgccacgtcatcgtgcatgctccgaagaacggcttcttctacatcatcgatgcaaagaccggtaagttcatcaccggcaagccctacacctacgagaactgggccaacggcctggatccggttacgggtcgtccgaactacgtgcctgacgccctgtggaccctgacgggcaagccctggctcggcatcccgggtgagcttggtggccataacttcgccgccatggcctacagcccgaagacgaagctggtctacatcccggcacagcagatcccgctcctgtacgatggccagaaaggcggcttcaaggcgtaccatgacgcctggaacctcggcctcgacatgaacaagatcggtctcttcgacgacaatgatccggagcatgtggccgccaagaaggacttcctgaaggtcctgaagggctggacggttgcctgggatccggaaaagatggctccggccttcacgatcaaccacaagggtccgtggaacggtggtcttctggccacggccggtaacgtgatcttccagggtctggcaaacggcgaattccacgcctacgacgccacgaacggcaacgatctctattccttccccgcacagagcgcgatcatcgctccgccggtgacctatacggccaacggcaagcagtatgtcgcggttgaagtgggctggggtggcatctatccgttcctgtacggcggcgttgcccgcacctcgggctggacggtcaaccactcccgcgtgatcgccttctcgcttgacggcaaggacagcctgccgccgaagaacgagctgggcttcacccccgtcaagccggttccgacctatgacgaggcccgccagaaggacggatacttcatgtatcagacgttctgctcggcctgccatggcgacaacgcgatctccggtggcgttctgcctgaccttcgctggtccggtcgtccgcgcggaagggaaagcttctacaagctcgttggtcgcggtgctctgacggcttacggcatggaccgcttcgacacgtccatgacgcctgagcagatcgaggatatccgcaacttcatcgtgaagcgcgcaaacgaatcctacgacgacgaagtcaaggcacgtgaaaactcaactggcgttccgaacgatcagttcctcaatgtcccgcagtccacggccgatgttccgaccgcggatcacccctga

SEQ ID NO: 49886 - protein, 757 aa, Gluconobacter oxydans
MTSGLLTPIKVTKKRLLSCAAALAFSAAVPVAFAQEDTGTAITSSDNGGHPGDWLSYGRSYSEQRYSPLDQINTENVGKLKLAWHYDLDTNRGQEGTPLIVNGVMYATTNWSKMKALDAATGKLLWSYDPKVPGNIADRGCCDTVSRGAAYWNGKVYFGTFDGRLIALDAKTGKLVWSVYTIPKEAQLGHQRSYTVDGAPRIAKGKVLIGNGGAEFGARGFVSAFDAETSKLDWRFFTVPNPENKPDGAASDDILMSKAYPTWGKNGAWKQQGGGGTVWDSLVYDPVTDLVYLGVGNGSPWNYKFRSEGKGDNLFLGSIVAINPDTGKYVWHFQETPMDEWDYTSVQQIMTLDMPVNGEMRHVIVHAPKNGFFYIIDAKTGKFITGKPYTYENWANGLDPVTGRPNYVPDALWTLTGKPWLGIPGELGGHNFAAMAYSPKTKLVYIPAQQIPLLYDGQKGGFKAYHDAWNLGLDMNKIGLFDDNDPEHVAAKKDFLKVLKGWTVAWDPEKMAPAFTINHKGPWNGGLLATAGNVIFQGLANGEFHAYDATNGNDLYSFPAQSAIIAPPVTYTANGKQYVAVEVGWGGIYPFLYGGVARTSGWTVNHSRVIAFSLDGKDSLPPKNELGFTPVKPVPTYDEARQKDGYFMYQTFCSACHGDNAISGGVLPDLRWSGRPRGRESFYKLVGRGALTAYGMDRFDTSMTPEQIEDIRNFIVKRANESYDDEVKARENSTGVPNDQFLNVPQSTADVPTADHP

SEQ ID NO: 49887 - DNA, 2406 bp, Acinetobacter calcoaceticus
  CDS (1)..(2406)
atgaatcaacctacttcaagatcaggtttaacgacttttaccgtaattattattgggttactggcgttattcctgttaattggaggtatttggctcgctacactaggcggttcaatttactacattatagctggagtattactcctcattgttgcatggcaactctacaagcgtgcttctactgctttgtggttttatgctgcattaatgctaggtaccattatctggagtgtctgggaagttggaacagacttttgggcgcttgcaccacgtttagatattttaggtattcttggtttatggttattggttccggctgtaactcgtggaatcaacaaccttggatcaagtaaagttgccttatcttcaactttagcaattgcaatcgtgttgatggtttattctatcttcaatgatccgcaagaaattaatggtgaaatcaaaacacctcaaccagaaacagctcaagccgtgcctggtgttgctgaaagtgattggccagcttatggtcgtactcaagcaggcgtgcgttattctccattgaaacagatcaatgatcaaaacgtaaaagacttgaaagttgcttggactttacgtactggcgatcttaagacagataacgactctggcgaaacgactaatcaggttacaccgattaaaatcggtaataacatgtttatctgtacagctcaccagcagttaattgctattgatcctgctacaggtaaagaaaaatggcgttttgatccgaaacttaaaacggataaatcgttccagcatctaacttgtcgtggtgtgatgtactacgatgcaaacaatacaactgagtttgcaacgagtcttcaaagcaagaaatctagctctacacaatgtccacgtaaggtatttgtaccagtcaacgatggccgtttagtggctgtaaatgctgacactggtaaagcatgtactgactttggtcaaaatggtcaagtgaacttacaagagttcatgccatatgcttatccaggcggttataacccgacatctcctggtatcgtgactggttcaactgttgttattgctggttctgtaacagataactactcaaataaagagccatctggtgtgattcgtggatacgacgttaacactggtaaacttctttgggtatttgacactggcgcagcggatccaaatgcaatgccgggcgaaggtactacttttgttcacaactcaccaaatgcgtgggcacctttagcatacgatgccaaacttgacatcgtttatgtaccaacaggtgtaggtacaccagacatctggggtggtgaccgtaccgagctgaaagagcgttatgcaaactcaatgttagcgattaatgcttctactggtaaattagtgtggaacttccagacaacccatcacgatttatgggatatggatgtaccatcacaaccatctttagctgatatcaaaaacaaagctggccaaactgttcctgcaatctatgtattgacgaaaacaggtaatgcctttgtgcttgatcgccgtaatggtcaaccgattgttcctgtaactgagaaaccagttccacaaacagttaaacgtggaccacaaactaaaggtgagttctattcaaaaactcagccattctctgacttgaacttggcgccacaagataaattgactgataaagacatgtggggtgccactatgcttgatcagctcatgtgtcgtgtatctttcaaacgtctaaattacgatggtatttatacgccaccatctgaaaacggtactttagttttccctggtaacttaggtgtatttgaatggggcggtatgtcagttaaccctgatcgtcaggttgctgtaatgaacccgattggtctgccattcgtcagtcgtttaattcctgctgatccaaaccgtgcacaaactgcaaaaggtgcgggaactgagcagggcgtacaaccgatgtacggcgtaccatatggtgttgaaattagcgcattcttatctccgcttggtttaccttgtaaacaaccggcttggggctatgtagctggcgttgatttgaaaactcatgaagtggtatggaaaaaacgtattggtacaatccgtgacagtttaccgaacttgttccagttgccagctgtgaaaattggtgtgcctggtttaggtggttcaatttctactgccggtaatgtcatgtttgttggtgcaactcaagataactacttacgtgcgtttaacgttactaacggtaagaaactttgggaagcgcgtttaccagcaggtggacaagcaacaccaatgacttatgaaatcaatggtaagcaatatgttgtaatcatggctggtggtcatggttcatttggtacgaaaatgggcgactatttagtggcttatgccttaccagataacaaataa

SEQ ID NO: 49888 - protein, 801 aa, Acinetobacter calcoaceticus
MNQPTSRSGLTTFTVIIIGLLALFLLIGGIWLATLGGSIYYIIAGVLLLIVAWQLYKRASTALWFYAALMLGTIIWSVWEVGTDFWALAPRLDILGILGLWLLVPAVTRGINNLGSSKVALSSTLAIAIVLMVYSIFNDPQEINGEIKTPQPETAQAVPGVAESDWPAYGRTQAGVRYSPLKQINDQNVKDLKVAWTLRTGDLKTDNDSGETTNQVTPIKIGNNMFICTAHQQLIAIDPATGKEKWRFDPKLKTDKSFQHLTCRGVMYYDANNTTEFATSLQSKKSSSTQCPRKVFVPVNDGRLVAVNADTGKACTDFGQNGQVNLQEFMPYAYPGGYNPTSPGIVTGSTVVIAGSVTDNYSNKEPSGVIRGYDVNTGKLLWVFDTGAADPNAMPGEGTTFVHNSPNAWAPLAYDAKLDIVYVPTGVGTPDIWGGDRTELKERYANSMLAINASTGKLVWNFQTTHHDLWDMDVPSQPSLADIKNKAGQTVPAIYVLTKTGNAFVLDRRNGQPIVPVTEKPVPQTVKRGPQTKGEFYSKTQPFSDLNLAPQDKLTDKDMWGATMLDQLMCRVSFKRLNYDGIYTPPSENGTLVFPGNLGVFEWGGMSVNPDRQVAVMNPIGLPFVSRLIPADPNRAQTAKGAGTEQGVQPMYGVPYGVEISAFLSPLGLPCKQPAWGYVAGVDLKTHEVVWKKRIGTIRDSLPNLFQLPAVKIGVPGLGGSISTAGNVMFVGATQDNYLRAFNVTNGKKLWEARLPAGGQATPMTYEINGKQYVVIMAGGHGSFGTKMGDYLVAYALPDNK

SEQ ID NO: 49889 - DNA, 1881 bp, Methylobacterium extorquens
  CDS (1)..(1881)
atgagcaggtttgtgacatcagtctcggccttggcgatgctggcgctcgcgccggccgcgctgtcgagcggggcctacgccaacgataagctggtcgagctgtcgaagagcgacgacaactgggtgatgcccggaaagaactacgattcgaacaacttcagcgatctgaagcagatcaacaagggcaacgtgaagcagcttcggccggcttggacgttctcgaccggcctgctgaacggccacgagggtgcgccgctcgtcgtcgacggcaagatgtacatccacacctcgttcccgaacaacaccttcgctctcggccttgacgatccgggcacgatcctgtggcaggacaagccgaagcagaatccggccgcccgcgccgtcgcctgctgtgacctcgtcaaccgcggcctcgcctactggcccggcgacggcaagacccccgcgctgatcctcaagacccagctcgacggcaacgtggccgccctcaacgccgagaccggcgagacggtgtggaaggtcgagaactccgacatcaaggtcggctcgacgctcacgatcgccccctacgtcgtgaaggacaaggtcatcatcggctcctcgggcgccgagctcggcgtgcgcggctacctgaccgcctacgacgtgaagaccggcgagcaggtgtggcgcgcctacgccacgggtccggacaaggacctgctgctggcctccgacttcaacatcaagaacccccattacggtcagaagggcctcggcaccggcacctgggagggcgatgcctggaagatcggcggcggcaccaactggggctggtacgcctacgatccgggcacgaacctgatctacttcggcaccggcaacccggcgccgtggaacgagaccatgcgtccgggcgacaacaagtggacgatgacgatcttcggccgcgatgccgatacgggtgaagccaagttcggctaccagaagaccccgcacgacgagtgggactatgccggcgtcaacgtcatgatgctctccgagcagaaggacaaggacggcaaggcccgcaagctgctgacccacccggaccgcaacggcatcgtctacacgctcgaccggaccgacggcgcgctcgtctcggcgaacaagctcgacgacacggtcaacgtgttcaagtcggtggatctcaagacgggccagccggtgcgcgatcccgaatacggcacccggatggaccacctcgccaaggacatctgcccctcggcgatgggttaccacaaccagggtcacgactcgtacgatccgaagcgtgaactgttcttcatgggcatcaaccacatctgcatggattgggagcccttcatgcttccctatcgtgcgggtcagttcttcgtcggtgcgacgctgaacatgtatccgggcccgaagggcgaccgtcagaactacgaaggtctcggccagatcaaggcatacaacgcgatcaccggcgactataagtgggagaagatggagcgcttcgccgtgtggggcggcaccatggccaccgcgggcgacctcgtcttctacggcacgctcgacggctacctgaaggcacgcgactccgacacgggtgaccttctctggaagttcaagatcccgtccggcgccatcggctacccgatgacctacacccacaagggcacgcaatacgtcgccatctactacggcgtcggcggctggccgggtgtcggcctcgtgttcgacctcgccgatccgaccgccggtctcggcgcggtgggcgccttcaagaaactcgccaactacacccagatgggtggcggcgtggtggtgttctcgctcgacggcaagggtccctacgacgatccgaacgtcggcgagtggaagtcggccgccaagtaa

SEQ ID NO: 49890 - protein, 626 aa, Methylobacterium extorquens
MSRFVTSVSALAMLALAPAALSSGAYANDKLVELSKSDDNWVMPGKNYDSNNFSDLKQINKGNVKQLRPAWTFSTGLLNGHEGAPLVVDGKMYIHTSFPNNTFALGLDDPGTILWQDKPKQNPAARAVACCDLVNRGLAYWPGDGKTPALILKTQLDGNVAALNAETGETVWKVENSDIKVGSTLTIAPYVVKDKVIIGSSGAELGVRGYLTAYDVKTGEQVWRAYATGPDKDLLLASDFNIKNPHYGQKGLGTGTWEGDAWKIGGGTNWGWYAYDPGTNLIYFGTGNPAPWNETMRPGDNKWTMTIFGRDADTGEAKFGYQKTPHDEWDYAGVNVMMLSEQKDKDGKARKLLTHPDRNGIVYTLDRTDGALVSANKLDDTVNVFKSVDLKTGQPVRDPEYGTRMDHLAKDICPSAMGYHNQGHDSYDPKRELFFMGINHICMDWEPFMLPYRAGQFFVGATLNMYPGPKGDRQNYEGLGQIKAYNAITGDYKWEKMERFAVWGGTMATAGDLVFYGTLDGYLKARDSDTGDLLWKFKIPSGAIGYPMTYTHKGTQYVAIYYGVGGWPGVGLVFDLADPTAGLGAVGAFKKLANYTQMGGGVVVFSLDGKGPYDDPNVGEWKSAAK

SEQ ID NO: 49891 - DNA, 1722 bp, Methylophilus methylotrophus
  CDS (1)..(1722)
atggcagatgcagacctggacaagcaggtgaatacagccggtgcttggccaattgcaacgggtggctactacagccagcacaacagtccgctggcacaaattaacaaatccaacgttaaaaacgtcaaagcagcctggtcattttcaacgggtgtcttgaatggtcacgaaggtgcgccattggtcatcggtgacatgatgtatgtgcactccgcttttccaaacaatacttatgcgctgaatctgaacgatccaggcaagattgtctggcaacacaagcctaagcaagatgcttccaccaaagccgtgatgtgctgtgacgtggttgaccgtggtctggcttacggcgcggggcaaattgttaaaaaacaagccaacggtcacttgctggcgttggatgccaaaactggcaaaatcaactgggaagtagaagtgtgtgatccaaaagtgggttcaacactgacacaagcgccttttgtggctaaagacacggtattgatggggtgttcaggtgctgagctgggtgtacgtggtgctgtgaacgcctttgacctgaaaacaggtgaattgaaatggcgtgcatttgcaaccggttctgatgactctgttcgcctggccaaagacttcaacagtgcaaacccacattacggtcaattcggcctggggactaaaacctgggaaggcgatgcctggaaaattggtggcggtaccaactggggttggtatgcctatgaccctaaattgaacctgttctactacggttcaggtaacccggccccatggaacgaaaccatgcgtcctggcgacaacaagtggacgatgaccatctggggtcgtgacctcgacaccggcatggcgaaatggggctaccaaaaaacgccgcatgatgagtgggactttgctggtgtgaatcagatggtgctgactgatcaaccagtcaacggcaaaatgacgccgctgctgagccacatcgaccgtaacggtatcttgtacacactgaaccgcgaaaacggcaacctgatcgtggctgaaaaagtggacccggctgtcaacgtgttcaaaaaagtggacctgaaaactgggacaccagtccgtgacccggaattcgcgacacgtatggaccataaaggcaccaacatttgtccatccgcgatgggcttccacaaccagggtgttgactcttacgatccagaaagccgcaccttgtacgctggcctgaaccacatttgtatggattgggagccgttcatgctgccataccgtgccggtcagttcttcgttggtgcaacgctggcgatgtaccctggcccgaacggcccaaccaagaaagaaatgggtcagattcgtgcatttgacctgaccactggtaaagctaaatggactaagtgggagaaattcgcggcttggggcggtactttgtacaccaaaggtggcctggtttggtatgcaacgctggatggttacctgaaagccttggataacaaagacggtaaagagctgtggaacttcaagatgccatctggtggtatcggatcgccaatgacttactcctttaaaggcaagcaatacatcggcagcatgtacggtgttggcggctggcctggcgtgggtctggtgtttgacctgacagacccgagtgctggtttgggtgcggtgggtgcgttcagagaactgcaaaaccacacacaaatgggcggtggcctgatggtgttcagcctgtaa

SEQ ID NO: 49892 - protein, 573 aa, Methylophilus methylotrophus
MADADLDKQVNTAGAWPIATGGYYSQHNSPLAQINKSNVKNVKAAWSFSTGVLNGHEGAPLVIGDMMYVHSAFPNNTYALNLNDPGKIVWQHKPKQDASTKAVMCCDVVDRGLAYGAGQIVKKQANGHLLALDAKTGKINWEVEVCDPKVGSTLTQAPFVAKDTVLMGCSGAELGVRGAVNAFDLKTGELKWRAFATGSDDSVRLAKDFNSANPHYGQFGLGTKTWEGDAWKIGGGTNWGWYAYDPKLNLFYYGSGNPAPWNETMRPGDNKWTMTIWGRDLDTGMAKWGYQKTPHDEWDFAGVNQMVLTDQPVNGKMTPLLSHIDRNGILYTLNRENGNLIVAEKVDPAVNVFKKVDLKTGTPVRDPEFATRMDHKGTNICPSAMGFHNQGVDSYDPESRTLYAGLNHICMDWEPFMLPYRAGQFFVGATLAMYPGPNGPTKKEMGQIRAFDLTTGKAKWTKWEKFAAWGGTLYTKGGLVWYATLDGYLKALDNKDGKELWNFKMPSGGIGSPMTYSFKGKQYIGSMYGVGGWPGVGLVFDLTDPSAGLGAVGAFRELQNHTQMGGGLMVFSL

SEQ ID NO: 49893 - DNA, 1881 bp, Methylobacterium organophilum XX
  CDS (1)..(1881)
atgagcaggtttgtgacatcggtctcggcattggcgatgctggcgctcgcgcccgccgcgctgtcgagcgtggcctacgccaatgacaagctcgtcgagctctcgaagagcgacgacaactgggtcatgcccggcaagaactacgactcgaacaactacagcgagctcaagcaggtcaacaagagcaacgtgaagcagctccggccggcctggaccttctccaccggcctgctcaacggccacgagggcgctccgctggtcgtggacggcaagatgtacgtccacacctcgttcccgaacaacaccttcgccctcgacctcgacgatccgggccacatcctgtggcaggacaagccgaagcagaacccggccgcccgcgcggtcgcctgctgcgacctcgtcaatcgcggcctcgcctactggccgggcgacggcaagaccccggccctgatcctcaagacccagctcgaccggcacgtcgtggcgctcaacgccgagaccggcgagaccgtgtggaaggtcgagaattccgacatcaaggtcggctcgacgctcaccatcgccccctacgtcgtcaaggacaaggtcatcatcggctcctcgggcgccgagctcggcgtgcgcggctacctgaccgcctacgacgtgaagaccggcggccaggtctggcgcgcctacgccaccggcccggacaaggacctgctgctggccgacgacttcaacgtcaagaacgcccattacggccagaagggcctgggcaccgcgacctgggagggcgacgcctggaagatcggcggcggcaccaactggggctggtacgcctacgatccgggcacgaacctgatctatttcggcaccggcaacccggcgccgtggaacgagaccatgcgtcccggcgacaacaagtggacgatgacgatcttcggccgcgacgccgacaccggcgaggccaagttcggctaccagaagaccccgcacgacgagtgggactatgccggcgtcaacgtcatgatgccctccgagcagaaggacaaggacggcaagacccgcaagctgctgacccatccggaccgcaacggcatcgtctacaccctcgaccgcaccgacggcgcgctggtctcggccaacaagctcgacgacacggtcaacgtgttcaagacggtcgacctgaagaccggccagccggtgcgcgatccggaatacggcacccggatggaccacctcgccaaggacgtctgcccctccgcgatgggctaccacaaccagggccacgattcgtacgatccgaagcgtgagctcttcttcatgggcatcaaccacatctgcatggattgggagcccttcatgctgccctaccgggcgggtcagttcttcgtgggcgccacgctgaacatgtatccgggcccgaagggcgaccgtcagaactacgaaggtctcggccagatcaaggcgtacaacgcgatcaccggcagctataagtgggagaagatggagcgcttcgcggtgtggggcggaaccctcgccaccgccggcgacctggtcttctacggcacgctcgacggctacctgaaggcgcgcgactccgacacgggcgacctcctctggaagttcaagatcccgtcgggcgccatcggctatccgatgacctacacccacaagggcacgcagtacgtcgccatctattacggcgtcggcggctggccgggcgtgggcctggtgttcgacctcgccgacccgaccgccggtctcggcgcggtgggcgccttcaagaagctcgccaactacacccagcagggtggcggcgtgatcgtcttctccctcgacggcaagggtccctacgacgacccgaatgtcggcgagtggaagtcggcctccaagtaa

SEQ ID NO: 49894 - protein, 626 aa, Methylobacterium organophilum XX
MSRFVTSVSALAMLALAPAALSSVAYANDKLVELSKSDDNWVMPGKNYDSNNYSELKQVNKSNVKQLRPAWTFSTGLLNGHEGAPLVVDGKMYVHTSFPNNTFALDLDDPGHILWQDKPKQNPAARAVACCDLVNRGLAYWPGDGKTPALILKTQLDRHVVALNAETGETVWKVENSDIKVGSTLTIAPYVVKDKVIIGSSGAELGVRGYLTAYDVKTGGQVWRAYATGPDKDLLLADDFNVKNAHYGQKGLGTATWEGDAWKIGGGTNWGWYAYDPGTNLIYFGTGNPAPWNETMRPGDNKWTMTIFGRDADTGEAKFGYQKTPHDEWDYAGVNVMMPSEQKDKDGKTRKLLTHPDRNGIVYTLDRTDGALVSANKLDDTVNVFKTVDLKTGQPVRDPEYGTRMDHLAKDVCPSAMGYHNQGHDSYDPKRELFFMGINHICMDWEPFMLPYRAGQFFVGATLNMYPGPKGDRQNYEGLGQIKAYNAITGSYKWEKMERFAVWGGTLATAGDLVFYGTLDGYLKARDSDTGDLLWKFKIPSGAIGYPMTYTHKGTQYVAIYYGVGGWPGVGLVFDLADPTAGLGAVGAFKKLANYTQQGGGVIVFSLDGKGPYDDPNVGEWKSASK

SEQ ID NO: 49895 - DNA, 1896 bp, Paracoccus denitrificans
  CDS (1)..(1896)
atgaacaggaacaccccgaaggcaaggggcgcgtcgagccttgcgatggccgtggccatgggccttgccgtcctgacgaccgcgccggcgaccgccaatgaccagttggtcgaactggccaaggaccccgcgaactgggtcatgaccgggcgcgactacaacgcgcagaactattccgagatgaccgacatcaacaaggagaacgtcaagcagctgcggcccgcctggtcgttctcgaccggggtgctgcatgggcacgaaggtacgccgctggtcgtcggcgaccggatgttcattcacacgcccttcccgaacaccaccttcgcgctggacctgaacgagccgggcaagatcctgtggcagaacaagcccaagcagaaccccacggcccggactgtggcctgctgcgacgtggtcaaccgcggcctggcctattggccgggcgacgatcaggtcaagccgctgatcttccgcacccagctcgacggccatatcgtcgccatggatgccgagaccggcgagacgcgctggatcatggagaactcggacatcaaggtcggctcgaccctgaccatcgcgccctatgtcatcaaggacctggtgctggtcggctcctcgggcgccgagctgggcgtgcgcggctatgtcaccgcctatgacgtgaaatcgggcgagatgcgctggcgcgcctttgccaccggcccagacgaggaattgctgctggccgaggacttcaacgccccgaacccgcattacggccagaagaacctgggcctggagacctgggagggcgacgcctggaagatcggcggcggcaccaactggggctggtatgcctatgaccccgaggtggacctgttctactacggctcgggcaaccccgcgccctggaacgagaccatgcgtccgggcgacaacaagtggaccatggcgatctggggccgcgaggccaccaccggcgaggcgaaattcgcctatcagaagacgccgcatgacgaatgggactatgccggcgtcaacgtgatgatgctgtcggaacaggaggacaagcagggccagatgcgcaagcttctgacccacccggaccgcaacggcatcgtctacacgctggaccgcaccaatggcgacctgatctcggccgacaagatggacgacacggtcaactgggtgaaggaggtgcagctggataccggcctgccggtgcgcgacccggaattcggcacgcgcatggaccacaaggcccgcgacatctgtccctcggcgatgggctatcacaaccagggccatgacagctacgaccccgagcgcaaggtgttcatgctgggcatcaaccacatctgcatggattgggagcccttcatgctgccctatcgcgccggccagttcttcgtcggcgccacgctgaccatgtatccgggccccaaggcgaccgcagaacgcgctggggctgggcagatcaaggcctacgacgccatctcgggcgagatgaaatgggaaaagatggagcgcttctcggtctggggcggcaccatggccaccgcgggcgggctgaccttttacgtcacgctggacggcttcatcaaggcccgcgacagcgacaccggcgacctgctgtggaagttcaagctgccctcgggcgtgatcggccatccgatgacctacaagcatgacggccggcaatatgtcgcgatcatgtatggagtcggcggctggccgggcgtgggtctggtcttcgacctggccgacccgaccgccggtctgggctcggtgggcgcgttcaagcggctgcaggagttcacccagatgggcggcggcgtgatggtcttctcgcttgacggcgagagcccctattccgacccgaacgtgggcgaatacgcgccgggtgagcccacctga

SEQ ID NO: 49896 - protein, 631 aa, Paracoccus denitrificans
MNRNTPKARGASSLAMAVAMGLAVLTTAPATANDQLVELAKDPANWVMTGRDYNAQNYSEMTDINKENVKQLRPAWSFSTGVLHGHEGTPLVVGDRMFIHTPFPNTTFALDLNEPGKILWQNKPKQNPTARTVACCDVVNRGLAYWPGDDQVKPLIFRTQLDGHIVAMDAETGETRWIMENSDIKVGSTLTIAPYVIKDLVLVGSSGAELGVRGYVTAYDVKSGEMRWRAFATGPDEELLLAEDFNAPNPHYGQKNLGLETWEGDAWKIGGGTNWGWYAYDPEVDLFYYGSGNPAPWNETMRPGDNKWTMAIWGREATTGEAKFAYQKTPHDEWDYAGVNVMMLSEQEDKQGQMRKLLTHPDRNGIVYTLDRTNGDLISADKMDDTVNWVKEVQLDTGLPVRDPEFGTRMDHKARDICPSAMGYHNQGHDSYDPERKVFMLGINHICMDWEPFMLPYRAGQFFVGATLTMYPGPKATAERAGAGQIKAYDAISGEMKWEKMERFSVWGGTMATAGGLTFYVTLDGFIKARDSDTGDLLWKFKLPSGVIGHPMTYKHDGRQYVAIMYGVGGWPGVGLVFDLADPTAGLGSVGAFKRLQEFTQMGGGVMVFSLDGESPYSDPNVGEYAPGEPT

SEQ ID NO: 49897 - DNA, 2127 bp, Comamonas testosteroni
  CDS (1)..(2127)
atggaacggctgatcgacaactctcatggatggccgggccgcatggtctggctgctggccgcctgcctgggcagcgcagcggctttcgcgcaaaccggccctgcagcgcaggctgctgctgccgtgcagcgcgtcgacggcgatttcatccgcgccaatgccgccaggacgcctgactggcccaccatcggcgtggactatgccgagacccgctacagccgcctcgatcagatcaatgccgccaacgtcaaggacctgggcctggcatggtcgtacaacctcgagtccacgcgcggcgtggaggccacgcctgtcgtggtggacggcatcatgtatgtcagcgcctcatggagcgtggtgcatgccatcgacacccgtaccggcaacaggatctggacctatgacccgcagatcgaccgcagcaccggcttcaaggggtgctgcgacgtcgtcaaccgcggcgtggcgctgtggaagggcaaggtctatgtgggggcgtgggatggccgcctgatcgcgctggatgccgccaccggcaaggaggtctggcaccaaaataccttcgaggggcagaaggggtcgctcaccatcaccggcgccccgcgcgtgttcaagggcaaggtcatcatcggcaaacgcggcgccgaatatggcgtgcgcggctatatcactgcctatgacgccgagaccggggagcggaaatggcgctggttcagcgtacccggcgatccctccaaacccttcgaggacgagtccatgaagcgcgccgccaggacctgggaccccagcggcaaatggtgggaggccggcggcggcggcaccatgtgggacagcatgaccttcgatgccgaactcaacaccatgtacgtgggcacgggcaatggatcgccctggtcgcacaaggtgcgcagccccaagggcggcgacaacctgtacctggcctccatcgtggccctggatcccgacaccggcaaatacaagtggcactatcaggaaacaccgggcgacaactgggactacacctccacccagcccatgatcctggccgacatcaagatcgccggcaagccgcgcaaggtcatactgcatgcgcccaagaacggcttcttcttcgtgctcgaccgcaccaatggaaagttcatctcggccaagaacttcgtgcccgtgaactgggccagcggctacgacaagcacggcaagcccatcggcattgccgcagcgcgcgacggcagcaagccccaggacgcggtgccgggcccctatggcgcgcacaactggcaccccatgtccttcaacccccagacgggcctggtgtatctgcctgcgcagaacgtgcccgtcaacctgatggacgacaagaaatgggagttcaaccaggccggaccgggcaagccccagtcgggcaccggctggaacacggccaagttcttcaatgccgagccgcccaagagcaagccctttggtcgtctgctggcctgggaccccgttgcgcaaaaggccgcctggagcgtggagcatgtctcgccctggaacggcggcacgctgaccacggcgggcaatgtggtgttccagggaacggctgatggccgcctcgtggcctatcacgcggccacgggcgagaaactgtgggaagcgcccacgggcaccggtgtggtggccgcgcccagcacctatatggtggacggcaggcagtatgtctcggtggccgtgggctggggcggtgtctacggtctggctgcgcgcgccaccgagcgccagggcccgggcacggtctataccttcgtcgtggccggcaaggccaggatgccggagttcgtggcccagcgcaccggccagttgctgcagggcgtgaaatacgaccccgccaaggtcgaggccggcaccatgctgtatgtggccaactgcgttttctgtcacggcgtgcctggcgtggaccgtggcggaaacattcccaatctgggttacatggacgcgagctatatcgagaacctgccaaactttgtcttcaagggcccggccatggtgcgcggcatgccggacttcacgggcaagttgtcgggcgatgacgtggagtccctcaaggccttcatccagggcacggcggacgccatccggcccaagccctga

SEQ ID NO: 49898 - protein, 708 aa, Comamonas testosteroni
MERLIDNSHGWPGRMVWLLAACLGSAAAFAQTGPAAQAAAAVQRVDGDFIRANAARTPDWPTIGVDYAETRYSRLDQINAANVKDLGLAWSYNLESTRGVEATPVVVDGIMYVSASWSVVHAIDTRTGNRIWTYDPQIDRSTGFKGCCDVVNRGVALWKGKVYVGAWDGRLIALDAATGKEVWHQNTFEGQKGSLTITGAPRVFKGKVIIGKRGAEYGVRGYITAYDAETGERKWRWFSVPGDPSKPFEDESMKRAARTWDPSGKWWEAGGGGTMWDSMTFDAELNTMYVGTGNGSPWSHKVRSPKGGDNLYLASIVALDPDTGKYKWHYQETPGDNWDYTSTQPMILADIKIAGKPRKVILHAPKNGFFFVLDRTNGKFISAKNFVPVNWASGYDKHGKPIGIAAARDGSKPQDAVPGPYGAHNWHPMSFNPQTGLVYLPAQNVPVNLMDDKKWEFNQAGPGKPQSGTGWNTAKFFNAEPPKSKPFGRLLAWDPVAQKAAWSVEHVSPWNGGTLTTAGNVVFQGTADGRLVAYHAATGEKLWEAPTGTGVVAAPSTYMVDGRQYVSVAVGWGGVYGLAARATERQGPGTVYTFVVAGKARMPEFVAQRTGQLLQGVKYDPAKVEAGTMLYVANCVFCHGVPGVDRGGNIPNLGYMDASYIENLPNFVFKGPAMVRGMPDFTGKLSGDDVESLKAFIQGTADAIRPKP

SEQ ID NO: 49899 - DNA, 2373 bp, Xanthomonas campestris
  CDS (1)..(2373)
atgctgatcgcgctggtggggctgatctttctgctgggtggcgcgaggttggccagcctgggcggcagctggtacttcctgctgatgggcctggcgaccgctttggccggtgtcttgatcgtgctgcgtcggccggccggtgcgctggtgtacggcgtcgccttcgcgctgacgctggtgtgggcgctgtgggatgcggggctggagttctggccgctggtctcgcggctgatgctgcctgcggcgttcgccgtgctggtggcactggcctggccagcgctgcggcgcagccgggcgttgccgaccgggcgcaccgcctatggcgtggcgacggtgctggcgctggcggtagtggccgggatcggcggcatgttcgtgccgcatccgccggtcgcaggcaacgcggggccgggcatgacggcggtgccgcctggaagcgtgcaacagaactggtccgcctacggcaataccgatggcggcagccgctttgctgcgctggaccagatcaaccgcagcaacggtcgaccggctgcagggtcgcctggacctaccacaccgggggagatcgccaacagcgacggcaacggtgccgaagaccagttgaccccgctgcaggtgggcgagaaggtgttcctgtgcacaccgcacaacaatctgattgcgctcgacgccagcaccggcaagcagctgtggcggcgcgagatcaatgcgacctcgtcggtctggcagcgctgccgtggcctgggctacttcgacgccgacgcggcgttgccggcaccgagcgtggccaatccctcgccgatcgccgcagtgaccgtggcgcagggcgccaactgccgtcgccgcctgttcaccaacaccatcgatggtcgcctgatcgcggtggatgcggacaccggcgcgttctgccagggcttcggcagcaacggtcaggtcgatctcaaggccggcctgggcgctgcgccggatccgttctaccagctgacttcgccgccactggtggccggcaccaccgttgttggtgggcggacgcgtgccgacgacaacgtgcagaccgacatgcctggtggcgtggtgcgcggttcgatgtggtcaccggtgcgcagcgctgggcttgacccgggcaatccgcacgatcgccaggcgccggccgccggcagcagctatgtgcgcagcacgccgaacgtatgggcaccgatgtcttacgacgcggcgatgaacaccgtgttcctgccgctgggcgggccgtcgaccgatctgtacggcgccgagcgcaccgcgctcgatcatcgttacggcgcctcggtgctggcgctggatgccaccaccggtgcggagaagtgggtctaccagaccgtgcacaacgatctgtgggacttcgacctaccgatgcagcccagcctgatcgacttccccaaccaggacggcagccacaccccggcggtggtcatcggcaccaaggccgggcagatctacgtgctcgaccgcgccaccggcaaaccgcttaccgaggtcagggaagtgccggtgaaaggctcggatattgcacacgagcagtacgcaccgacccagccgctgtcggtcggcatgccgcagatcggcaccaagcacctgaccgaatcggacatgtggggcgccactgcgatggaccagatgctgtgccgcatcgcgttcaagcagatgcgttatgaaggcttgtacaccgcgccgggcaccgatgtctcgctgagtttccccggctcgctgggcggcatgaactggggaggcctgtcgaccgacccggtgcatgacgtcgtcttcgccaacgacatgcgcctgggcttgtgggtgcagatgattcctgccgacacccgcaaggccgaggcggccggtggtggcgaggccgtcaataccggcatgggcgccgtgccgctgaagggcacgccgtatgcggtcaacaagaaccgcttcctgtcggcgctgggcattccgtgccaggcgccgccgtacggcacgctcagcgcgatcgacctcaagacgcgcagcatcgcctggcaggtgccggtggggacggtgcaggacaccggcccgttcggcatcaagatgcatctgccgatcccgatcggcatgccgacgctgggcggcacgctgtccacccagggcgggctcgtgttcatcgccggcacccaggactactacctgcgcgcgttcgacagtgccaccggcaaggaactctggaagggccgcttgccggtcggcagtcagggcgggccgattacctacgtctcgcacaagaccggcaagcagtacgtggtgatcagtgccggcggtgcgcggcagtcgcccgatcgtggcgattacgtgatcgcctacagcttgcctgacgcgcactga

SEQ ID NO: 49900 - protein, 790 aa, Xanthomonas campestris
MLIALVGLIFLLGGARLASLGGSWYFLLMGLATALAGVLIVLRRPAGALVYGVAFALTLVWALWDAGLEFWPLVSRLMLPAAFAVLVALAWPALRRSRALPTGRTAYGVATVLALAVVAGIGGMFVPHPPVAGNAGPGMTAVPPGSVQQNWSAYGNTDGGSRFAALDQINRSNGRPAAGSPGPTTPGEIANSDGNGAEDQLTPLQVGEKVFLCTPHNNLIALDASTGKQLWRREINATSSVWQRCRGLGYFDADAALPAPSVANPSPIAAVTVAQGANCRRRLFTNTIDGRLIAVDADTGAFCQGFGSNGQVDLKAGLGAAPDPFYQLTSPPLVAGTTVVGGRTRADDNVQTDMPGGVVRGSMWSPVRSAGLDPGNPHDRQAPAAGSSYVRSTPNVWAPMSYDAAMNTVFLPLGGPSTDLYGAERTALDHRYGASVLALDATTGAEKWVYQTVHNDLWDFDLPMQPSLIDFPNQDGSHTPAVVIGTKAGQIYVLDRATGKPLTEVREVPVKGSDIAHEQYAPTQPLSVGMPQIGTKHLTESDMWGATAMDQMLCRIAFKQMRYEGLYTAPGTDVSLSFPGSLGGMNWGGLSTDPVHDVVFANDMRLGLWVQMIPADTRKAEAAGGGEAVNTGMGAVPLKGTPYAVNKNRFLSALGIPCQAPPYGTLSAIDLKTRSIAWQVPVGTVQDTGPFGIKMHLPIPIGMPTLGGTLSTQGGLVFIAGTQDYYLRAFDSATGKELWKGRLPVGSQGGPITYVSHKTGKQYVVISAGGARQSPDRGDYVIAYSLPDAH

SEQ ID NO: 49901 - DNA, 1803 bp, Paracoccus denitrificans
  CDS (1)..(1803)
atgaaaaacctaatgaatggcgcctgccttgcgctgctcatgtccggcactgcggcgctggccaatgaacagcgtgctggccgagatcgccaagccccgcaatgggcgatccagatgggcgattacgcgaacacgcgatattcgaccctggaccagatcaacaaggacaacgtcaaggatctgcgcgtcgcctggaccttctcgaccggggtgctgcgcggacacgaaggctcgccgctggtgatcggcgatgtcatgtatgtccacaccccctttccgaaccgggtgtttgcgctggacctgaacgacaacggcaagatcctgtggcgctatgaaccgcagcaggatccgaacgtaattgcggtgatgtcctgcgacacggtctatcgcggcctttcctatgcggacggcatgatcctgctgggccaggccgacaccacggtcgtggccctggacgccacgagcggcgaggtgaaatggtcgaccaagatcggcgacccgggcatcggcgagacgctgaccgccaccgtcgttccggtcaaggacaaggtcctggtcggcatctcgggcggcgaatacggcgtgcgcggccggatgaccgcgctgaacctcaccgatggcagcgaggcctggaaagcctggtccaccggcccggacgaggagttgctggtcgatcccgaaacgaccacgcatctgggcaagcccatcggcgccgacagctcgctcaacagctgggaaggcgatcagtggcagatcggcggcggcacgatctggggctggttctcgtatgacccggacctgaacctggtctattacggcaccggcaacccctcgacctggaacccctcgcagcggccgggcgacaacaagtggtcgatgacgatcatggcgcgggatgccgataccggcatggccaagtggttctatcagatgacgccccatgacgaatgggactatgacggcgtcaacgagatgatcctgaccaaccagaccgtcgacgggcaagagcgcaagctgctgacccatttcgaccgcaacggcctggcctatacgatggatcgcgagaccggcgagttgctggtggccgagaaatacgatccggtggtgaactggaccaccggcgtcgacatggacccgaattcggaaacctatggccgtccggccgtggtggccgaatactcgaccgcccagaacggcgaggacgagaacaccaccggcgtctgccctgcggcactgggcaccaaggaccagcagccggcggccttctcgcccaagaccaacctgttctatgtgccgacgaaccacgtctgcatggattacgagccgttccgggtggcctataccgccggccagccctatgtcggcgccacgctgtccatgtatcccgcgccgaacagccatggcggcatgggcaacttcatcgcctggcacaacaccacgggcgagatcaagtggtccgttcccgagcagttctcggtctggtcgggcgctttggctacggcgggcgacgtggtcttctacggcacgttggagggctatctgaagcccgtcgatgcccagacgggcgaggagctttacaagttcaagaccccctcgggcatcatcggcaacgtgatgacctacgaacatggcggcaagcagtatgtcggcatcctgtcgggtgtcggcggctgggccgggatcggccttgccgcgggcctgaccaatcccaacgatgggcttggcgcggtgggcggctatgcctcgctgtcgcaatataccgagctgggcggccagctgaccgtgttcgaactgccgggctaa

SEQ ID NO: 49902 - protein, 600 aa, Paracoccus denitrificans
MKNLMNGACLALLMSGTAALANEQRAGRDRQAPQWAIQMGDYANTRYSTLDQINKDNVKDLRVAWTFSTGVLRGHEGSPLVIGDVMYVHTPFPNRVFALDLNDNGKILWRYEPQQDPNVIAVMSCDTVYRGLSYADGMILLGQADTTVVALDATSGEVKWSTKIGDPGIGETLTATVVPVKDKVLVGISGGEYGVRGRMTALNLTDGSEAWKAWSTGPDEELLVDPETTTHLGKPIGADSSLNSWEGDQWQIGGGTIWGWFSYDPDLNLVYYGTGNPSTWNPSQRPGDNKWSMTIMARDADTGMAKWFYQMTPHDEWDYDGVNEMILTNQTVDGQERKLLTHFDRNGLAYTMDRETGELLVAEKYDPVVNWTTGVDMDPNSETYGRPAVVAEYSTAQNGEDENTTGVCPAALGTKDQQPAAFSPKTNLFYVPTNHVCMDYEPFRVAYTAGQPYVGATLSMYPAPNSHGGMGNFIAWHNTTGEIKWSVPEQFSVWSGALATAGDVVFYGTLEGYLKPVDAQTGEELYKFKTPSGIIGNVMTYEHGGKQYVGILSGVGGWAGIGLAAGLTNPNDGLGAVGGYASLSQYTELGGQLTVFELPG

SEQ ID NO: 49903 - DNA, 24 bp, Primer
atggcaattaacaatacaggctcg

SEQ ID NO: 49904 - DNA, 23 bp, Primer
ttacttcacatcatccggcagcg

SEQ ID NO: 49905 - protein, 793 aa, consensus
  MISC_FEATURE (1)..(793): consensus for the disclosure of xaa see table XV
WXXXXXXXXXXXXSXLXXIXXXNVXXLXXAWXXXXXXXXXXXXXXXXXXXXXXXXXXXXXPXXXXXXXYXXXXXXXXXXXXXXAXXXXXGXXXWXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXAXXXXXGXXXXXXXXXXXXXXXXXXXXXXXXXXXXXXXXPXXXXXXXXXGXXXXXXXXXXXXXXXXXXXGXXXXXXXXXGXXXWXXXXXXXXXXXXXXXXXXXXXXXXXXXXXXXXXXXXXXXXXXXXXXXXXXXXXXXXXXXXXXXXXXXXXXXXXXXXXXXXWXXXXXDXXXXXXXXXXGNXXPXXXXXXXXXXXXXXXXXXXXXXXXXXXXXAXXXXTGXXXWXXQXXXXDXWDXXXXXXXXXXXXXXXXXGXXXXXXXXXXXXGXXXXXDRXXGXXXXXXXXXXXXXXXXXXXXXXXXXXXXXXXXXXXXXXXXXXXXXXXXDXXXXXXXXXXXXXXXXXXXXXXXXXXXXXXXXXXXXXXPXXXGXXXXXXXXXXPXXXXXXXXXXXXXXXXXXXXXXXXXXXXXXXXXXXXXXXXXXXXXXXXXXXXXGXXXXXXXXXXXXXXXXXXXXXXXXXXXXXXXXGXXXAXDXXXXXXXXXXXXXXXXXXXXXXXXXXXXXXXXXXXXXXXXGXXXTXGXXXFXXXXXXXXXXAXXXXXGXXLWXXXXXXXGXXXXPXXXXXXXXGXQYXXXXXG

SEQ ID NO: 49906 - protein, 81 aa, consensus
  MISC_FEATURE (1)..(81): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXW

SEQ ID NO: 49907 - protein, 95 aa, consensus
  MISC_FEATURE (1)..(95): consensus for the disclosure of xaa see table XV
XXXXXXXXXXXXXXXXXGXXXXXXXXXXXXXXXXXXXXXXXXXXXXXXXXXXXXXXXXXXXXXXXXXXXXXXXXXXXXXXXXXXXXXXXXGXXXW

SEQ ID NO: 49908 - protein, 119 aa, consensus
  MISC_FEATURE (1)..(119): consensus for the disclosure of xaa see table XV
WXXXXXDXXXXXXXXXXXXXXXXXXXXXXXXXXXXXXXXXXXXXXXXXXXXXXXXXXXXGXXXXXXXXXXXXXXDXXXXXXXXXXXXXXXXXXXXXXXXXXXXXXXXXXXXXXXXXXXX

SEQ ID NO: 49909 - protein, 63 aa, consensus
  MISC_FEATURE (1)..(63): consensus for the disclosure of xaa see table XV
XXXXTXXXXXXXXXXXXXXXXXXXXXXGXXXXXXXXXXXXXXXXXXXXXXXXXGXXXXXXXXX

SEQ ID NO: 49910 - DNA, 2535 bp, Escherichia coli
  CDS (1)..(2535)
atggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaa

SEQ ID NO: 49911 - protein, 844 aa, Escherichia coli
MAGNDREPIGRKGKPTRPVKQKVSRRRYEDDDDYDDYDDYEDEEPMPRKGKGKGKGRKPRGKRGWLWLLLKLAIVFAVLIAIYGVYLDQKIRSRIDGKVWQLPAAVYGRMVNLEPDMTISKNEMVKLLEATQYRQVSKMTRPGEFTVQANSIEMIRRPFDFPDSKEGQVRARLTFDGDHLATIVNMENNRQFGFFRLDPRLITMISSPNGEQRLFVPRSGFPDLLVDTLLATEDRHFYEHDGISLYSIGRAVLANLTAGRTVQGASTLTQQLVKNLFLSSERSYWRKANEAYMALIMDARYSKDRILELYMNEVYLGQSGDNEIRGFPLASLYYFGRPVEELSLDQQALLVGMVKGASIYNPWRNPKLALERRNLVLRLLQQQQIIDQELYDMLSARPLGVQPRGGVISPQPAFMQLVRQELQAKLGDKVKDLSGVKIFTTFDSVAQDAAEKAAVEGIPALKKQRKLSDLETAIVVVDRFSGEVRAMVGGSEPQFAGYNRAMQARRSIGSLAKPATYLTALSQPKIYRLNTWIADAPIALRQPNGQVWSPQNDDRRYSESGRVMLVDALTRSMNVPTVNLGMALGLPAVTETWIKLGVPKDQLHPVPAMLLGALNLTPIEVAQAFQTIASGGNRAPLSALRSVIAEDGKVLYQSFPQAERAVPAQAAYLTLWTMQQVVQRGTGRQLGAKYPNLHLAGKTGTTNNNVDTWFAGIDGSTVTITWVGRDNNQPTKLYGASGAMSIYQRYLANQTPTPLNLVPPEDIADMGVDYDGNFVCSGGMRILPVWTSDPQSLCQQSEMQQQPSGNPFDQSSQPQQQPQQQPAQQEQKDSDGVAGWIKDMFGSN

SEQ ID NO: 49912 - DNA, 2331 bp, Lactobacillus acidophilus NCFM
  CDS (1)..(2331)
atggcagataatacaaataatatgaaacgtgaatcacgacgaaactatcacggacgaaggtcgagtggtggccatttatggataaaaataataaaatggctatttcttgctgcactattagtggtagtttctggtattgggctttttgctttctatgcaaaggatgctcctaatattagtcaaagccaacttcaaagtggtggtacttctagcctttataccaatgatggtaaatttttattatcacttggatctgaaaaaagaatctacgttaagaataaagatattcctcgacagttaaaagacgcaattgtttctgttgaagataaaagattctacaaagatagacttggagtagatccaattagaattgtgggatcaatgcttactaatgctaagagtaatagtattgctgcaggtggatcaactattactcaacaattggttaagttaaccgtattttcaactgcggcttcacaacgtactttaaaaagaaaagcccaagaagcttggttagcaatgaaagtgcaacatgaatttagtaaagaccaaattttagaattctatgttaataaagtctttatgaattatggtaattacggtatgggaacagccgctaattattattacaataaatctctaaaggatctcgatttagcacaaactgctttaattgcagggatgcctaatgctcctgtaatgtatgatccatatttataccctcaaaaagctcgctatcgtagaaatatcgttttaaagacaatgcttgaaaatgataagattacgaaggctcaatataatcaagcaattaatgaacctattaccaaaggattacgccctagacacactaataatgaatctaagattagacaaatcgatgatccatatattaaggaggtaatttctgaagttaaaagtaaaggttttgatccatataatgataatttgaagattacaataaatattgatcaaaaagctcaaaacaagttatatcaattagcgaacaatggtgaagtaccatttactaatgacaaaatgcagattggtgcaactgtagttgatcctaataatggtcatgtagtagcaattttaggtggtcgacatttaccttctgttcaattaggtcttgatcgtgcagttcaaactggtcgttctaccggatcgtcaattaaacctgttcttgattatgcaccagcgattcaatatttgaattggtcaacagctaaaatgttagatgatagtaaatatgtttatccaggaaccaatattcaattatatgattgggataacaaatatgatggcatgatgacaatgcgtaaagcattggaacaatcacgtaacgttccagcagttaaaacccttgctgatgtaggagtaaaacgtgcttccgcatttgctagacgtatgggtgtagatgttcctgcaaattcaggcttatcagtggcaattggtgctaatgcatcaagtttacaaatggctggtgcatacagtgcatttgctaccatgggtgtttatcataaaccacaatttgtatctaaaattgaaactccagatggtttaactagaaattatgattcaaatggtgtgcgtgtaatgaagaaatctaccgcatatatgattactgatatgttaaaaggagttattaaaagaggttctggtacaaacgctaaaatagctgacctttatcaagctggtaaaacaggtactgttaaatactccgatgaagatttagccaagtatccaggctataattcaactcctaaggattcatggtttgtaggttatactagatcgtatgttatgggtgtgtggacaggatatgataatctaaaagatggtactatctctggaattggtcagcaatctgctcaattaatttataagagtatgatgacctacttaatgagaaataagcctaatttggattgcaaacaacctaattcagtagttagagcaagaattgttaataattctaatcctccagaagttgctactagtggcggaacttggcaattgtttgttcgtgggcatgctcctgcaggtatcggaaatagtgctgcaagttatgatgaagaagatgaagaaacagatactactagtaacaatactgataacactacctcatccagttcttcagtaaccgtagagagtcgtgtttcttctagaagagaaaatggtactactactcaatcaagtagcagtcaaagagtctcttcttcaagtgaaagtcgagagcaatcttcatcgcgtgaacaaagtagcagtgaacagcaatctagacccgataatacagaacgagatcaggaaaatactgatagaaataatgattaa

SEQ ID NO: 49913 - protein, 776 aa, Lactobacillus acidophilus NCFM
MADNTNNMKRESRRNYHGRRSSGGHLWIKIIKWLFLAALLVVVSGIGLFAFYAKDAPNISQSQLQSGGTSSLYTNDGKFLLSLGSEKRIYVKNKDIPRQLKDAIVSVEDKRFYKDRLGVDPIRIVGSMLTNAKSNSIAAGGSTITQQLVKLTVFSTAASQRTLKRKAQEAWLAMKVQHEFSKDQILEFYVNKVFMNYGNYGMGTAANYYYNKSLKDLDLAQTALIAGMPNAPVMYDPYLYPQKARYRRNIVLKTMLENDKITKAQYNQAINEPITKGLRPRHTNNESKIRQIDDPYIKEVISEVKSKGFDPYNDNLKITINIDQKAQNKLYQLANNGEVPFTNDKMQIGATVVDPNNGHVVAILGGRHLPSVQLGLDRAVQTGRSTGSSIKPVLDYAPAIQYLNWSTAKMLDDSKYVYPGTNIQLYDWDNKYDGMMTMRKALEQSRNVPAVKTLADVGVKRASAFARRMGVDVPANSGLSVAIGANASSLQMAGAYSAFATMGVYHKPQFVSKIETPDGLTRNYDSNGVRVMKKSTAYMITDMLKGVIKRGSGTNAKIADLYQAGKTGTVKYSDEDLAKYPGYNSTPKDSWFVGYTRSYVMGVWTGYDNLKDGTISGIGQQSAQLIYKSMMTYLMRNKPNLDCKQPNSVVRARIVNNSNPPEVATSGGTWQLFVRGHAPAGIGNSAASYDEEDEETDTTSNNTDNTTSSSSSVTVESRVSSRRENGTTTQSSSSQRVSSSSESREQSSSREQSSSEQQSRPDNTERDQENTDRNND

SEQ ID NO: 49914 - DNA, 2058 bp, Lactobacillus acidophilus NCFM
  CDS (1)..(2058)
atgaataatgaccaaccaagaagaagtagttttaaagatgcttggcatcgatttgataaccgcttctttatcggacgctggattattttaatcctgcttattcttatgcttttaacttgtacatattatacaatcaaagttaaaacttcgaatatctcgaatttaaaagcatcattatcaacaacaacaaccatttatgattacaagggtaaaaaagctggttctttgtattcacaaaagggatcgtttgttgaatatgacaaaatttcgccaaatattcaaaatgccgtgatttcgacagaagatcgtactttctggaaaaaccccggctttagcgttaaaggaatggcccgtgctgccattagtttaattattcatcatggtcaagttaccggtggtggatcgacgttaacacagcagttagctaagaattcgcttcttacgcagcagcaaactttttcgcggaaattagaggaactattttttgcaattgaaatcaatcatgtttactctaaaaaagatattttgacaatgtatttgaacaatgcctacttcggaaatggggtatggggtgttcaagacgctagtcgtagatattttggtaaagatgctagtgaagtaactgtcagtgaagccgcaacacttgctgcaattttgcgtaatccaagttattataatccagttgaccatatggctaatgcattatcacgtcgaaacctagttttaagtttaatggctgataatggcaaaataactgctgctcaagctaaagcttattctaaagaaggattaactttaagaaacacttttaaaaacaaagatggctatcgctatccttacttctttgatgctgtagttgatgaggcaattaacaaatatggtttaactgaagaacaggtaatgaataagggattaaagatttacactactcttaatcaaaattaccaaggacaattacaaaatacctttgagcaaagttggctgtttccacaagcgggaagcgatggtgttgaatgtcaaggtgctagtgtggcaatggatccaggtactggagcggttcgtgcagtaattggtggacgtggtcaacatgtctttcgtggttataaccgtgcaacacaaatgaaacgtcagccgggttcttcaattaagccgatagcagtatatgcgccagctcttcaaaatggctatcattatgattcagagctatcaaataaattgcaaaaatttggtaagaatgggtacgaaccacataacgttgacaacggctattctgataaaatcccaatgtaccaagccttggctcaaagtaaaaatgtgccagcagtttggttattagataaaattggtgtaaataaaggggttcaatctgttgaaaactttggtattaaagtaccgaaaagtgatcgtaaccttgctttggccttaggtggtctttcaagtggtgtatcaccattgcaaatggctcgagcttattctgcttttgccaataagggtaacttaccaaataactcatactttattactaagattacagatgcaagtggtaatgttttggcagaaaacaataatctaggtacccatagagttatttcagagaatacagcaaaagaaatgactacgatgatgcttggggtgtttactaatggtacaggtcagtctgctcaacctaatggttataaagtagctggtaaaactggatcaacggaagtacctaattcatatggtttcggtaccaaagatcaatggattgtcgggtatacaccagatattgttttagctacttgggtcggctttgatcgtactaaccggcaacattatatgcaaggtatctctgaaacaggaattactaggttgtataaagcagaaatggaaggaatcttgccatatactgcacaaacgcaatttactgaaaaagcacctagccaaattataaagaataatggttcaaattctgattggactggtggattaggacaaaaaattcaagatggtataggttctgcgggacagacaattaatgaatggtataatagtctgaaagggctattaggccgataa

SEQ ID NO: 49915 - protein, 685 aa, Lactobacillus acidophilus NCFM
MNNDQPRRSSFKDAWHRFDNRFFIGRWIILILLILMLLTCTYYTIKVKTSNISNLKASLSTTTTIYDYKGKKAGSLYSQKGSFVEYDKISPNIQNAVISTEDRTFWKNPGFSVKGMARAAISLIIHHGQVTGGGSTLTQQLAKNSLLTQQQTFSRKLEELFFAIEINHVYSKKDILTMYLNNAYFGNGVWGVQDASRRYFGKDASEVTVSEAATLAAILRNPSYYNPVDHMANALSRRNLVLSLMADNGKITAAQAKAYSKEGLTLRNTFKNKDGYRYPYFFDAVVDEAINKYGLTEEQVMNKGLKIYTTLNQNYQGQLQNTFEQSWLFPQAGSDGVECQGASVAMDPGTGAVRAVIGGRGQHVFRGYNRATQMKRQPGSSIKPIAVYAPALQNGYHYDSELSNKLQKFGKNGYEPHNVDNGYSDKIPMYQALAQSKNVPAVWLLDKIGVNKGVQSVENFGIKVPKSDRNLALALGGLSSGVSPLQMARAYSAFANKGNLPNNSYFITKITDASGNVLAENNNLGTHRVISENTAKEMTTMMLGVFTNGTGQSAQPNGYKVAGKTGSTEVPNSYGFGTKDQWIVGYTPDIVLATWVGFDRTNRQHYMQGISETGITRLYKAEMEGILPYTAQTQFTEKAPSQIIKNNGSNSDWTGGLGQKIQDGIGSAGQTINEWYNSLKGLLGR

SEQ ID NO: 49916 - DNA, 2445 bp, Xanthomonas oryzae pv. oryzae KACC10331
  CDS (1)..(2445)
atgccccgacgccacgacaacgacgctcccgacgatttcgaggacgataccaacgcgcaaggctcccgctggcaacgcagactcatcgtctggggatttgccgcgttcgcgctggcgctcggtttcctgattccctatacggtatatctgaacaagcaggtcacccagcgcttcggcgagttgcgttggcagatcccgacccgcgtgtacgggcggccattggtgctggtgcccggcatcgcgctggatgcggccacgctgaagaccgagctggatgcggcgtcgtacagtgacgacggtcaggcgaagctgcctggcacctatcagcaggacggcagccgcttcaccatcgccagccgcggctatatcgatgtggatgggcatgtgccggcgcgccgtatcgacgtcagcctggcgggcgggcgcgtggccacgctgcgcgacgccggcgaccgcaaagcgctcgaaagcgcacgcctggacccggcgcgcattgccaccctgtacggccaaaagcaggaagaacgccgcctggtgcgcatggaagaagtgcccgagctgctggtcaccggcctgcaggcggtggaagatcgcgacttcaacagccaccacggcatcgatctgagtggcatggtgcgcgcggcctggatcatggcgcgctccggcggccaggttcgccagggtgccagcacgctgacccagcagttggcccgcagcggcctgctcggcatcggcaaggaacagacgctgacgcgcaagttcaacgagatcctgtacgcggtgatcatggaggcgcgttacgacaagcgcaccatcctggaggcctatctcaaccaggtgtatctgggccagcgcggcgggcaggcgatccacggtgtgtcgtcgggcgccgagctgtggttcggccgcgaactcaattcgatgaccaccgagcagatcgcgttgttgatcgggctggtcaaggggccgtcgtactacgacccgcggcgcaacccggagcgcgcgctggaccggcgcaatttcgtgctcggcaagctgcacgaaaacaacctgatcaacgacgccgagtacaagcgcgcgctggccgcgccgctgggcgtgcccaccgagcccggcctggtcgcagccaatcgtttccccgcctatgtggacttggtgcggcgccagctggcgcacgattacccggaaggcgtcctgcagggcgccggcatgagcgtgctcacgggcatgtcgccgtctgcgcaggcgtatgccgaaggggcggtcaccggcaccatcaagcggctggacaacaagaagcgcccgccgctgcaggccgggctggtgctcaccgacgtgcacaacggcgatgtgctggcggtggtcggcagccgcgaggtggccaagccgggcttcaatcgtgcggtggaagcgcagcggcaggtgggctcgttgctcaagccgttcgtgtacatgctggcgctggcctcgccggaccgctgggcgctgtccagctgggtcgacgactcgccggtcaccgtgcagctcagccgcggcaggacctggtcgcccggcaattccgacaaccgcagccacggcactgtgcgtctggtcgatgcgctggcgcattcctacaaccaggccacggtgcgggtgggcatgcaggtcggcgcagaccgcatcgcgcaactgatccaggtcttggccggcatcaaggccgagcccaatccggccttgatcctgggcacgaccgaccagagcccgtatggcatggcgcagctttaccagttcctggcggccggcggcgagatccagccgctgcacgcggtgcgcggtgtgctcgatccgcagggcaagctgctcaagcgctacgacaagaccccggcaccggcgcaggaaggcgattcggtggctgccaacctgatcagcatcggtctgcagcaggtagtcagcaacggtaccgcgcgccagctgctgggcgatggcctgggtcgcttgtcgtcggccggcaagaccggtacctccaacgatggtcgcgacagttggtatgccggctataccggcgaccacctggcggtgatctggatgggcaacgaccagaacgccgagaccggcctgtatggcgccaccggcgcgatgcgggtgtggtcgagcatcttcgcccgcctgccgagtgcgccattgaaggtcagcggcagaggcctggattggcagtgggtggacgccagcggtaccggcgtgaccgaccccggttgcccgggcgcgcgccagttcccgttcgtggtcggcttcacgccggcctacgccccgtgtgccggcaatgcaccatcgatcgaagctgcgcccggcgaagcggccgcacccgccgaacaatccagcggcggtggctggcgccgcttcttcggtctggaaaagaagcccgaacaacccgccccggcgcctgccacggccccaccggcgcattga

SEQ ID NO: 49917 - protein, 814 aa, Xanthomonas oryzae pv. oryzae KACC10331
MPRRHDNDAPDDFEDDTNAQGSRWQRRLIVWGFAAFALALGFLIPYTVYLNKQVTQRFGELRWQIPTRVYGRPLVLVPGIALDAATLKTELDAASYSDDGQAKLPGTYQQDGSRFTIASRGYIDVDGHVPARRIDVSLAGGRVATLRDAGDRKALESARLDPARIATLYGQKQEERRLVRMEEVPELLVTGLQAVEDRDFNSHHGIDLSGMVRAAWIMARSGGQVRQGASTLTQQLARSGLLGIGKEQTLTRKFNEILYAVIMEARYDKRTILEAYLNQVYLGQRGGQAIHGVSSGAELWFGRELNSMTTEQIALLIGLVKGPSYYDPRRNPERALDRRNFVLGKLHENNLINDAEYKRALAAPLGVPTEPGLVAANRFPAYVDLVRRQLAHDYPEGVLQGAGMSVLTGMSPSAQAYAEGAVTGTIKRLDNKKRPPLQAGLVLTDVHNGDVLAVVGSREVAKPGFNRAVEAQRQVGSLLKPFVYMLALASPDRWALSSWVDDSPVTVQLSRGRTWSPGNSDNRSHGTVRLVDALAHSYNQATVRVGMQVGADRIAQLIQVLAGIKAEPNPALILGTTDQSPYGMAQLYQFLAAGGEIQPLHAVRGVLDPQGKLLKRYDKTPAPAQEGDSVAANLISIGLQQVVSNGTARQLLGDGLGRLSSAGKTGTSNDGRDSWYAGYTGDHLAVIWMGNDQNAETGLYGATGAMRVWSSIFARLPSAPLKVSGRGLDWQWVDASGTGVTDPGCPGARQFPFVVGFTPAYAPCAGNAPSIEAAPGEAAAPAEQSSGGGWRRFFGLEKKPEQPAPAPATAPPAH

SEQ ID NO: 49918 - DNA, 2373 bp, Vibrio fischeri ES114
  CDS (1)..(2373)
atggctgaaaagaaaaaaacaccaacaaaagctgcccctaaaaaaacggcagcaaagaagaaagcaccagcgaaaagaaaaacatcatctaagaaaaaagcgcaatcgtctcgtcctttttggaagagtttgatgattttaggctttaaattaagtttggttgttttagctattcttgttatcgccggtatttatcttgataccgtagttaagaaacgttttgatggtcaattatttagcttaccaacggttgtttatagccgagtgttaacgttatctcctgggcaaaatatcagtttaaaaacggttcaaaatgagttggatttacttaaatatcaaaaagtacgtcaacctcaacgccctggtgaatattcatcatcatcaacaaaaattgaattaattcgtcgtccttttgaatttcaacaaggaccagagccggatcgtcacgtcatgctttattttaattctgaaggacttcagaaaattgaaaatagaagcgtaatgaaacaaatgggttttttacaaatcgagcctcagttcttaggtatgttggatgctgatgatgatcaacagcgtttattcttacgtagagagcagtttcctgaggtaatggttgatgccttactagcgaccgaagaccgtgatttttatcagcacgatggtgtttctcctcttgctatagctcgagctatggtagtgaatgctaaggcaggacgaaccgtgcaaggtggtagtacgctgactcaacaattggcgaaaaacttatttctttctcgtgaacgtacactatggcgaaaagttcgagaagcgtatctcgcattaattttagactatcgttatagcaaagaccgtattttagaagcgtatttaaatgaggtgtatttaggacaaactggtggagaggccattcatggttttggcttggctgcacaggtatattttggtcgaccaatagaagagttgcgtattgatcaactagcgatgttagttggtatggtgaaaggcccgtcttattacaatccgatgcgtttccctgaacgagtaaaagagcgccgagatttagttcttcgattaatgatgcaagaagagatcttatcgcctcatcaatatgaaatggcagctagccgtccactcgatgtaaaaaaacgagcaactatagcgacaagacaaccggcttatttccagcaattaaaatgggagttaaaagagaaagcgggtaaggcatatcagaaaggagaagggctacgagtattcactactctggatcctctgtctcagcaaaaagcagagcaggccgttgagagaacagtacctcagttagaaaaaagagctgggaagggcttggaagctgcaatggtgattgttgatcgtcaaagtggtgaaattcgagcaatgattggtggcagccgaactggatttgatggatttaaccgagcgattaatgctaaacgaccaattgggtcattagttaaacctgctatctatttgagtgcattagaaacaccggataagttttcattagcaacaacgttagatgataaaccgattgcattaaaaggaagtaaaggtacaacatggacgccaagaaactttgaccgtaaattcagaggagaggttcctctttattatgctctttctcgttctttaaatgtaccaacagtaaatcttggtttgatggttggcttaagcaaagtgaccgacactctagttaaattaggggttgatgcaaatgagattaatcaagtgccatcaatgctattaggatccatcaacttatctccatatcaagtagctcaaatgtatcaaacgattggtaatggtgggagaaaagccgctttaacagcacttaaggcagttgtagataatgatggaaacttactttatgaaaacttccctaaatcagctgcagtcgttcctgagcaagctacgtggttaactgtgtatggaatgaaacgaacggtgagtgaaggaacagctcgattcttaaatagtaaatatagttgggcagctttagcgggtaaaacgggaacaagtaacgattccagagacagttggtatgctggtattgatggtcgtgaagttgccattacttggctaggtcgcgatgataacaaaccaatgaagttgacggggtcaagtggtgcgttacgagtttacgctgattatctaagtatgcgttctcctgaagtgcttcaattaccgtggccaaatgaagtgacagccgctggatttgatttacaaagtaataaaacactagaaccagattgttcaggtcgagtgaagttgcctatttgggataaaaaagggcagtataaagctgagtgtgaaaagaataagccagcagcttggttaactgatatttttggtttttag

SEQ ID NO: 49919 - protein, 790 aa, Vibrio fischeri ES114
MAEKKKTPTKAAPKKTAAKKKAPAKRKTSSKKKAQSSRPFWKSLMILGFKLSLVVLAILVIAGIYLDTVVKKRFDGQLFSLPTVVYSRVLTLSPGQNISLKTVQNELDLLKYQKVRQPQRPGEYSSSSTKIELIRRPFEFQQGPEPDRHVMLYFNSEGLQKIENRSVMKQMGFLQIEPQFLGMLDADDDQQRLFLRREQFPEVMVDALLATEDRDFYQHDGVSPLAIARAMVVNAKAGRTVQGGSTLTQQLAKNLFLSRERTLWRKVREAYLALILDYRYSKDRILEAYLNEVYLGQTGGEAIHGFGLAAQVYFGRPIEELRIDQLAMLVGMVKGPSYYNPMRFPERVKERRDLVLRLMMQEEILSPHQYEMAASRPLDVKKRATIATRQPAYFQQLKWELKEKAGKAYQKGEGLRVFTTLDPLSQQKAEQAVERTVPQLEKRAGKGLEAAMVIVDRQSGEIRAMIGGSRTGFDGFNRAINAKRPIGSLVKPAIYLSALETPDKFSLATTLDDKPIALKGSKGTTWTPRNFDRKFRGEVPLYYALSRSLNVPTVNLGLMVGLSKVTDTLVKLGVDANEINQVPSMLLGSINLSPYQVAQMYQTIGNGGRKAALTALKAVVDNDGNLLYENFPKSAAVVPEQATWLTVYGMKRTVSEGTARFLNSKYSWAALAGKTGTSNDSRDSWYAGIDGREVAITWLGRDDNKPMKLTGSSGALRVYADYLSMRSPEVLQLPWPNEVTAAGFDLQSNKTLEPDCSGRVKLPIWDKKGQYKAECEKNKPAAWLTDIFGF

SEQ ID NO: 49920 - DNA, 2397 bp, Neisseria gonorrhoeae FA 1090
  CDS (1)..(2397)
atgattaaaaagattttaactacttgttttggtttgttttttggtttttgtgtatttggagtgggtctggttgccattgctattttggtaacgtatccgaaactgccgtctttggattctttgcagcattaccagcctaaaatgccgttgactatttattcggcggatggagaagtcatcggtatgtatggggagcagcggcgcgaatttacaaaaatcggcgatttccccgaggtgttgcggaatgcggttattgccgccgaggataaacgcttttaccggcattggggggtggatgtttggggtgttgcccgcgctgccgtcggcaatgtcgtgtccggcagcgtgcagtcgggtgcgagtacgattacacagcaggtggcgaaaaatttttatttgagcagtgaaaaaacgttcacacgcaaattcaatgaggtgttgcttgcctataaaatcgagcagtctttaagcaaagacaaaatccttgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccggagcgtgccaagttgcgccagaagtatattttgaacaatatgctcgaggagaagatgattaccgtgcaacagcgcgatcaggcattgaatgaggaactgcattatgagcggtttgttcggaaaatcgatcagagtgctttatatgtggcggaaatggtgcgtcgggaactgtatgagaaatatggtgaagatgcctatacgcagggttttaaggtttataccacggtccgcaccgatcatcagaaggcggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgttactaaaaagaaaaatgtcgtcatacagctgcccggcggcaggcgggttgcgcttgacaggcgcgccttgggttttgcggcccgagcggtcgataatgagaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggccgtccgagctgccggcaagcctgtctatggctttaggtacgggcgagacgacgccgttgaaagtggcggaggcatatagtgtatttgcgaacggcggatatagggtttcttcgcacgtgatcgataagatttatgacagagacggcaggttgcgcgcccaaatgcaacctttggtggcagggcaaaatgcgcctcaggcaatcgatccgcgcaatgcctatattatgtataagattatgcaggatgtggtccgtgtcggtacggcaaggggggcagctgcgttgggaagaacggatattgccggtaaaacgggtacgaccaacgacaataaagatgcgtggtttgtcggttttaaccctgatgtggttactgccgtatatatcggcttcgacaaacctaagagtatggggcgtgccggctacggcggtacgattgcggtgccggtttgggtggactatatgcgttttgcgttgaaaggaaagcagggcaaagggatgaaaatgcctgaaggtgtggtcagcagcaatggcgaatactatatgaaggaacgtatggtaaccgatccgggcttgatgctggacaacagcggtattgcgccgcaaccttcccgacgggcaaaagaagatgatgaagcggcagtagaaaacgaacagcagggaaggtctgacgaaacgcgtcaggacgtacaggaaacgccggtgcttccgagcaatacggattccaaacagcagcagttggattccctgttttaa

SEQ ID NO: 49921 - protein, 798 aa, Neisseria gonorrhoeae FA 1090
MIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQLDSLF

SEQ ID NO: 49922 - DNA, 2457 bp, Mesorhizobium loti MAFF303099
  CDS (1)..(2457)
atgattcgtctcattggctatttcttcggcatcggcacgacgctggcccttctggtcgcggcgggcgttgccatttacatcagccatctgtcgaaggatctgcccgactacgaggtgctggccaaatacgagccgccggtgaccacccgcattcacgcctcggacggctcgctgatggccgaatatgcgcgcgagcggcggctatatttgccgatccaggccatcccggatcgcgtcaaggcggccttcctgtcggcggaagacaagaacttctacaatcaccccggcatcgacgtgaccggccttggccgcgccatcatcgtcaacctgcagaattttggctcgggcaggcgccaggtcggcgcctcgacgatcacccagcaggtggccaagaacttcctgttgaccgcggaccagacctacgagcgcaagatcaaggaaatgatcctggccttccgcatcgagcaggcctaccccaaggatcgtatcctcgagctctacctcaacgaaatcttcttcggtttcggcgcctacggtgtcgccggcgcggcgctcacctacttcgacaagtcggtgaacgaactgaccgtggccgaggccgcctacctggcttcgttgccgaagggccccaacaactaccatcctttcaagcatgccgatcgcgcgatcgagcgccgcaactgggtcatcgaccagatggtcgaaaatggctacgtcacgcgtgaggaaggcaacaaggccaaggccgagccgctcggcgtgacgccgcgccgtaccggcacctatctgttcgccggcgaatacttcaccgaagaggtgcgccgccagatcatcgcccgttacggcgagaacgcgctctacgaaggcggcctgtccgtccgcaccacgcttgatccgaaagtccagctcatcgcccgcaaggcgatgcagaacggcttgatcaaatacgatacgctgcgcggctatcgcgggccggtgacgtcaatcgacgtgtccggcgactggggcgtcccgctgggcgccgtcaagggactggaggacgtccccgaatggtcgctggccgtcgtgctcgactcctccgcgtcaggtctctcgataggcctgcagcccgcacgccaggcatcgggcgacatcgtcaaggaacgcgtcgaaggcactgtcagcaaggacgacatgggctttgccatgcgccatatggtggacggcaagacggtaaaggccaagtcgccggccgatgtgctgaagcccggcgacgtcatcttcgtgcagaagaacgaaggctccgacaacacctacagcctgcgccaggttcccgaggtggaaggcggcctgatcgccatggatccgcacaccggccgtgtgctggccatggtcggcggtttctcctatgcgcagtccgaattcaaccgcgccacccaggcgatgcgtcagccgggctcctcgttcaagccgatcgtctactcggcggcgctcgacaatggctatacgccggcctcggtgatcatggacggaccgatcaccatacagagcggcaacacgacctggacgccgaagaactatgacggcaccgtcgccgggccggcaacgctgcgttccggcatcgagaagtcgcgcaatttgatgacggtgcggcttgccaacgacatgggcatgaagctggtcgtcgaatatgccgagcgctttggtgtctacgatcatctggcgccgtatctgccgatggcgctgggctccggcgagaccaccgtgatgcgcatggtttcggcctattcgatcatggccaatggcggcaagtcgatcaaaccgtcgctgatcgaccgcatccaggaccgctacggcaagaccgtgttcaagcaggatgagcgtggctgcgaaggctgcaacgcgcttgaatggaagaaccagccagagccggaactggtcgacaattccgagcaggtgctcgatccgatgaccgcttatcagatcacctcgatgatggaaggcgtggtccagcgcggcaccggcgccaccattggcgaactcggccgccacattgccggcaagacaggcaccaccaacgacgaaaaggacgcctggttcatcggtttcacgccgaacctcgtggttggcctctacatgggctacgacacgccgcgcggccttggccacggcgccaccggtggcggtctcgccgccccgatcttcaaggatttcatgcgcgttgcgctggacggcacgcccaacgtcgacttcaaggtcccagacggcatgaacctgatcgccatcaatcgtaagaccggcatgcgtgccgcgtcgggcgatccgggcaccatcatcgaggccttcaagccgggcaccggtcccgccgacagctattgggtgatcggcatgggtgccgacggctccaacgcgtcgggcggcgcactgtcaccgcaggccaaccaggccatccaggacggcggcggcggcctctactga

SEQ ID NO: 49923 - protein, 818 aa, Mesorhizobium loti MAFF303099
MIRLIGYFFGIGTTLALLVAAGVAIYISHLSKDLPDYEVLAKYEPPVTTRIHASDGSLMAEYARERRLYLPIQAIPDRVKAAFLSAEDKNFYNHPGIDVTGLGRAIIVNLQNFGSGRRQVGASTITQQVAKNFLLTADQTYERKIKEMILAFRIEQAYPKDRILELYLNEIFFGFGAYGVAGAALTYFDKSVNELTVAEAAYLASLPKGPNNYHPFKHADRAIERRNWVIDQMVENGYVTREEGNKAKAEPLGVTPRRTGTYLFAGEYFTEEVRRQIIARYGENALYEGGLSVRTTLDPKVQLIARKAMQNGLIKYDTLRGYRGPVTSIDVSGDWGVPLGAVKGLEDVPEWSLAVVLDSSASGLSIGLQPARQASGDIVKERVEGTVSKDDMGFAMRHMVDGKTVKAKSPADVLKPGDVIFVQKNEGSDNTYSLRQVPEVEGGLIAMDPHTGRVLAMVGGFSYAQSEFNRATQAMRQPGSSFKPIVYSAALDNGYTPASVIMDGPITIQSGNTTWTPKNYDGTVAGPATLRSGIEKSRNLMTVRLANDMGMKLVVEYAERFGVYDHLAPYLPMALGSGETTVMRMVSAYSIMANGGKSIKPSLIDRIQDRYGKTVFKQDERGCEGCNALEWKNQPEPELVDNSEQVLDPMTAYQITSMMEGVVQRGTGATIGELGRHIAGKTGTTNDEKDAWFIGFTPNLVVGLYMGYDTPRGLGHGATGGGLAAPIFKDFMRVALDGTPNVDFKVPDGMNLIAINRKTGMRAASGDPGTIIEAFKPGTGPADSYWVIGMGADGSNASGGALSPQANQAIQDGGGGLY

SEQ ID NO: 49924 - DNA, 2268 bp, Mesorhizobium loti MAFF303099
  CDS (1)..(2268)
atggcgaaccgcagagacagccgcatcgagcccagtttcgagggaccgccacaggcgcgatcccagccgggtctttcggtgagcgaagaggaccgcgtcgtgccaagcaaccgcaaagcctccgcaaaacgcaaatcatcgaaggcgaaatcgtcgcgcggcgggcgcggcaggagccggcgcggcctgttcggcgtgcttggccggcttttctactggtgcttcgtgctcgccatctggggtggcatcgcggtggccggcgtcgttatctactacggcgccaagatgcctgcggccaccacctggtcgatccccgaccgcgcccccaacatcaagatcgtctcggccgatgaccagttgctggcaaacaggggcatgagcggcggcgaagccgtcggcctgcacgaaatgtcgccttacattcccgaagccgtcatcgccatcgaggaccgccggttctattcgcatttcggcgtcgacccgatcggtctgtcgcgcgccatggtgaccaacctgctcggcgggcatttctcgcaaggcggttcgacgctgacgcagcaattggccaagaatctgttcctgaagcctgaccgcacgctggagcgcaaggtacaggaggtgttgctggcgctgtggctggagcacaagcacaccaaggaccagatcctcgaaatgtacctcaaccgggtctatttcggctccggcgcctttggtgtcgaggcggcttcgcggcgttatttcggcaagagcgcgcgcgatgtcacgctctcggaagcagcgctgcttgcgggcttgctgaaggcgccgtcgcggctgtcgccggcgcgcgatcccaaggccgcggaggagcgttcgcagcttgtgctcgcggctatgcgtgaagagggcaagatcagtgacaaggagttgaagacggcgctcagcgcgccggcgacgcgcgcgccgtcctactggaccggttcggagaactatgtcgccgacaccatcatggaagaactgccagacctgatcggcgacgtgcgcggcgacatcgtcatcgattccaccgtcgacctgaacctgcagaagctcgccgagcagtcgatccgccggctgatcgacgaaagcggcaagaagctcaacgtcacccagggcgcgctggtgtcgatcgacgattccggcgcggtgcgcgctatggtcggcggctacgactattcgaccagccagttcgaccgcgcctcggaagcgcgccgccagccgggctcggcgttcaagccgttcgtctatatggcggcactggaagccggccgcacgcccgacagcatccgcaacgacgcgccgatcaagatcggcaactggacgcccgacaattacggcggcaaatattttggcaaggtcacgctggcgacggcgctggccaagtcgctgaactcggtcgccgcgcagctgacgatggaggtcgggccgaacgcggtggtggaagcggcgcaccgcatgggcatccagtccgaactgcaggccaacacctcgatcgcgctcggcacctcggaagtgacgccgctggagctgacgtcggcctatgtgccgttcgccaatggcggctacaagcccgacatccacttcatccgccgcatcacgaccgccgagggcaaggtgctctacgacagcggtggtggcagcgcgccgcgtgtcgtgaaacccgagatcgtcggcatgatgaactcgatgatgaccggcaccgtcgaggtcggcacggccaagaaggcggccttcgcctggccgtcggccggcaagaccggcaccagccagaattcgcgcgatgcctggttcgtcggctacaccgccaatctcaccaccggtgtgtggttcggcaatgatgacggcacggggatgaagaaggtcaccggtggcgcgctgccggcgcaggcctggcacgaattcatggtcgccgcacacgagggcgtgccggtgcggccgctgcccggcacctggaaatcgacgccggccgacacgatcgtgcccgacgacataccttcggccgacaacaaccagccagcgccggtcccgtccgcgtcggttggccagaaggcgccgtcaacacagccgacccaggcggcagcgccggcccgtgtggcgcggcctgcccagaccgtcgatgccgatggcttcaacatgccagcggatgacggcaccactgcttcggtcggccatccggtgccgccgggcaatgttggcggtccgctgaagaagaaacagacctcgatcctggatattctgggcggcggctga

SEQ ID NO: 49925 - protein, 755 aa, Mesorhizobium loti MAFF303099
MANRRDSRIEPSFEGPPQARSQPGLSVSEEDRVVPSNRKASAKRKSSKAKSSRGGRGRSRRGLFGVLGRLFYWCFVLAIWGGIAVAGVVIYYGAKMPAATTWSIPDRAPNIKIVSADDQLLANRGMSGGEAVGLHEMSPYIPEAVIAIEDRRFYSHFGVDPIGLSRAMVTNLLGGHFSQGGSTLTQQLAKNLFLKPDRTLERKVQEVLLALWLEHKHTKDQILEMYLNRVYFGSGAFGVEAASRRYFGKSARDVTLSEAALLAGLLKAPSRLSPARDPKAAEERSQLVLAAMREEGKISDKELKTALSAPATRAPSYWTGSENYVADTIMEELPDLIGDVRGDIVIDSTVDLNLQKLAEQSIRRLIDESGKKLNVTQGALVSIDDSGAVRAMVGGYDYSTSQFDRASEARRQPGSAFKPFVYMAALEAGRTPDSIRNDAPIKIGNWTPDNYGGKYFGKVTLATALAKSLNSVAAQLTMEVGPNAVVEAAHRMGIQSELQANTSIALGTSEVTPLELTSAYVPFANGGYKPDIHFIRRITTAEGKVLYDSGGGSAPRVVKPEIVGMMNSMMTGTVEVGTAKKAAFAWPSAGKTGTSQNSRDAWFVGYTANLTTGVWFGNDDGTGMKKVTGGALPAQAWHEFMVAAHEGVPVRPLPGTWKSTPADTIVPDDIPSADNNQPAPVPSASVGQKAPSTQPTQAAAPARVARPAQTVDADGFNMPADDGTTASVGHPVPPGNVGGPLKKKQTSILDILGGG

SEQ ID NO: 49926 - DNA, 2154 bp, Mesorhizobium loti MAFF303099
  CDS (1)..(2154)
atggtcagccctgaaccgcgcaagagaagaggtccgatcgcgtcgcgccttctggcgctggacgcctggatcgattcctcgctctacgagatcgggttcaaggcgcggcagttctgggaagcggcgacgatcttctcgcggcgctttcggctcaagggctggcggcgcggcatcatcgagattttgagcgaaactttcacgctcggcgccggcggcatcgtggtgatgctggcgctggccatcccggcgttccaggatacggccggtgactggcgcgcccagggcgatttcgccgttaccttcctcgaccgctatggcaacgagatcggccagcgcggcatcatccagcgcgattccgtgccggtcgacgagatgcccgatcacgtcatcaaggcggtactggccaccgaggaccggcgtttcttcgaccactacggcatcgacgtgctcggcctgtcacgcgcgatcttcgagaatgtgcgggcgaactcggtcgtccagggtggctcgagcatcactcagcaattggccaagaacctgttcctgaccaatgagcgcaccttcgagcgcaagatcaaggaagccttcctgtcgctgtggctcgaagccaatctgtcgaagaaggaaatcctgcagctgtatctcgaccgcgcctatatgggcggcggcacgttcggcatcgaggcggcggcggacttctatttcggcaagagcgtcaaggatcttaatctcgccgaggcggcgatgctggccggcctgttcaaggcgccgaccaaatacgccccccacatcaacctgccggcggcacgcgcccgcgccaatgtggtgttgtcgaacctcgtcgattccggcttcatgaccgaaggccaggtgctgcaggcaaggctgcatccggccgacgtcgtcgatcgcggcgaacagaaaagccccgactatttcctcgactgggccttcgacgaggtcaagaagatcgccaagccgggccagcattcgctggttgcccacactaccttcgacgccaacatccagaaggcggcggaagagtccgtcgagttccatctgcgccagttcggcaaggagtacaacgtcaccgaaggtgccgtggtggtcatcgagaccaatggcgcggtgcgggcgatcgtcggcggccgcgactacggcgccagccagttcaaccgcgccaccaaggcgctgcgtcagaccggttcctccttcaagccctatgtctacgccacggcgatggagcacggctttacgcccaactcaatcatttccggcgggccaatcagctggggcaactggtcaccgcacaattatagcggcgagtcggctggcaacatcacgctgatcatggcgatggccaagtcgatcaacaccgtgccggtgcggctggccaaggaccatctcggcatcgcgccgatcaaggcgatggccgaggcgatgggcgttgaatcgccgctcgagtcgcacaagacgatggtgctcggcacttcgggcatgaccgtgatggaccaggcgacgggctacagcgtgttcgcccagaacggctttgtcggctcccggcacggcatcacccagctcgtcacccgcaccggcgacgtggtgtatgactggaccaaggacgcgacgccgccgcaccgggtgctgtccgagcaggcactgaaatccatgaacaccatgctggcggccgtgccggtgatgggcacggcgcggcgcgcgcaaattcccaacatcgtcgtcgctggcaaaaccggcacgacgcaatcctaccgtgatgcctggttcgtcggcttcaccggcaactacacggcagccgtgtggctgggcaacgacgatttcaccccgaccaagaacatgacgggcggctcgctgccggcgatggtgtggcagcgcctgatggtctacgcgcaccagaacatcgacctgaagccgatccccggcatcgacaaacctttcgtcgacgaggatatcgcggccaaggccgctgaagcgcagaagaagagcgaggatgaagccgcggccgacgcggcagccgaacgcccggcggtgctgtccagccgaaccacgcagacgctgagggacatgacgcagctgttccagtccgcccctaaactcgacgccgccgcctcgcccgaaacgctctcggcgctgtga

SEQ ID NO: 49927 - protein, 717 aa, Mesorhizobium loti MAFF303099
MVSPEPRKRRGPIASRLLALDAWIDSSLYEIGFKARQFWEAATIFSRRFRLKGWRRGIIEILSETFTLGAGGIVVMLALAIPAFQDTAGDWRAQGDFAVTFLDRYGNEIGQRGIIQRDSVPVDEMPDHVIKAVLATEDRRFFDHYGIDVLGLSRAIFENVRANSVVQGGSSITQQLAKNLFLTNERTFERKIKEAFLSLWLEANLSKKEILQLYLDRAYMGGGTFGIEAAADFYFGKSVKDLNLAEAAMLAGLFKAPTKYAPHINLPAARARANVVLSNLVDSGFMTEGQVLQARLHPADVVDRGEQKSPDYFLDWAFDEVKKIAKPGQHSLVAHTTFDANIQKAAEESVEFHLRQFGKEYNVTEGAVVVIETNGAVRAIVGGRDYGASQFNRATKALRQTGSSFKPYVYATAMEHGFTPNSIISGGPISWGNWSPHNYSGESAGNITLIMAMAKSINTVPVRLAKDHLGIAPIKAMAEAMGVESPLESHKTMVLGTSGMTVMDQATGYSVFAQNGFVGSRHGITQLVTRTGDVVYDWTKDATPPHRVLSEQALKSMNTMLAAVPVMGTARRAQIPNIVVAGKTGTTQSYRDAWFVGFTGNYTAAVWLGNDDFTPTKNMTGGSLPAMVWQRLMVYAHQNIDLKPIPGIDKPFVDEDIAAKAAEAQKKSEDEAAADAAAERPAVLSSRTTQTLRDMTQLFQSAPKLDAAASPETLSAL

SEQ ID NO: 49928 - DNA, 1983 bp, Helicobacter pylori J99
  CDS (1)..(1983)
atgctaaaaaagattttttatggttttatcgttttatttttgattatcgtagggttgttggccgttcttgtcgctcaagtttgggtaactacggataaggatattgctaaaattaaagattatcgccccagtgtcgcttcacagattttagacagaaaagggcgtttgatcgctaatatttatgataaggaatttcgtttttatgcgcgttttgaagaaatccccccacgatttgttgaaagccttctagcggtagaagacaccctcttttttgagcatggggggatcaatttagacgctgtcatgcgcgctatgattaaaaacgctaaaagtggtcgttacactgaagggggtagcactctaacccaacaactcgttaaaaacatggtgctcacacgggaaaaaaccctaaccagaaaactcaaagaagctatcatctccatacgcattgaaaaagtcttaagcaaagaagaaattttagagcgttatttgaaccaaactttttttgggcatgggtattatggcgtgaaaaccgcaagtttagggtattttaaaaaaccccttgacaaactcacgcttaaagaaatcaccatgttagtcgccttacctagggctccaagtttttatgaccctaccaaaaatttagaattttcactctctagggctaatgatattttaaggcggttgtattctttaggctggatttcttctaacgagctcaaatccgctctcaatgaagtgccaatcgtctataaccaaacttccacgcaaaatatcgctccctatgtcgtggatgaagtgttgaagcaattggatcaattagacgggttaaaaactcaaggctataccataaaactcacgatagatttggattaccaacgcttagcgttggagtctttgcgttttgggcatcaaaaaatcttagaaaaaatcgctaaagagaagccaaaaactaacgcttctaatgataaagatgaagacaacttaaacgccagcatgatagttacagaaacgagcaccggtaagattttagccttagtgggggggattgattataaaaaaagcgctttcaatcgcgccacgcaagccaaacggcagtttgggagcgcgatcaagccttttgtgtatcaaatcgcttttgataatggctattccaccacttccaaaatccctgataccgcgcgaaattttgaaaatggcaattatagtaaaaacagcgtgcaaaaccacgcatggcaccctagcaattatactcgcaaatttttagggcttgtaaccttgcaagaagccttgagccattcgttaaatctggctacgattaatttaagcgatcagcttggctttgaaaaaatttatcaatctttaagcgacatggggtttaaaaacctccctaaagatttgtctattgtgttagggagctttgctatctcaccgattgatgcggctgaaaagtattctctattttctaattacggcaccatgctcaaacccatgctcattgaaagcatcaccaaccaacaaaacgaagtcaaaactttcacgcccattgaaaccaaaaagatcacttccaaagaacaagcttttttaaccctttcagcgctgatggatgcggtagaaaacggcacagggagtttggctcgcattaaaggtttagaaattgccggtaaaaccgggacttctaacaacaatattgacgcttggttcattggctttacccccaccttacaaagcgtgatctggtttgggagagacgataacacgcctattggcaaaggagcgacaggaggcgttgtgagcgcgcctgtgtattcgtatttcatgcgcaatatcttagcgattgaaccttctttaaaaagaaagtttgatgtccccaaaggcttgcgtaaagaaatcgtggataaaatcccctactactcaagccctaattccatcacccccacccccaaaaaaacagacgatagcgaagaacgcttgttgttctaa

SEQ ID NO: 49929 - protein, 660 aa, Helicobacter pylori J99
MLKKIFYGFIVLFLIIVGLLAVLVAQVWVTTDKDIAKIKDYRPSVASQILDRKGRLIANIYDKEFRFYARFEEIPPRFVESLLAVEDTLFFEHGGINLDAVMRAMIKNAKSGRYTEGGSTLTQQLVKNMVLTREKTLTRKLKEAIISIRIEKVLSKEEILERYLNQTFFGHGYYGVKTASLGYFKKPLDKLTLKEITMLVALPRAPSFYDPTKNLEFSLSRANDILRRLYSLGWISSNELKSALNEVPIVYNQTSTQNIAPYVVDEVLKQLDQLDGLKTQGYTIKLTIDLDYQRLALESLRFGHQKILEKIAKEKPKTNASNDKDEDNLNASMIVTETSTGKILALVGGIDYKKSAFNRATQAKRQFGSAIKPFVYQIAFDNGYSTTSKIPDTARNFENGNYSKNSVQNHAWHPSNYTRKFLGLVTLQEALSHSLNLATINLSDQLGFEKIYQSLSDMGFKNLPKDLSIVLGSFAISPIDAAEKYSLFSNYGTMLKPMLIESITNQQNEVKTFTPIETKKITSKEQAFLTLSALMDAVENGTGSLARIKGLEIAGKTGTSNNNIDAWFIGFTPTLQSVIWFGRDDNTPIGKGATGGVVSAPVYSYFMRNILAIEPSLKRKFDVPKGLRKEIVDKIPYYSSPNSITPTPKKTDDSEERLLF

SEQ ID NO: 49930 - DNA, 1932 bp, Thermotoga maritima MSB8
  CDS (1)..(1932)
atgaagaaattccttttatccttcttcatagcttcgcttttgacttttttcttactgtggggtctttatttcttcttcacaaaagaccttcctcctcccgaggagaaacttgtgccgaccatcagactgttttacagtgacggaactccactgcttgtctccaggaatatctggatagacctctccgacattccagagaaattcgttgagatactcctcacctccgaggacgaggaattctacaaacatccaggattcgacctcatgggatttctgagggcgttgatcatggatataaagacactgagtttctcacagggcggaagcaccatcacacagcaactcgccaggacgctttatctttcgatggacaaatccatcgtcaggaaattgaaggaaatcttcatatccttctggcttgaacgcataagaaccaaagatgaaatcctcgagatgtacataaactccgtctatatggggaacggaatatacggattccaaacggcctctaaattatacttcggaaaggacctctctgatctttcggtgccggagatgtgtgttcttgtggctctgatcaaatcccccgagaacttcaatcctttaaaagatcccgagacctcccgaaagagggcgaagatcgtcctggacagattactgacggagaaaagaatcagcactcaggaatacgagaattactctgcggaactttcaaaactcgagtttcacacgcagcagatgaacgtggacgaggaactcttctggagggtcgtgagagaagcccaggaccttggattttcgctgaacgaactcaggtacggctacagggtttatctcacactggataaagaacttcagaaaaaggtgtacaacacggtcgaagatgataagacagcttttgttggtgtaaaggtgaaaacaggagaaatagtggcttatcgaggagtcggccttcaatacggaaccggatggagacagataggatcagccataaagcccctgtattattactatgccgttctcaagggaagaaacccttccgatctccttctggaccttcccctgaagatcggagagtgggaaccagaaaacttcgataaaaccttcaaaggaacagtcagtttgaaggaagcactcgttgattcgaggaacatcccttctgtgttactttactcttatttgcaaccagagagtgtgaggagttttataacggaagtattgaagctgagagccaggtatccagacgatctcaccgcttctcttggtactgtggaaacagccccggaagagatcgtgaaggtttattccgccatcttcaacggaggagtggttctggagccatacatcatcgacaaaatagaagacagaaacgggaagatcatctacagagggtacccgaaagtgctgtccgtcgttccgtcttttgtgagatccgcccaggaagcgagtgaaatattgaagagtatcttaaaagaagtggttgagagaggcaccggtgttcgggtgaagattccaggaaaagaaatcgcgggaaaaacaggaacggcagagaagaacgcctggttcgttggaggagatgatgagtacatattcgcggtggtaaaggacggggaaaaccttcttggtggaagggattgcgctccagtgtggaaagaaatagtgagcagctgggagaagttcgagggagatcttcgatacaaaagactagacaaaccgggaattcctcttattgacgatagaacaatagaatatctggactacgcgaaactggttgaactggtcaatggatcgaaacttcctgtgagcgttcttgtcaaagttctacagctcatggactacaatcatcagattgaattcctctcaaaattgaacagcgtggatccgatactgtcccttgaaatctggaaaaagtttttgatggaaggaggttga

SEQ ID NO: 49931 - protein, 643 aa, Thermotoga maritima MSB8
MKKFLLSFFIASLLTFFLLWGLYFFFTKDLPPPEEKLVPTIRLFYSDGTPLLVSRNIWIDLSDIPEKFVEILLTSEDEEFYKHPGFDLMGFLRALIMDIKTLSFSQGGSTITQQLARTLYLSMDKSIVRKLKEIFISFWLERIRTKDEILEMYINSVYMGNGIYGFQTASKLYFGKDLSDLSVPEMCVLVALIKSPENFNPLKDPETSRKRAKIVLDRLLTEKRISTQEYENYSAELSKLEFHTQQMNVDEELFWRVVREAQDLGFSLNELRYGYRVYLTLDKELQKKVYNTVEDDKTAFVGVKVKTGEIVAYRGVGLQYGTGWRQIGSAIKPLYYYYAVLKGRNPSDLLLDLPLKIGEWEPENFDKTFKGTVSLKEALVDSRNIPSVLLYSYLQPESVRSFITEVLKLRARYPDDLTASLGTVETAPEEIVKVYSAIFNGGVVLEPYIIDKIEDRNGKIIYRGYPKVLSVVPSFVRSAQEASEILKSILKEVVERGTGVRVKIPGKEIAGKTGTAEKNAWFVGGDDEYIFAVVKDGENLLGGRDCAPVWKEIVSSWEKFEGDLRYKRLDKPGIPLIDDRTIEYLDYAKLVELVNGSKLPVSVLVKVLQLMDYNHQIEFLSKLNSVDPILSLEIWKKFLMEGG

SEQ ID NO: 49932 - DNA, 2508 bp, Vibrio cholerae O1 biovar eltor str. N16961
  CDS (1)..(2508)
gtgcagcctcaactaaacagggattctccggtgaagttcataaagcgtttattagtattttcattgatttgcattattcttggagtcactacaatctttggtttctatttttatgtgaaatcagatctgccagatgtagccactctacgtgatgtccaattacaaactccgatgcaagtcttcagtcaagacggcaaactgatcgcccaatttggtgaaaagcgccgcatcccgctcaagctggaagaaatgcctaaagagttgatcgaagcggtgattgcgaccgaagactctcgctactacgagcactacggttttgacccgattggtatcacgcgtgccgcctttgctgtactcgcctcgggcagtgcttcgcaaggtgccagtaccattactcagcagcttgcgcgtaactttttcctctctaatgagaagaaggtgatgcgtaaagtcaaagagatcttcattgcgatccatattgagcaactgttaagcaagcaagagatcttagagctgtatctcaacaaaatttacctcggctaccgttcttatggcgtcggcgcggctgcgcaagcgtatttcggcaaagaggtgaaagatctgaccttaggtgaaattgcgctgattgcaggcctaccaaaagccccttcaaccatgaaccctatctattccgtcgagcgtgcgaccaaccgtcgtaatgtggtgctgcagcgtatgctggatgaaaaatacatcactaaagcagaatacgatgctgcgcgtgccgaacctgtgctgccgaaataccatggcgcagagattgagttaaacgcaccgtatgtggctgaaattgctcgcgcatggatggttgaacgctacggtgaagaagctgcttacacgtcaggcatgaatgtctacacaacggtcgactctaagttgcaaagagccgccaaccaagccgcgatcaataacctgttggcttacgatgagcgtcacggttatcgcggtgcagaaaaagagttgtggcaagtcaatcaaccggcttggagcagcactcagctgtctgaatacctgagcaatgaacctacctatggcgatatgttccctgccgcggttctcagcgttgaagaaaaatcggcccaagtgtgggtaaaaagctatggtgtgcaaaccatcgcttgggaagacatgaattgggcgcgccgttttatcaacgacgatcgccaaggcccacttccgaaaagtgccaatgaatttttagccgcaggacagcaaatttgggttcgtccacgcacccaagatggcgcgattaccgcttggaagctaactcaagttccgaatgccaacaccgcatttgtcgcgatgaatccagaaaacggcgcggtcactgcgttggttggtggttttaactttgtgcacaacaaatttaaccgagctacccagtcagtgcgtcaagtgggttcaagtatcaaaccatttatctattctgcggcactgaataaaggactcactttagccacgctgattaatgatgcgccgattaaccaatgggatgagagtcaaggcacggcatggcgtccgaagaactcaccaccaacctacaccggcccaacacgactgagaattggtttagcccaatcgaaaaacgtcatggccgtgcgcgttttgcgtgaagtgggtttggatgaaacacgcgaatacttaactcgctttggtttcaaattagatcagttaccgcgctctgagacgattgcgctcggtgcaggcagcttgactcctgtacaaatggcacaaggcttctcggtttttgctaacaatggttacttcgttgaacctttctacatcagccgcgtcgaaaatccatttggcaacattgagtttagcgcagagccgaaagtcgtctgccaccgtgaatgctcatcggaacttgatgagtttgccgagcaagacgcagcaagcccttatgccccgaaagtgatttccgagcaaaacgctttcttaacgcgtgaaatgctgtacagcaatatttggggtggcggtgagtggagctcagataccggttggaacggtacaggctggcgagcacaggcactgaaacgccgcgacatcggtggtaaaaccggtaccaccaacgactcaaaagatgcatggtacaacggttatgccccaggcatcgttggtgtggcttgggtgggctttgatgatcatagccgtaacctagggaaaacagcgccgaatagaaacattgaagatgatgtttccggtgccgaatcgggtggtaaaaccgccttgccagcttgggttgagtttatgtctctcgcgctacaagatgtgcccgttcaacagaaagcggtaccgaacaatatcgctcgtgttcgcattgaccgcgatacggggttactgaccaacaaactcgactccagctcgatgtttgagtatttcgaagccggcactgagccgacagagtacgtcagcgaacatgtcaatgagtccatctattcgaccagctctggtgaagagctgttctag

SEQ ID NO: 49933 - protein, 835 aa, Vibrio cholerae O1 biovar eltor str. N16961
MQPQLNRDSPVKFIKRLLVFSLICIILGVTTIFGFYFYVKSDLPDVATLRDVQLQTPMQVFSQDGKLIAQFGEKRRIPLKLEEMPKELIEAVIATEDSRYYEHYGFDPIGITRAAFAVLASGSASQGASTITQQLARNFFLSNEKKVMRKVKEIFIAIHIEQLLSKQEILELYLNKIYLGYRSYGVGAAAQAYFGKEVKDLTLGEIALIAGLPKAPSTMNPIYSVERATNRRNVVLQRMLDEKYITKAEYDAARAEPVLPKYHGAEIELNAPYVAEIARAWMVERYGEEAAYTSGMNVYTTVDSKLQRAANQAAINNLLAYDERHGYRGAEKELWQVNQPAWSSTQLSEYLSNEPTYGDMFPAAVLSVEEKSAQVWVKSYGVQTIAWEDMNWARRFINDDRQGPLPKSANEFLAAGQQIWVRPRTQDGAITAWKLTQVPNANTAFVAMNPENGAVTALVGGFNFVHNKFNRATQSVRQVGSSIKPFIYSAALNKGLTLATLINDAPINQWDESQGTAWRPKNSPPTYTGPTRLRIGLAQSKNVMAVRVLREVGLDETREYLTRFGFKLDQLPRSETIALGAGSLTPVQMAQGFSVFANNGYFVEPFYISRVENPFGNIEFSAEPKVVCHRECSSELDEFAEQDAASPYAPKVISEQNAFLTREMLYSNIWGGGEWSSDTGWNGTGWRAQALKRRDIGGKTGTTNDSKDAWYNGYAPGIVGVAWVGFDDHSRNLGKTAPNRNIEDDVSGAESGGKTALPAWVEFMSLALQDVPVQQKAVPNNIARVRIDRDTGLLTNKLDSSSMFEYFEAGTEPTEYVSEHVNESIYSTSSGEELF

SEQ ID NO: 49934 - DNA, 2160 bp, Bacillus halodurans C-125
  CDS (1)..(2160)
atgttacgaaagttagcgggtactgcattacttatcttatcctccctcctttttggtctcatcatttatttaatcatcatttatgctggtcagtatgtcattgatgaagaaaagcttgtgatgaatgcgacgacaacgttagtagatacaaaaggaaatgttgtttcacggttattcattgaagaccgtgagcccgtgtcgatactagatgtacctgaccatgtgaagcacgcatttattgcgatcgaggatgcgcgtttccatgatcatcaaggaatcgatttccgcgcgattggccgtgccctttaccgagacatgctagctggtgaaaagctagaagggggtagcacaatcacccagcaattagtaaagaatgcatttttagatcatgaaaaaacatggctaagaaaaacgaaggaagttctcattgcgatgaacttagagcggcgttacagcaagtctgctattcttgaattttacttgaatcagatctactttggccatggagcatacggaattcaatccgctgccaacttgtattttgacaaagatgtgtcagacttgacggtggaggaaggggcggttcttgctggattagcaaaggctccgaccatttactctccgattattgaccttgaaaggagcaagcaacggcgcgatttagttctaaccgttatgcagcgtcaaggttttataacggcggaagaagctgtacgtgcaaaggggagattgattcaattagacgtaaatgaacctgctgaggaagaggcttatttaacgtacatcgacatggtcatcgatgaggccgaatctcaatatcatctatctcatcaagagttcatgacaggtggatatacagtcgttgtgccgatagaccaggcggtacaagaagtagcgtttacccttatacatgaaaagaagtattatccgaaaggcaatgaagatgcccaatctgcttttgtattacttgatgctcagacaggtggtgtattagctgtacaaggagggaaagattacgtgcgccgcgggttgaaccgtgtaaatgttccacgtcagccaggatctacgtttaaaccactcgctgtctttgcccccgctttggaggaagggcgagcagaaccgtactcgctgctccgagacgaattgcgcacatatgatgggtatgaaccgcataacttcggcgatgagtatgaggaagaggtgacgctctatgatgcgatcacccaatctaaaaatgccccggctgtttggctcctaaacgaactaggaattccaacagctaaacagtatttgcaaagacaaggctttcagctagacgatgaggggttggcgattgctcttggcgggttgcaggatggtgtcaccccacttgagcttgcttctgcctatcaagtatttgcaaacggcgggaaaaaacgcgaaccatattttattgaagccatttataatcgcgaaggagaaaaaatggcagaggtcgaccgaacggaaacacaagtctattccccacaaacggcttggtcgatgacacggatgctcgagtcggtcgtgagagaaggaacaggaacatccgcccaagggattggtgccttagctggaaaaacaggaaccacgtcttttccagaggtcgaaggggcaacgatggatgcttggtttgcgggctatacgcctgaagcggtaggaacggtgtggatgggctatgatattacatcaaccgaatcttatttaaagggagggagccgttattcggcaaagctatttcgcgacatcctttctgaagcgacaccgcagcttcgtgctacaaccttttcaaagcctgacgatgtggaggaactaaaccctcctgtccgtttagtagacatcgatgatctaaaagcgacttttgctatgggaggaactgggctaatgagcatcaagcttgagtggtctggttcagaagatgaacggctacattactacatttacgagcggcggggagcggaacgaacatacgtcggtcgaacagaggggacggatcaatattacattccagcgattaacgccttttccatgaatgattatcaagtcgttccgtatgatccaacgacgaagcgaaaaggggagccgtccaatattgcggaagtagaatttcgcttcgggtttcatgaatcggtaggtgactga

SEQ ID NO: 49935 - protein, 719 aa, Bacillus halodurans C-125
MLRKLAGTALLILSSLLFGLIIYLIIIYAGQYVIDEEKLVMNATTTLVDTKGNVVSRLFIEDREPVSILDVPDHVKHAFIAIEDARFHDHQGIDFRAIGRALYRDMLAGEKLEGGSTITQQLVKNAFLDHEKTWLRKTKEVLIAMNLERRYSKSAILEFYLNQIYFGHGAYGIQSAANLYFDKDVSDLTVEEGAVLAGLAKAPTIYSPIIDLERSKQRRDLVLTVMQRQGFITAEEAVRAKGRLIQLDVNEPAEEEAYLTYIDMVIDEAESQYHLSHQEFMTGGYTVVVPIDQAVQEVAFTLIHEKKYYPKGNEDAQSAFVLLDAQTGGVLAVQGGKDYVRRGLNRVNVPRQPGSTFKPLAVFAPALEEGRAEPYSLLRDELRTYDGYEPHNFGDEYEEEVTLYDAITQSKNAPAVWLLNELGIPTAKQYLQRQGFQLDDEGLAIALGGLQDGVTPLELASAYQVFANGGKKREPYFIEAIYNREGEKMAEVDRTETQVYSPQTAWSMTRMLESVVREGTGTSAQGIGALAGKTGTTSFPEVEGATMDAWFAGYTPEAVGTVWMGYDITSTESYLKGGSRYSAKLFRDILSEATPQLRATTFSKPDDVEELNPPVRLVDIDDLKATFAMGGTGLMSIKLEWSGSEDERLHYYIYERRGAERTYVGRTEGTDQYYIPAINAFSMNDYQVVPYDPTTKRKGEPSNIAEVEFRFGFHESVGD

SEQ ID NO: 49936 - DNA, 2661 bp, Bacillus halodurans C-125
  CDS (1)..(2661)
atgtcaaatgaagcaaatacaagacaagggcggcgacaagcgaaaaagaaaaagaacgatcgccgcaagccgaaaagaggaatattgaaaaagctgtttattgcgtttatccttctttttggagcgatcatgcttgcaggcggtattaccgtctttgccatcatcgcccaatcgccggaaattgatcctgaaaagcttcaatttccacaaggagcgcaaatttttgatcaatcagatgagtttgtttcccaattagacacatctgagcgccgaatccaagtcaactatcaagacattccagaggagcttgaggaagcattcatctccgtggaggacgttcgattccgcgatcacttcgggattgaccttcgccgtattggtggagcgatcgctgcgaacattacgagcggctttggctctgaaggggctagtacgatcactcagcagctcgtcaaaaacgtttttttaacgaacgaaaaagcacttacacgtaaaattcaggaacaatatttagcggttaagctcgaacaacaatattcgaaaaaccaaattcttgagatgtatttaaatcaaatctatctcggacaaggggtatacggggtagagcaagcgtctcaatattatttcgggaaatcgatcacagacgactcgttctcccttgctgatgcagctttgcttgcagcgattccgcgtcggccaagcttttatgatccggtcgtcaatcctgaaaacgcagaaagccggcggaaccttgtcatctcgatgatggcagatcaaggaaaaattacagcagaggaagctgaagcggctcgttcgattccgattgctgaacagttaaacgttcaagagcgagaatcttatccatttgaagccttttataaccaagtgcataaagaagtcgaggaaatggaaggcatcagcgttaacgatttgtacaatgcaggtcttaaaatctacactacgctcgacacagaagcgcagcaacacgtagaaaaagtcttgcaaaccgatgagtttattcaaacgtatccgaacaaagaagacttccaagcgggtattaccctcgtggacacacaaacaggtgaaattaaagcgatcggtagcggtcgtgaaaatacaaatgtgcaacgtggatttaactacgcaaccgatattaaacgtcagccaggttctacaattaagccgattcttgactatgggccagtgattgagtatttacaatggtcgactggtcgaatcattaaagacgaaccgcatcagtacagtaatggagtggaatttaaaaactttgatggcgcgtataaaggaaacatgacgatgcgacaggcgctcgctgaatcacgcaatgttcctgcgattaaagcattgcaggaagtaggcgttgagcgtgcagcagaatttgctgaaagcatcggcgtcgaaatcgatcaaaagccaatgcatgaatcctatgggttaggcgggtttaacacaggcgtatcaacccttgatatggctggtgcttatgcggcgtttggtaacggaggaaaatatatcgaaccacacactgttcgtaaaattgaattccctgacggccgcgtcattgacactacgccagaatcaacacaggcgatgagcgattatacggcctatatgatctctgacatgttgaaaacagctgttgaatcaggaacaggtacagtcgcaagtattccaggtcttcctctcgcaggtaagacggggacaacgaactttgatcgagagatccagcaaaaatatggcctccctagtggagctgttccagaccgttggtttgcaggctatacgacacggtatacagctgctgtttggactggattcactgagttcggtgaggaaaactatttactaagtcaagaggaacaacggatcgccatgcagatatttaaagctgtcatggaagaagtatcaagtaaagtagaaacccctgactttgaaatgccgaactccgttgtccgtattggcattgaaaaaagcacgggattattaccgagcagtcatacgcctcaaagcgaaattgtttacgagctattcgtccgtggaacggaaccgacccgggtgtctgaacaatttgatcgtctgtcaggaccatcaaacctgacagcaaactacaatgaagcaacaggacaaattatcggtagctgggaatatgatgcgtctaagctcgatgaggtatccttccgtttagaaatggccgttggcgatggtggctttaacacgatcgacacgaccaaagatatgcaatttatcgttgatgacgtaaccccaggcacgacctatcgtttccgtgtcactgccgtctctgatagcgattctaatgtgacaagcaactctgccgaagtcaaagtaaccgttccaggcggagaagaagaagagccagatgaggaagaaatgacagagcctgacgaggaagagcaacaggacggcaacgaagaagaggaccctgatcaaggaaatgatcaaaacaacggaaatgaaggtaacaacaacgggaacggcaatggcaatggcaatggaaataacaaccgtccaggtaatgacggacgaccgaatgacaatgatgacgacaatgacgatgatgaaacagatccacctgctacgaaccctccaaacgatgaacaacaggacggagaaacggaatag

SEQ ID NO: 49937 - protein, 886 aa, Bacillus halodurans C-125
MSNEANTRQGRRQAKKKKNDRRKPKRGILKKLFIAFILLFGAIMLAGGITVFAIIAQSPEIDPEKLQFPQGAQIFDQSDEFVSQLDTSERRIQVNYQDIPEELEEAFISVEDVRFRDHFGIDLRRIGGAIAANITSGFGSEGASTITQQLVKNVFLTNEKALTRKIQEQYLAVKLEQQYSKNQILEMYLNQIYLGQGVYGVEQASQYYFGKSITDDSFSLADAALLAAIPRRPSFYDPVVNPENAESRRNLVISMMADQGKITAEEAEAARSIPIAEQLNVQERESYPFEAFYNQVHKEVEEMEGISVNDLYNAGLKIYTTLDTEAQQHVEKVLQTDEFIQTYPNKEDFQAGITLVDTQTGEIKAIGSGRENTNVQRGFNYATDIKRQPGSTIKPILDYGPVIEYLQWSTGRIIKDEPHQYSNGVEFKNFDGAYKGNMTMRQALAESRNVPAIKALQEVGVERAAEFAESIGVEIDQKPMHESYGLGGFNTGVSTLDMAGAYAAFGNGGKYIEPHTVRKIEFPDGRVIDTTPESTQAMSDYTAYMISDMLKTAVESGTGTVASIPGLPLAGKTGTTNFDREIQQKYGLPSGAVPDRWFAGYTTRYTAAVWTGFTEFGEENYLLSQEEQRIAMQIFKAVMEEVSSKVETPDFEMPNSVVRIGIEKSTGLLPSSHTPQSEIVYELFVRGTEPTRVSEQFDRLSGPSNLTANYNEATGQIIGSWEYDASKLDEVSFRLEMAVGDGGFNTIDTTKDMQFIVDDVTPGTTYRFRVTAVSDSDSNVTSNSAEVKVTVPGGEEEEPDEEEMTEPDEEEQQDGNEEEDPDQGNDQNNGNEGNNNGNGNGNGNGNNNRPGNDGRPNDNDDDNDDDETDPPATNPPNDEQQDGETE

SEQ ID NO: 49938 - DNA, 2064 bp, Bacillus halodurans C-125
  CDS (1)..(2064)
atggaagtcgtcattcaacgaaaagcaagaaaacggtggcggttgttcagactttggctccgacttttgctcatcgttcttgtccttggggctggaagtgctgtttctctattatcatacattaaaatgcaaggtcctccgccactccaagtatcacaaacgaccgttttatatggacatgatatgtctgtgatcggggagcatcaccaaggccaacaacgatattgggtcgccttggacgagatttctccttatttaaaagaggctacgatttccatcgaggatcgaaagttttaccagcatcatggatttgatcttactcgtatcggcggagctgttgttgcgaacctacgcgctggctcaatggctcaaggagcaagcacgatcacgcagcaatacgcacggaacttataccttggtcatgataaaacgtggaatcgtaaagcacaagaagccctttatgccctacgtctagaaatgcattacacgaaagatgatattttagaaggctatttaaatacaatctactacgggcacggcgcttatggtatcgaagctgctgctcaacatttcttcggaaaaaaagcagccaacttgacgttagccgaagctagcatgctagccggtgtccctaaagggccgagctactactctccgctcgtagacgaagaccgggcaaaggcacggcaagagatcatcctccaatccatggtcgagaacggatatattacggctcaagaagcagaagaggcgataaatgaagcgctcgattacgtgacagatggtggcatgcgctcagaaacgatcgggccttattttcaagatgtggtcgaggaacagttagtggaagaggtagggctggatccagcattattagaatcaggcgggttgcacatttacaccacactcgacccgcatatgcaggaagaagcggaacgttgggtggaagtggagatgccagattccgatttacaggtagctctcgtagccattgatccaagcacaggtgacgttcgcgccctcgttggcgggaaaaattacggggaaagctcgtttaaccgagcaacgaaagctcgacgctcccctggttcttcctttaagccatttctatattatgctgccctggagcaaggatttacgcctgcatcgacgctcattagtgaaccgacaacgttctcatacgatcaagggcgttctacctattcgccccggaactttcaagaccggtacaaggacgattttgtgacattgctgcaagctctcgccttttccgataatatttttgccgtgaaaacccatatgtttttaggaacagatgagctcgtggagaccgctagacgctttggcattgagagcccgcttcgcgacatcccatcgctcgcactcggaaccttgcccgtcggtgttcttgaactgaccaaaagctacgttcctttcgcgaacaatggatttacggtcgaaccacgcttcattacaaaagtagttgatcgagacgggaatgttctttatgagcaaatgccggaaacagagcaaacgttagatcctagactaacctttattatggcagacttaatgaccgctatgttcgatccatcccttaacgactatatgtcggtaacgggtagctccgtcaaccatcttgtcaatcgccctgttgccggtaaatctggatctacatcgaccgatagttggatggtcgggtttacgcctcagctcgtaacaggggtatggatcggttatgaccaaagtgaaacccttaaccacggaacagaaggccaagtggctaaacggatttgggccaacttcactgaacatgcattagagaacgagctgatgctacaatttcgacaaccgccaggcgtcgtctctgttaacatgaacccatctaacggctttctagcaaatgatgtgtgccctaatggcagaaaaacctttttcgtcgaagggacagagccgacggaaggctgcccagaagaagcgagggacaatgaaaccgatgcgatcgatgaagaaaaccatgaaaaagagcgttttctagaccgctttattcgctggttccattga

SEQ ID NO: 49939 - protein, 687 aa, Bacillus halodurans C-125
MEVVIQRKARKRWRLFRLWLRLLLIVLVLGAGSAVSLLSYIKMQGPPPLQVSQTTVLYGHDMSVIGEHHQGQQRYWVALDEISPYLKEATISIEDRKFYQHHGFDLTRIGGAVVANLRAGSMAQGASTITQQYARNLYLGHDKTWNRKAQEALYALRLEMHYTKDDILEGYLNTIYYGHGAYGIEAAAQHFFGKKAANLTLAEASMLAGVPKGPSYYSPLVDEDRAKARQEIILQSMVENGYITAQEAEEAINEALDYVTDGGMRSETIGPYFQDVVEEQLVEEVGLDPALLESGGLHIYTTLDPHMQEEAERWVEVEMPDSDLQVALVAIDPSTGDVRALVGGKNYGESSFNRATKARRSPGSSFKPFLYYAALEQGFTPASTLISEPTTFSYDQGRSTYSPRNFQDRYKDDFVTLLQALAFSDNIFAVKTHMFLGTDELVETARRFGIESPLRDIPSLALGTLPVGVLELTKSYVPFANNGFTVEPRFITKVVDRDGNVLYEQMPETEQTLDPRLTFIMADLMTAMFDPSLNDYMSVTGSSVNHLVNRPVAGKSGSTSTDSWMVGFTPQLVTGVWIGYDQSETLNHGTEGQVAKRIWANFTEHALENELMLQFRQPPGVVSVNMNPSNGFLANDVCPNGRKTFFVEGTEPTEGCPEEARDNETDAIDEENHEKERFLDRFIRWFH

SEQ ID NO: 49940 - DNA, 2328 bp, Pasteurella multocida subsp. multocida str. Pm70
  CDS (1)..(2328)
atgccaaaatccaacaaaaccaatgtaagccgaaaaaaatcttcttggcccctcttatgtgccaaagtgagttttacattaatctgtatgttggcgttttatggattgtatttagattggcaaatacgctctaaaatggatgggcagatctggcgactccccgcagaagtctatagccgtattgaacgtatcagtcttgaagaacaactgagctttgaacaagtcaaacaacgtttattagacaatgattatcgtcaaaccaccctagtagcagcccctggcgattttaaagtggaaggtgacaccctcgttttgctacgacgcgcgtttccctttcctgtacaaccagaagcacagcgtgtctttcgtctacgttttaaacacaatcaattggcagtaattgaagatttaatcaaccaacgtaccattcctgagtttcgtttagcgccaaaattaatcgctatgctacagtcagagaaagaagagcgtttagcgatcccactccataactatccacgtttattaatcgatgcattattacttaccgaagatcgtcgcttttaccaacatgaaggaatcagtttactcggcattgcacgtgcgatgatcaccaatattcaagcaggtcatactgtacaaggtggcagtaccttaacgcaacaattagtcaaaaacctgtttttaagtaacaaacgaaccctaagccgtaaagtcaatgaagccttgatggccgtgattttagattggcgttacgataaaaatcgtattttagaaacctatttaaatgaaatttatttaggacaaaatggcgatactcaaattcatggctttgaactggctagccacttttattttgggcgctcaaccaacgaaattagtttggatcaaatcgccttattagttggcatggtcaaaggtccttctctttataatccttggcggaatccgaacaccgcattagagcgccgtaatgtggtactgcgtttactcctcgatcatcaagtaattgggcatgaactgtatcaaatgttagtccagcgtccattaggcgtacaagaacgtggtcaaattacgcgcaagtaccctgccttcattcagaccttacaagctgaattacgtgagcaattaggcgaaaacaaagccacgaatttattaggagcacggattttttcaaccttagatcctaaacaacaaacccatgcagaaaatgcagtagtcagtgcgacatctaccttacaagcgaaacacaaaaacccccatttacaatctgcgatggtaattgctgattatcgtttaggcgaagtgcgggccattgttggtggtttacaaacacaatatgcgggctttaatcgtgccttaagcgccaaacgccaaattggctctttagtaaaacccgccatttatttgaccgcactttcagtacctgacaagttccgtcttaatacagcgattcaaaatcaaccgattaccattcaaattaaaggcagcccaccgtggcaaccgcgtaactatgatcgcaaatacagcggttccgtgatgttaatggatgccttagctcgttccttaaacatcccaacagtaaatattgggatgcaagtgggattagagaaagtgattgaaacacaaaagaaaatgggttgggataaagtacaaatccccaaagtacccgccactttattgggcgcttatgcgatttccccttacgaagtcacgcatttatatcaagtgatcgccaatcaaggacaaaaaatcccgttggcgaccattgacagcatcacagaccaacaaggaaatctcttatatcaacgccgcttagaacctgagcaagtggtaccggctgaagccagttatcaaacactgtatgctatgcaacaaaccgtaacgcgaggcactgcgcgcagtttacaaaaccaatttagtcacttacatcttgccggaaaaacaggcactaccaatgatgcacgtgatacctggtttgtgggcattgatggtgaaaacatcgtgacggtttggttagggcgtgatgataatggcgaaaccaaactaactggcgcttctggtgccttgcaaatttatcaaaattatttacagcgtcatccggcaactgtacttcacttaccttctcttaacagtattcaatgggtaggtattaatgattatggtagttgggattgttcaagcgcacgtcaaattcccgtttggataaatcatgctcagtctttttgccaagcacctgaaatcagcaaacaagaaagcgtatgggatgtgttatcgccgggtgctccatcaaaccaaccggcaccagtagaagatgccattgctaactga

SEQ ID NO: 49941 - protein, 775 aa, Pasteurella multocida subsp. multocida str. Pm70
MPKSNKTNVSRKKSSWPLLCAKVSFTLICMLAFYGLYLDWQIRSKMDGQIWRLPAEVYSRIERISLEEQLSFEQVKQRLLDNDYRQTTLVAAPGDFKVEGDTLVLLRRAFPFPVQPEAQRVFRLRFKHNQLAVIEDLINQRTIPEFRLAPKLIAMLQSEKEERLAIPLHNYPRLLIDALLLTEDRRFYQHEGISLLGIARAMITNIQAGHTVQGGSTLTQQLVKNLFLSNKRTLSRKVNEALMAVILDWRYDKNRILETYLNEIYLGQNGDTQIHGFELASHFYFGRSTNEISLDQIALLVGMVKGPSLYNPWRNPNTALERRNVVLRLLLDHQVIGHELYQMLVQRPLGVQERGQITRKYPAFIQTLQAELREQLGENKATNLLGARIFSTLDPKQQTHAENAVVSATSTLQAKHKNPHLQSAMVIADYRLGEVRAIVGGLQTQYAGFNRALSAKRQIGSLVKPAIYLTALSVPDKFRLNTAIQNQPITIQIKGSPPWQPRNYDRKYSGSVMLMDALARSLNIPTVNIGMQVGLEKVIETQKKMGWDKVQIPKVPATLLGAYAISPYEVTHLYQVIANQGQKIPLATIDSITDQQGNLLYQRRLEPEQVVPAEASYQTLYAMQQTVTRGTARSLQNQFSHLHLAGKTGTTNDARDTWFVGIDGENIVTVWLGRDDNGETKLTGASGALQIYQNYLQRHPATVLHLPSLNSIQWVGINDYGSWDCSSARQIPVWINHAQSFCQAPEISKQESVWDVLSPGAPSNQPAPVEDAIAN

SEQ ID NO: 49942 - DNA, 2562 bp, Pasteurella multocida subsp. multocida str. Pm70
  CDS (1)..(2562)
atgcggatcgcaaaactaatactcagtaccctgctcacgctcatcgtactaggctgtctcgcgctaggtgcgatctatgtttatttaaaggcggacttaccggatgtagaaagcctaaaaacagtcgaattacaacagccaatgcaaatttatacggctgatggcaaactgattggcgaagtgggagaacaacgtcggattccagtgccactggataaaattccaaaacaactgattcatgctgttttagcaacagaagataaccgtttctatgaacatcatgggctcgatcctattggcattgcgcgtgctattatggtcgcggttacgaagaaaggcgtttcacaaggcgccagtacaattactcaacaattagcacgaaattttttcttaacccctgaaaaatcgcttgaacgcaaagctaaagaagccgttttagccattgatatcgaaaatacactaagtaaaaatgagattttagaactctatctgaacaaaatttatttaggctatcgttcttatggcgttgccgctgccgccaaaacctattttggcaaagagctcgatcaactaagcttgtccgaaattgcgattatcgctggcttacctaaagcaccttccacaatgaacccgatttattcattaaaacgggcgcaagaacgccgtaatattgtcttaggacggatgttaaccactaaatacatcacacaagaagaatatgacgcggcaatcaaagaacctatcgtcgcgcgctaccatggtgcacaaattgatttccgtgcagactatgtcactgaaatggcacgtcaagaaatggtcagacgttttggtgaagaaaaagcctacactagcggttttaaagtttatactacggtgctttcgaaggatcaggctgaagcgcaaaaagccttacgtaataacttaattgattacgatatgcgccatggttatcgtggcggtgcgccactttggcaaaaagacgaaacggtgtgggacaatgatcgtatcataggtttcttaaaaaaattaccacattctgaaccgctcttaccggctgccgtcatgaatatcagcaaaaccggagcagaacttcttctagcctcaggtgaacgcatgaccttatcacacaatgctatgcgttgggcgggtaaaaaaacaccaaaagtaggcgaacaaatttggattcgtcaaaaagagaaaggggaatggattctggctcaagtgccggaagtcaactctgccttggtatccttaaatagtgataatggtgcaattgaagccttagttggtggatttagtttcgaacaaagcaaatttaaccgtgctacacaatctttagtccaagtgggctcttcaattaaaccgtttatttatgcggccgcattagaaaaagggttaacgctttcaagcgtcttacaagactcgcctcttgtcatacaaaaagcaggacaaaaaccttggcagccaaaaaactcaccaaatcgatttgatggaccaatgcgcttgcgggttggcttaggattatcaaaaaatatgattgcgattcgtgcgatgcaaatggcgggcattgattttacagcagaattcttacaacgctttggttttaaacgcgatcaatacttagccagtgaagcccttgccttaggtgcggcctcttttactccacttgaaatggcaagaggctacgcggtctttgacaatggcggtttcttagttgatccctttattattaatcgtattttagacaatacgggcaaagagattttcttagccaatccgaaaattgcctgtattagctgtcataatattcctgtgctctatggtgaaactgaaaaactggatgcatttaaaaactacgacttaagcttaacggagaatttcgataccaatatcaatggggaagaagaaaacgatgtcggtgatttgatccctgacttgccagaacttcaaccaacggcacaaacacaattagatgaaaataatcttagctttatggctgcggctaaaacagataatgctgaaacccaatatgcaccgcgcgtgattagcggtgaattggcctttttagttcgcagtgctttaacctccgctatttatggcgagccgggtaaaagctgggtggggactagctggcgcttatctaaagcctttaaacgtcaagatatcggtggaaaaaccggtactacgaataattcgaaagttgcttggtacgctggctttggcgcacatttaaccaccgctgtgtatgttggcttcgacgacaataagcgtaatttagggcgcggcgaagcaggggcaaaaacggctttacctgcgtggcaagcctatatgcaagtaagcttagaaaatattccagaacgtaaattgagtccaccacccaatattattgaaaaacgcattgatacgggttctggcttactcacggaatctggtggacgaatggaatattttatcaatggtacagaacctaaacggagttatgtagaagaacaaggctactacatcccatctgatgagataaacgaaaattccccaatccaagaacgggaagaacttttctaa

SEQ ID NO: 49943 - protein, 853 aa, Pasteurella multocida subsp. multocida str. Pm70
MRIAKLILSTLLTLIVLGCLALGAIYVYLKADLPDVESLKTVELQQPMQIYTADGKLIGEVGEQRRIPVPLDKIPKQLIHAVLATEDNRFYEHHGLDPIGIARAIMVAVTKKGVSQGASTITQQLARNFFLTPEKSLERKAKEAVLAIDIENTLSKNEILELYLNKIYLGYRSYGVAAAAKTYFGKELDQLSLSEIAIIAGLPKAPSTMNPIYSLKRAQERRNIVLGRMLTTKYITQEEYDAAIKEPIVARYHGAQIDFRADYVTEMARQEMVRRFGEEKAYTSGFKVYTTVLSKDQAEAQKALRNNLIDYDMRHGYRGGAPLWQKDETVWDNDRIIGFLKKLPHSEPLLPAAVMNISKTGAELLLASGERMTLSHNAMRWAGKKTPKVGEQIWIRQKEKGEWILAQVPEVNSALVSLNSDNGAIEALVGGFSFEQSKFNRATQSLVQVGSSIKPFIYAAALEKGLTLSSVLQDSPLVIQKAGQKPWQPKNSPNRFDGPMRLRVGLGLSKNMIAIRAMQMAGIDFTAEFLQRFGFKRDQYLASEALALGAASFTPLEMARGYAVFDNGGFLVDPFIINRILDNTGKEIFLANPKIACISCHNIPVLYGETEKLDAFKNYDLSLTENFDTNINGEEENDVGDLIPDLPELQPTAQTQLDENNLSFMAAAKTDNAETQYAPRVISGELAFLVRSALTSAIYGEPGKSWVGTSWRLSKAFKRQDIGGKTGTTNNSKVAWYAGFGAHLTTAVYVGFDDNKRNLGRGEAGAKTALPAWQAYMQVSLENIPERKLSPPPNIIEKRIDTGSGLLTESGGRMEYFINGTEPKRSYVEEQGYYIPSDEINENSPIQEREELF

SEQ ID NO: 49944 - DNA, 1995 bp, Lactococcus lactis subsp. lactis Il1403
  CDS (1)..(1995)
atgtggacggcagtaaaattatttttaattgctttcttttctttaattatcctagccttagccgctgggggcgccgttttcgtttattatgctaaggatgcacctgcactcactttggacaaacttgaatctaaaccttctactaaagtttatgactctagcgaaaaagtggtggcaactttaggagctgaacaaagaaatctggttaaaactgataatattccagtaatgttggttaatgcggttacttctattgaagaccatcgtttcttcaatactcgtggaattgaccccattcggattgctggagcttttgttaataatttaaaaggtggttctttaaacggtggttctacacttgatatgcagctcattaagctttcattcttctcaaccgatgaatcagaccaaactttgagtgttaaaattcaagaagcttggatggccttaaaattagaccaaaaatggaccaaggagcaaatttttacagcttatgttaataaggttaatatggcaaatggttattatggaatgggaactgcttcccaagcctattatggcaaagatttaactcagctttcaatcgctcaacttgccctacttgctggaatgcctcaagctcctaatacttataatccatatactaaccctacttctgctaaatggcgccgtgatatggttatccgtgcaatgcgtcgttacgataaaattacagctgaagaagaaaagaaagcactggctaccccaattgatgatggacttcaacctttaaaacaaagtgtaactattccaagttatgctgataatttcctcaaacaggcaattgctcaagctaaaactttggctggagatgatattttgactgagggagctaaaatttatactactcttgatacaacagcccaacaaaatctatataatattgttaacactggcaactatatcacttatccagatgatacaatgcaagttgcttcaactgttactgatgtcaaaacaggtgctgtaattgcacaaattggtggtcgtaatcaaccaagcaatgttacttttggctttaaccaagccgtgcaaacagaccgagattggggttcgaccatgaagccaattgtcgactacggtccagcttttgaaaataatatttatacttcaactaataattatgtttccgattccccaactacttatccaaatggaacgcctttaaaaaactgggataatacttattttggttcaatgactgtcaaaagtgccttagcactttcacgtaacatcccagctgttaaaactttaatcaatgttggactagataattctagcaaatttgttaatggtctaggaattactttagatcctctggaatactctaatgccatctctagtaactctaaaaatggtggagcaagttctgaaaaaatggctgctgcttatgctgccttctcaaatggtgggatttacactaaaccttattatgtttccaaagttgtcttccccgatggtcgtacagttgaatacaaaccggaccgctcacgagcaatgcaagcctcaaccgcttatatcatgaccaatattcttcaaagtgttttaacattgccactttctgaatctgttggttcttacgctgctgttcccggcttagcagccgctggtaaaactggtacatctaactatacagatagtgaaatggatcaaatcactgagaaatacggttcccttccaggtatggtttctccagacgaaaactttgttggttatactcctcagtattcaatggctgtttggaccggttattcaaatcgaatgacgccaatttatggtacaagtactcagattgcaaccaaagttttctcatctatgatgactcaacttactcctgatccttcatctgttgcgacatggacaatgcctgagggtgttagtcaagaaggaactgctcttgttaaaacagatagttctggtcaaacaataagtcaatcctccgctaatggtagttaa

SEQ ID NO: 49945 - protein, 664 aa, Lactococcus lactis subsp. lactis Il1403
MWTAVKLFLIAFFSLIILALAAGGAVFVYYAKDAPALTLDKLESKPSTKVYDSSEKVVATLGAEQRNLVKTDNIPVMLVNAVTSIEDHRFFNTRGIDPIRIAGAFVNNLKGGSLNGGSTLDMQLIKLSFFSTDESDQTLSVKIQEAWMALKLDQKWTKEQIFTAYVNKVNMANGYYGMGTASQAYYGKDLTQLSIAQLALLAGMPQAPNTYNPYTNPTSAKWRRDMVIRAMRRYDKITAEEEKKALATPIDDGLQPLKQSVTIPSYADNFLKQAIAQAKTLAGDDILTEGAKIYTTLDTTAQQNLYNIVNTGNYITYPDDTMQVASTVTDVKTGAVIAQIGGRNQPSNVTFGFNQAVQTDRDWGSTMKPIVDYGPAFENNIYTSTNNYVSDSPTTYPNGTPLKNWDNTYFGSMTVKSALALSRNIPAVKTLINVGLDNSSKFVNGLGITLDPLEYSNAISSNSKNGGASSEKMAAAYAAFSNGGIYTKPYYVSKVVFPDGRTVEYKPDRSRAMQASTAYIMTNILQSVLTLPLSESVGSYAAVPGLAAAGKTGTSNYTDSEMDQITEKYGSLPGMVSPDENFVGYTPQYSMAVWTGYSNRMTPIYGTSTQIATKVFSSMMTQLTPDPSSVATWTMPEGVSQEGTALVKTDSSGQTISQSSANGS

SEQ ID NO: 49946 - DNA, 2232 bp, Lactococcus lactis subsp. lactis Il1403
  CDS (1)..(2232)
atgtctgaaaataataatttcagtcggcgtaataaaaaggaatctaaaaaaaatagtttaaaaattcctaatttacgccctaaaaaacaaaaaaagcttgaagaagaaatagaaaaaccggctaaaacgaagttcggtaaattcatgaaaccaattaaacggttctggaaacgttataatctgacaaaaatcacaattatttttgtcttagtagccattgtttcgacaggttcatatcttttttacttagctaaaacagctaatgttaaagtactgcaaagttctatttcggcacaaacagtcatttatgacaaagataataatgaagctggaaatctttatggtcaaaaaggaacaccggtcaagattgaccaaatttccaaaaatattacaaatgctgttgtggcaactgaagatagaactttctataaaaatcatggtgtcaatttgaaacgttttgctctagcagccgttactcttgggcgttttggtggtggttcaacaatcactcagcaattggccaaaaatgcttatttgactcaagaacaaacgattgaccgtaaagcgcgtgagtttttcttggcacttgaaatcaataaacattatagtaaagatgagattcttgatatgtatctgaataattcttactttggtaatggtgtttggggaattcaggatgcagctttgaaatactttggtgttccagcaagtgaagtaactgttgatgaagcagccagtcttgcgggaatgttaaaagggccagaaatttataatcctctttacgaaaaaggaaaatatgcgactgaccgacgtaatacagttttgcaaaatatggttaatgctggttatttggagcagtcacaggcagatacttttatgaaagttgacttacaagctcaattgcaagacaattatcaatctaaaagtagtcaatataaatatccaagctattataatgctgtaatttctgaagcggaacgcaagtatggtctgacattacaagaaatcatgaataatggttacaagatatatacgggcatggaccaaaatatgcaatccggtttgcaaaagacttattctgacccaagtttcttcccacaagcatctgatggaacttatgcccaatctgcttcggttgctattgaccctaaaacgggagctgtcaatgctcttgtcggaaatgttaatacagaaggttcaaatagctttactgattataactatgccacaatgtctaaacgttctcctggttcagttatcaaacctcttattgtttacgctccagcaattgaagcggggtggtcaattgataaaacggttgatgattcaccagcagattataatggctggaaaccaaccgattttgataatcaatggcgtggacaaatcccaatgtatactgctttagcaaattcatataatattccagctattaatacatatcaagcgattggaccaaaagtcggaaatgctttagggcgtgagtttggtttagatttaagtagtaaaaatgatgttttaccgacggcactcggagctggagttgaaacgaatccatggcaaattgctcaggcttatcaagttttcgcaaatggcggagtgatgaatgatgcgcatttgattactaaaattgaaaatgctgcaggacaagttgtaaaaacagcaaaggtaaccaaaaaacgggttattagtaaagatacagctgacaaaatgactcaaatgatgctggggacttatactaatggttctgcttggaaagcttcacctaagtcttatacacttgctggtaagacaggaaccaatgaagaccaagaccaatgggtagtaggttatacaccggatgtggttatggctctctgggttggttatgcggatgggaaatataaactgacaggttcatcagaaggacaaacctcagtcattttccgtcaagaagctagttatatgttgccttatactaaaggaacggcatttacagttgaaaatccttatgcggaagcaggtgttgccgcacaagaaccttattggactcaacaaagacaatatcaagatgatattgtggaccaagaacaagcagaggctcacacgactggaaatacaccagaaagctctagttctagctcttcatcgtcttcagattctggtggtttggacctcggaaaagtgggtaaagatattggagatgcagctaaaaatgcttgggataaagttaaaggaatttttggcaactaa

SEQ ID NO: 49947 - protein, 743 aa, Lactococcus lactis subsp. lactis Il1403
MSENNNFSRRNKKESKKNSLKIPNLRPKKQKKLEEEIEKPAKTKFGKFMKPIKRFWKRYNLTKITIIFVLVAIVSTGSYLFYLAKTANVKVLQSSISAQTVIYDKDNNEAGNLYGQKGTPVKIDQISKNITNAVVATEDRTFYKNHGVNLKRFALAAVTLGRFGGGSTITQQLAKNAYLTQEQTIDRKAREFFLALEINKHYSKDEILDMYLNNSYFGNGVWGIQDAALKYFGVPASEVTVDEAASLAGMLKGPEIYNPLYEKGKYATDRRNTVLQNMVNAGYLEQSQADTFMKVDLQAQLQDNYQSKSSQYKYPSYYNAVISEAERKYGLTLQEIMNNGYKIYTGMDQNMQSGLQKTYSDPSFFPQASDGTYAQSASVAIDPKTGAVNALVGNVNTEGSNSFTDYNYATMSKRSPGSVIKPLIVYAPAIEAGWSIDKTVDDSPADYNGWKPTDFDNQWRGQIPMYTALANSYNIPAINTYQAIGPKVGNALGREFGLDLSSKNDVLPTALGAGVETNPWQIAQAYQVFANGGVMNDAHLITKIENAAGQVVKTAKVTKKRVISKDTADKMTQMMLGTYTNGSAWKASPKSYTLAGKTGTNEDQDQWVVGYTPDVVMALWVGYADGKYKLTGSSEGQTSVIFRQEASYMLPYTKGTAFTVENPYAEAGVAAQEPYWTQQRQYQDDIVDQEQAEAHTTGNTPESSSSSSSSSSDSGGLDLGKVGKDIGDAAKNAWDKVKGIFGN

SEQ ID NO: 49948 - DNA, 3030 bp, Deinococcus radiodurans R1
  CDS (1)..(3030)
atgtggtatgcgcccgccccaggaggcccggcattgattttcttcctgcgttttctcaagttcctgtcgtctctggtgatcgcggcgctcgttgcaggcgtcggcgtggcggccacctacgtggcccagtggggccgtgaactgcccgattaccgcgagctcgataacctgacccgttcgctcggcgccgagacccgcgtgtatgcccgcgacaacacgccgctgggcaccctgattccgcgcatcggtgatcaggcggtcagccgcaccctggtgcaactcgacgaggtcagccccttcatggtcggcacactgatcgccaacgaggaccggcgctttttcgagcactacggtctcgatcccctcgggctggcgcggcaggtgcagcgcctcgcacgcggtgaagaggtgcaaggcggctcgaccctgaccaaccagctcgtcaagaacaccctgctgctcgaggagtacaaccaggcccgtacccccgaccgcaaggtcaaggagtggctgctctcggcgcaggtcgagcggtcctttaccaagtccgagattttgcaggactacctcaacgcgatctactggggcgacggcggcccggttgagctctacggcgtgtactcggcggcgcaggcgtatttccgcacggcgcccaaggacctgacgctggcgcaggcggcctacctgacttctctgattcccaacccgcgcaaccgctacgagaacttcgagcggcaggtgcgccccgccatgaaggtgatgctggcgcgcatggtgcaagacggctggatcacccagaaccaggccgacgccgcctggaaggaaaagatccagccgcgcggctggaccatcgtctacgacgacgcgggcaacgtcaaaagcgccaagctgaccgaccccagcgccaaggaactcaaggccgtgacgaccacccgcgccccgcacttcgtccggcaggtcgaggacgaactgattcggcgcttcgggcgcgaaaaggtgcgcgagtccggcgggctgcgggtgtacaccacgctcgaccccaaggtgcaaaacgccgtcgaaaccgccagccgcgaaacctactacggctacatgacggctcagggacaggcgctgccgcccggcaccaccctggccgccgtcatcatcgatccctacaccgccgaggtgcgcggcatgatcgggcaaaagctggtgggcagcgacccgcccgccgactggaacaacgccgcgcagggccagcggcaggtgggctcgaccatcaaaccgctgctctacaccaccgcgctggaaaaaggcgccacgcagctcatgcgccagcaagacacccgctggtgcacccgcgacatcggctcgcgcggcggctggtactgcccgcaggactgggaaggcatcacgaccaaccgctccatgaccatccgcgagggcctcgacaagtcgctgaacctcgtcgcggtgcgcgtggccgagtacgtgggccttgagacctttttcaacaagctcaagctgctcgacattccgccgaacgaaggcaccagctacgcggcggcgctgggcgcggtggaaaccaccccggtcaagctggcggcggcctacgcgcccttcgtcaacgggggcctgtaccgcccgccgcgctacatcaccaaggtgaccaatgcacgcggcgaggtgctctacgacgccgacaccgacgtgcagttgccgacccgcgtgtggtcgccgcaagtggcctaccttggcctcgacatgattcgcggcgtggtcaacgacctcggcgaccagcagggcggattggcgagccgcgcgaagtttggcgactggccggtgggcggcaagaccggcaccaccaacggcgtgaccagcggcaacaaggacttctggttcgtggggaccacccccatctacaccggcgccgtctgggtcggcaagcagcagagcggcgaaatgtcgcgcaactactactccggctgggtcaacggccccatctggcgccgcatgatggagctcgcgcacaaggacaagacgccggtcaagttcaacgagccgcccggcatctaccgcgtgccggtgggcgaggccacgctgccgggcgtgacggtcgccatgatggacccccgctaccgccgcagcacgaccgaagtcgtgcccgaagcagtgcccgaaggccccaagtactccgaaaccaccttcgaccccggcacccaggacgcgaacacggtggtcgtggacatcgaccgcgccacgggccgcatcgccaccgagttcaccccgcccgagaacgtggtgcagcgccgagtggaaatccggcagttgcccggtacgcgcccgccgccaaccccgcgccgctcaccgaccagcagcccgaccccgccgcgctcaagcaggtcaagccgcaggccccgctgccggtggcgcccgccactcaaaaacctgcacagaaacccgcgcagccctgagctcctgcccccttcctacaccgcccgcgccctatgccgggcggttttccgtgctgcgtgcgctgagccttctcaccctgccgtcatccggcgcggcgcggggcgcgggcatagtcgggaagctatggcagacctttccggcccggcccgcgcttcacgccctgcattcgccttcccggcccggcggctgggggcgccgctgctctcgctgctgctggcgctcggcgcggggggggcggacgcccgcgtgcggctgggagagctgctgccggcccacccctggcagagtgccgagcgcgaggtcgtggtggtctacacccacgactgcggcgacctcggtgaattgtggggcgcggtgctgcggagcggcctgccggtgcgcgccgtcaacgccgaggacgtgacctcgccggccccggcgggcctgaagccctggcgtggtccggaggcgacgcagtttgcccggcagctcaaggtgggcacctacccggcggtcttgctggtgcgtggcgggcgcattctcaacgcctgggaaggcacttttcagggcacggggctgacgaagggcgagtga

SEQ ID NO: 49949 - protein, 1009 aa, Deinococcus radiodurans R1
MWYAPAPGGPALIFFLRFLKFLSSLVIAALVAGVGVAATYVAQWGRELPDYRELDNLTRSLGAETRVYARDNTPLGTLIPRIGDQAVSRTLVQLDEVSPFMVGTLIANEDRRFFEHYGLDPLGLARQVQRLARGEEVQGGSTLTNQLVKNTLLLEEYNQARTPDRKVKEWLLSAQVERSFTKSEILQDYLNAIYWGDGGPVELYGVYSAAQAYFRTAPKDLTLAQAAYLTSLIPNPRNRYENFERQVRPAMKVMLARMVQDGWITQNQADAAWKEKIQPRGWTIVYDDAGNVKSAKLTDPSAKELKAVTTTRAPHFVRQVEDELIRRFGREKVRESGGLRVYTTLDPKVQNAVETASRETYYGYMTAQGQALPPGTTLAAVIIDPYTAEVRGMIGQKLVGSDPPADWNNAAQGQRQVGSTIKPLLYTTALEKGATQLMRQQDTRWCTRDIGSRGGWYCPQDWEGITTNRSMTIREGLDKSLNLVAVRVAEYVGLETFFNKLKLLDIPPNEGTSYAAALGAVETTPVKLAAAYAPFVNGGLYRPPRYITKVTNARGEVLYDADTDVQLPTRVWSPQVAYLGLDMIRGVVNDLGDQQGGLASRAKFGDWPVGGKTGTTNGVTSGNKDFWFVGTTPIYTGAVWVGKQQSGEMSRNYYSGWVNGPIWRRMMELAHKDKTPVKFNEPPGIYRVPVGEATLPGVTVAMMDPRYRRSTTEVVPEAVPEGPKYSETTFDPGTQDANTVVVDIDRATGRIATEFTPPENVVQRRVEIRQLPGTRPPPTPRRSPTSSPTPPRSSRSSRRPRCRWRPPLKNLHRNPRSPELLPPSYTARALCRAVFRAACAEPSHPAVIRRGAGRGHSREAMADLSGPARASRPAFAFPARRLGAPLLSLLLALGAGGADARVRLGELLPAHPWQSAEREVVVVYTHDCGDLGELWGAVLRSGLPVRAVNAEDVTSPAPAGLKPWRGPEATQFARQLKVGTYPAVLLVRGGRILNAWEGTFQGTGLTKGE

SEQ ID NO: 49950 - DNA, 2430 bp, Clostridium acetobutylicum ATCC 824
  CDS (1)..(2430)
atgtctgataatactaagactaacagtagaaataaatctgttaaaagaacaaaaaaagtgaagaagaaaaagaagtttggcttctttaaaaaattgtttactatattattttgcctttttattttattatctgttgcagcttctggagtaatatttgcaatagtaaaaacatctccaaatttagatataaatggtacaatattaaatttagatcagccttcacaattatatgatgataacaataacccaatggatacagttgtaacaaaccaaagacgttatgttgtcagtataaaggatatgcctaaaaatttatcaaacgcttttgtaagcattgaggatgaacgtttttacaaacacagtggaatagatactaaaagaatacttggtgcattttacaacgacataaaatcaaaaattcacaaacaaaatagtatccaaggtgcatcaaccataacgcaacagctcataaaaaatagaatgtttttaaacgattcattagaaaatagaatttcatttaaaagaaaaatacaggaagcttatttatccataaagcttgaacaatcactcagcaaatcccagatactggaagcgtatatgaatacaatttttcttggtgttcaagctaacggtgtagaggcagcttcacgacaatattttaataaaagtgctaaggatttgaatttaattgaatgtgcctttattgcaggccttgcacaaagtccatcagcatattatcctttttcgcaaaatgtagctaaaaatccaaatatatatttagatagaacaaagctagttttgtataaaatgagacaaaataactatatagatttttcaacttatcaaaatgctataaatgaccttaacaataataaattagctttttctcagcaaaagatttctaacaagtatacctatgagtggttttctatacctgttgtaaaccaagtaaagcaagatttaaaatctcaatatcattatactgatgaagaaatagattcacttcttagagatggtggactaaaaatatatactactatgaacacatcaatggaatcaaatgtacaaaacatattagacaacaacagcacattaaaaagctatagctatgcagataaaaacggtattattcaacctgaagctgctgcaactttatttgattatcacacaggagaaataaaggctattgtaggtggaagaggccaacaaccaccttcatcgtataatagagcggattcaagtaactatttacgttctgtaggttctagtataaaacctcttacagtttatgcaccagcaatagatactaaacttgcgacagaagatactatagttaatgattccccactttcatcggatgttgcagaaaagtatgggtcaaatggggttccatataatcctcataacgatgatggtggttattcaggtccagtaaatttaaagacagcattaaccaagtcaataaatcttgtagcaataaagttagaggataaattaggactttcaacaggagcagcttatgctcaaaaatttggtcttactcttaacaatgatgataagagtagtattgctgcattatctcttggtgaaattagaggttcaaatacaactactatggctgccgcttacggtgtatttggaaataacggattatattcagaacctaggctatatagaaaggtagtagataaaactggtaaggtacttctggagaacaactattcaactagaaaggttatttcaccacaatctgcttacataatgtatgatttattaaaaggtcctgtaagtgcaggaggtactggtagttatgctagatttggtgacatgccggtcgctggtaaaacaggtactgcatctgattctaaaaatttgtggttttgcggtttgactccatattattctgctgcagtatgggtcggaaatgaccagccaactaaactcagtttaggaagtaatgatgttgctgaaatatggggcgaaattatgaaaatggcaaatgtaaatttaactgttaaagatatcgatgctcctggtggggtaacaaaaattggagattcatattatatagatggtactagtccatctaatttatctggggatgattcttcatcttcaactgctagtaaacctcaaacaccaactactaacactcaaaataatacgaacaataatgttgctaatccaaatagtaacaatacaactaatagtaataccagtaactcaacagagacaccagcacaaaatactcagcaacctactcctacaccaacaccttctaccaataatacgcctggtaatacaaacactaataccaatactaacaataacacgaatacaaatactaatactaataacaataacacaaataactcaagttctggaaataacaatccaccaaataataacacaacaaatactaataaataa

SEQ ID NO: 49951 - protein, 809 aa, Clostridium acetobutylicum ATCC 824
MSDNTKTNSRNKSVKRTKKVKKKKKFGFFKKLFTILFCLFILLSVAASGVIFAIVKTSPNLDINGTILNLDQPSQLYDDNNNPMDTVVTNQRRYVVSIKDMPKNLSNAFVSIEDERFYKHSGIDTKRILGAFYNDIKSKIHKQNSIQGASTITQQLIKNRMFLNDSLENRISFKRKIQEAYLSIKLEQSLSKSQILEAYMNTIFLGVQANGVEAASRQYFNKSAKDLNLIECAFIAGLAQSPSAYYPFSQNVAKNPNIYLDRTKLVLYKMRQNNYIDFSTYQNAINDLNNNKLAFSQQKISNKYTYEWFSIPVVNQVKQDLKSQYHYTDEEIDSLLRDGGLKIYTTMNTSMESNVQNILDNNSTLKSYSYADKNGIIQPEAAATLFDYHTGEIKAIVGGRGQQPPSSYNRADSSNYLRSVGSSIKPLTVYAPAIDTKLATEDTIVNDSPLSSDVAEKYGSNGVPYNPHNDDGGYSGPVNLKTALTKSINLVAIKLEDKLGLSTGAAYAQKFGLTLNNDDKSSIAALSLGEIRGSNTTTMAAAYGVFGNNGLYSEPRLYRKVVDKTGKVLLENNYSTRKVISPQSAYIMYDLLKGPVSAGGTGSYARFGDMPVAGKTGTASDSKNLWFCGLTPYYSAAVWVGNDQPTKLSLGSNDVAEIWGEIMKMANVNLTVKDIDAPGGVTKIGDSYYIDGTSPSNLSGDDSSSSTASKPQTPTTNTQNNTNNNVANPNSNNTTNSNTSNSTETPAQNTQQPTPTPTPSTNNTPGNTNTNTNTNNNTNTNTNTNNNNTNNSSSGNNNPPNNNTTNTNK

SEQ ID NO: 49952 - DNA, 2304 bp, Sinorhizobium meliloti 1021
  CDS (1)..(2304)
atgggcacccggtccggccccaaagggatatttccttccggcatggcgagcggcaaatcaggacagcggatcgagccttccttcggcggtaacgacggcgacggcggcgacctgcgcgtcgatgcgagcgatcgcgtcgcgggcggcggcagcaagccgaggcgcgccaagtcgcccgaacgcggcgccaagcgagaaaagcgcggcaggcgcgccggcggccgcggctccgggagaagtggttccggcggcgggttcttcggcctcgtccggcggctcgcctattggtgcgtcgtgctcggcatatggggtgcgatcggcgtcggcgggctcgtgctctattacggcgcgcgcatgccgagcgcgacgagctggtcgatccccgaacggccgcccaacgtcaagattctcgcggcgaatggcgacataatcgccaacaggggcgcgaccggcggcgaggcggtcgctctcgaagacatgtcgccctatatcccgcaggcggtgatcgccatcgaggatcgccgcttctattcgcacttcggagtcgatccgctggggctggcgcgcgccatgctcacgaacgtcatgagcggccgcatggtccagggcggctccacgctcacccagcagcttgccaagaacctgtttctctcgccggagcggacgctggagcgcaaggtgcaggaggtgctgctcgccttttggctggagcagaaatacaccaaggaccagatcctggcgatgtatctcaaccgcgtcttcttcgggtcgaacgcctatggcgtcgaggcggcctcgcggcgctacttcaacaagtcggcgcgcgacgtcaatctcggcgaagcggcgctgctcgcgggccttctgaaggctccttcacggctgtcgccggcccgagaccccgaagcggcggaggagcgcgcacagctcgtgctcggcgcaatgcgcgaggaaggcttcatcagcgattccgagatcaagacggccatgtcgcaggcaccgacacgggcaaagagcttctggtccggcgccgagcactatgtcgccgacatggtgatggaccaggtccccggcatgatcggcgaagtcacgcaagatctcgtcatcgatacgaccatcgaccttacgctcgagaagaaggcggaggaggtgctcgccgagaggctcgagaccgaaggcggcaagctcaacgcctcccaggcggcgctcgtctcgatcgacggcacaggcgccatccgggcgctcgtcggcggcagggactatgccgaaagccagttcgaccgcgcctccaaggcgaagcgccagccgggctcggccttcaagcccttcgtgtatgcggcggcgctcgagatcggccgcacgccgatgtccgtgcgcaacgacgcgccggtccggatcggcaactggacacctgagaactacgatcagaagtaccgcggcgaggtgacgctcgccgatgcgctcgccaattcgctgaacaccatcgccgcccagctcgtgatggaggtcgggccgcagaacgtggtcaagctcgcgcaccggctgggcatagattccgacatgcaggccaatgcatcgatcgcgctcggcacgtcggaagtgacgctggtggagctgacgtcctcctatgcgcccttcatgaatggcggcttcaaggcgacgccgcacgtcatccggcgcatctccaccgccgatggcaccgtgctttacgaaaacacctacgacaacccgccgcgggtgctcgatccggcgatcgtcagcgagatgaaccgtatgatggtgcgcgtgctgacggacggcaccggcaaaaatgcgcgcctgccgggctgggaggcggcagggaagaccggaacgacgcagtccttccgcgacgcgctgttcgtcggctacacctccaacctcgcgaccggcatctggttcggcaacgacgacggaaaatttatgaaaaaggtcaccggcggcggccttcccgccagggcctggcacgatttcatggttgcggcgcatgagggcctttcgccctcgccgctcttcggcacgacgggcgtgcagccggtctttgacgagggcggcatcgctgctgccggcgaaatgccggccgatggcttcgacgcgggtagtcccgatgtcttccccgagcgtccggcaggcatggacggcgtcgaaagcatggacggcatggccgccgtcgatcaggtccggcctgcagaacaggccggagggccaatcccgccggccggcgtcggagagaccaccggtggaacccgccgaacgacgctgttcgacctgctgaccggcggctga

SEQ ID NO: 49953 - protein, 767 aa, Sinorhizobium meliloti 1021
MGTRSGPKGIFPSGMASGKSGQRIEPSFGGNDGDGGDLRVDASDRVAGGGSKPRRAKSPERGAKREKRGRRAGGRGSGRSGSGGGFFGLVRRLAYWCVVLGIWGAIGVGGLVLYYGARMPSATSWSIPERPPNVKILAANGDIIANRGATGGEAVALEDMSPYIPQAVIAIEDRRFYSHFGVDPLGLARAMLTNVMSGRMVQGGSTLTQQLAKNLFLSPERTLERKVQEVLLAFWLEQKYTKDQILAMYLNRVFFGSNAYGVEAASRRYFNKSARDVNLGEAALLAGLLKAPSRLSPARDPEAAEERAQLVLGAMREEGFISDSEIKTAMSQAPTRAKSFWSGAEHYVADMVMDQVPGMIGEVTQDLVIDTTIDLTLEKKAEEVLAERLETEGGKLNASQAALVSIDGTGAIRALVGGRDYAESQFDRASKAKRQPGSAFKPFVYAAALEIGRTPMSVRNDAPVRIGNWTPENYDQKYRGEVTLADALANSLNTIAAQLVMEVGPQNVVKLAHRLGIDSDMQANASIALGTSEVTLVELTSSYAPFMNGGFKATPHVIRRISTADGTVLYENTYDNPPRVLDPAIVSEMNRMMVRVLTDGTGKNARLPGWEAAGKTGTTQSFRDALFVGYTSNLATGIWFGNDDGKFMKKVTGGGLPARAWHDFMVAAHEGLSPSPLFGTTGVQPVFDEGGIAAAGEMPADGFDAGSPDVFPERPAGMDGVESMDGMAAVDQVRPAEQAGGPIPPAGVGETTGGTRRTTLFDLLTGG

SEQ ID NO: 49954 - DNA, 2235 bp, Sinorhizobium meliloti 1021
  CDS (1)..(2235)
atgaggcagaaccttcgggacatgaaagccgtgcaggaaccgaggaaagaggacaaccggccgaaaaggcgacacatctttcttcggatcgattcctggatcgattcgaccgtatggagcgcaggattccggctcggggagtggtgggaggacaccaccatctttttccgccggtttcgcgtgcgcggctggaaaagagcgttcttcgaagtgctcggcgagggaatgacgcttggcgcggcgggctcggtgctgatgttggcgctcgcccttcccgccttcgaggaaaccaagggcaactggcgggcgcaaagcgatttcgcagtcacctttcttgaccgctacggtaacgagatcggccaccggggcatcatccacgaggattccgtcccgatcgacgagctgccggatcacctcataaaagcggtcctcgccacggaagacaggcgcttcttcgaccattggggcatagattttctcgggctcgcacgcgccatgaccgagaacgctcgcgccggcggggtcgttcaaggcggctcgacactcacgcagcagctggccaagaacctgttcctctcgaacgagaggacgatcgagcgcaagatcaaggaagcctttctcgccgtctggctcgaatccaacctgtcgaagaaggaaatcctccgcctctatctcgaccgcgcctatatgggcggcggcaccttcggcgcggcagcggcggcgcaattctatttcggcaaggcgattaccgacgtcaatcttgccgagtcggcgatgctcgccgggctcttcaaggcgccggcgcgctatgccccccatgtgaacctgccggcggcccgtgcccgcgccaacgaggtcctgagcaatctcgtccagggcgggctgatgacggagggacaggtgatcgccgcccgcctcaccccggcctccgtggtcgatcgtgcccaggtcaaggcaccggatttcttcctcgactgggccttcgaagaggtccagcgcattgccgctcccttcgcgcagcattcgctgatcgtgcgcacgacgatcgacatggggctgcagcaagcagccgaggaagcggtcgaatcgggcctcaggcaatatggcgagagctacaaggtcaagcagggcgctctcgtcatggtcgagcatggcggcgcggtacgggcgatggtcggcggccgcgactacggcgaaagccagttcaaccgcgccacgcgcgcgctgcgccagccgggctcgtccttcaaggtctatacctacgccgccgcgatggaaaagggcatgacaccggaaaccgtcgtcgtcgacgcgccgatcacctggcgtggctggtcgccgcagaactacggccgcaaatatgccggccgagtgacggtgatgaacgcgctcgccagatcgataaacactattccggtccgcctcgccaaggacaagctcggtacagaaatcattgccgagaccgccaagagaatgggcatcgagaccccggttcgcaccgacaagaccatgccgctcggcacctccgaagtgaccgtgctcgatcaggcgacggcctacgcggtctttccggcgggcgggttacagtcgcgacgccacggcatcagtcagattctcaactacgacggcgacattctctacgacttcgggcgcgacgcgccgcccccacgcagggtgctgagcgaacaggcagtctcgtcgatgaaccgcatcctgacgcagatcccggtcatcggcacggcgcgacgcgcagccctcgacaacgggatcgtcaccggcggcaagaccggaacgacacaggcctatcgcgacgcatggttcgtcggcttcaccggcgactacaccacggccgtctggttcggcaatgacgactatacctccaccgacgaaatgaccggcggctctctcccggcgatgaccttcaaacgactgatggactatgccgaacaggggatcgagcaccgcgcgattccgggcatcgaaatcgcgcccgccaaaccggcgaaggagcgatccgccgaaactgcgaagccggacgagaacgccctgccgccgctcgtgcggccgcgatcactgtccgcggacgtaacccggctgttgaaaaggatcggcgacacattcgagaaagcgcaaccgctcaaggcgcgcgaaaggcccggcggcaaggtggccgtgctcgagccgacggatcgaggcgtgaacatgcggaccatgccgggcacgacaaacaattga

SEQ ID NO: 49955 - protein, 744 aa, Sinorhizobium meliloti 1021
MRQNLRDMKAVQEPRKEDNRPKRRHIFLRIDSWIDSTVWSAGFRLGEWWEDTTIFFRRFRVRGWKRAFFEVLGEGMTLGAAGSVLMLALALPAFEETKGNWRAQSDFAVTFLDRYGNEIGHRGIIHEDSVPIDELPDHLIKAVLATEDRRFFDHWGIDFLGLARAMTENARAGGVVQGGSTLTQQLAKNLFLSNERTIERKIKEAFLAVWLESNLSKKEILRLYLDRAYMGGGTFGAAAAAQFYFGKAITDVNLAESAMLAGLFKAPARYAPHVNLPAARARANEVLSNLVQGGLMTEGQVIAARLTPASVVDRAQVKAPDFFLDWAFEEVQRIAAPFAQHSLIVRTTIDMGLQQAAEEAVESGLRQYGESYKVKQGALVMVEHGGAVRAMVGGRDYGESQFNRATRALRQPGSSFKVYTYAAAMEKGMTPETVVVDAPITWRGWSPQNYGRKYAGRVTVMNALARSINTIPVRLAKDKLGTEIIAETAKRMGIETPVRTDKTMPLGTSEVTVLDQATAYAVFPAGGLQSRRHGISQILNYDGDILYDFGRDAPPPRRVLSEQAVSSMNRILTQIPVIGTARRAALDNGIVTGGKTGTTQAYRDAWFVGFTGDYTTAVWFGNDDYTSTDEMTGGSLPAMTFKRLMDYAEQGIEHRAIPGIEIAPAKPAKERSAETAKPDENALPPLVRPRSLSADVTRLLKRIGDTFEKAQPLKARERPGGKVAVLEPTDRGVNMRTMPGTTNN

SEQ ID NO: 49956 - DNA, 1944 bp, Bacillus subtilis subsp. subtilis str. 168
  CDS (1)..(1944)
gtggatgcaatgacaaataaacggctgagactgacgctgaaaaccgttcgcgcctttatctttttaggggcttttgcggccttggcggcagctgctgtgtttatgactgtcattttgatagccaaataccagggcgctccctcggtgcaagtgccgcaatccacgattttgtacgcgagtgacggctcaaagctcggggaaacgaactacggcgaaaagcgctattgggtccccttaaaggacatgaatccgacgatcgtaaaagcgacagtggcgattgaagaccagaatttctacgatcatcacggctttgattataaacgcatggccggcgcggcgcttgctgacctgaaagcatttgccaaggttcagggtgcaagcaccatcacccagcaatatgcgagaaacttataccttgaacacgacaaaacgtggaaacggaaatggaatgaggcgttctacacgatccgtctggaacaaaactattctaaggacgagatattagaaggctatttaaatacgatttactacggccacggcgcctacggcattgaagcagcttcccgcctgtatttcggcaagcatgccaaaaacctgacggatgcggaggcggcgcttttggcaggaatcccgaaaggcccttccggctattcaccgtatgtcaatgagacgaaggccaaggaacgccagaaaacgattgtgcggatgatggaaaagcagcagatgatcagccaaaagaaagcggatgaattgatcaaggaacctctttcctatcagcctttgaataaacaagtttccaagagaaaggctccttatttctacgacaatgcgatgagagagctggaaaaaaagctcggcatgacacgggagcaaattgaaacgagcgggttaaacgtctatacaacggtagataaacggatgcagcgcatcgccgaggagaccattaccgaaacggttaacgcgggctctgacattcaagtcgggttttcagccattgatccccgcaccggaaacgttctcgcccttgtcggcggcagggattatcaaaaaagcccgtttgaccggacgacacaggcgaagcgccagcctgcttcgacgatcaagccgttgctgtactataaagcgattcagagcggatttacgccagtcactttgatgaaaagcgaagaaaccgagtttcaaattgatgcaaagggagaaacctattctccaagcaactataacggatactatgccaacaagccgattacgcttctgcaggcgctggcgctttccgacaatatttacgctgtgaaaacgcatctttttctcggcacgaacaaacttgtaaagacggcaaaggaattcggcattaccgcccatcttcaagcactgccgtccctggcactcggcaccgaacccgtacgtccgattgagatggtcaacgcctatgccatgctcgcaaatggcggaaagaaaatcgaaccgacttttatttcaagagtaacggacgcagccggccacgtgctgtacgaaaacccgaatcagcataaacaggtgcttgatgaaaaagccgcttttgtcacagcgagtatgatgacaggcatgtttgatatcgatttaaatggatatacgtcggttacggggcgaacgatagccaaccgcctgacaagaacgtatgccggaaaatcaggaaccaccagcgcagacagctggatgatcggcttcaatccgaagctggccgccggtgtttggaccggctatgacaaaaacagcaccatcgactcggtcgaagaaaaaagctatgctaaaaccatttgggcggacttcatggaggacgcgctcaaaggcgaaccggaaaccgcgttcaagccgccaaaaggcgtaaccggtgtgtacattgatccggaaacaggctactcatcaggtccggctgcgccgctaagcattacacatattttgtga

SEQ ID NO: 49957 - protein, 647 aa, Bacillus subtilis subsp. subtilis str. 168
MDAMTNKRLRLTLKTVRAFIFLGAFAALAAAAVFMTVILIAKYQGAPSVQVPQSTILYASDGSKLGETNYGEKRYWVPLKDMNPTIVKATVAIEDQNFYDHHGFDYKRMAGAALADLKAFAKVQGASTITQQYARNLYLEHDKTWKRKWNEAFYTIRLEQNYSKDEILEGYLNTIYYGHGAYGIEAASRLYFGKHAKNLTDAEAALLAGIPKGPSGYSPYVNETKAKERQKTIVRMMEKQQMISQKKADELIKEPLSYQPLNKQVSKRKAPYFYDNAMRELEKKLGMTREQIETSGLNVYTTVDKRMQRIAEETITETVNAGSDIQVGFSAIDPRTGNVLALVGGRDYQKSPFDRTTQAKRQPASTIKPLLYYKAIQSGFTPVTLMKSEETEFQIDAKGETYSPSNYNGYYANKPITLLQALALSDNIYAVKTHLFLGTNKLVKTAKEFGITAHLQALPSLALGTEPVRPIEMVNAYAMLANGGKKIEPTFISRVTDAAGHVLYENPNQHKQVLDEKAAFVTASMMTGMFDIDLNGYTSVTGRTIANRLTRTYAGKSGTTSADSWMIGFNPKLAAGVWTGYDKNSTIDSVEEKSYAKTIWADFMEDALKGEPETAFKPPKGVTGVYIDPETGYSSGPAAPLSITHIL

SEQ ID NO: 49958 - DNA, 1962 bp, Caulobacter crescentus CB15
  CDS (1)..(1962)
atggcgaacggacccttcggcggaaatccgccggcgaagccgcagcgcacgccgctccaggccctgatctactggggttcggtcgttggcgtctggggcctgatcttcgtcgtcgccttcttcgccgtgttcgccagcgacctgcccgacacgtccaagctctatgacgtcaagcgtcagccctcgatcaactatctggaccgctccggcgccctgctggccgtgcgcggcagccaatatgcgccgccggtcgatctggacgccctcccgaaatatgtcccggcggcgttcatcgccatcgaagaccgccagttctatcaccacttcggcttcaacccctggggcatcatccgctcggcggcctggaacctgactcatgatggcccccagcgcggcggctcgaccatcacccagcagttggcccgtaacctgttcctgagcccggcccagaactatcgccgcaaggcccaggagctgatcctggccatctggctggaactgaagttctccaagaagcagatcctggctctctatatgaaccgggtctatttcggcgccggcgcctacggcatcgaggccgcctcgcagcgctacttcaacaagcccgccaaccagctgaccatcggcgaagccgccctgttggccggcatgatgaaggggccggcccgctattcgcccgtatcggccaaggaacgcgccgcccgccgcgccaccatcgttctggacgagatggtgcgcatcaaggcgatcaccgccgaggaacgcgacgaggccttccgcacccccgttcaggtgtcggccaccctggccaatcagcgcgcccagtatttcaccgactatatcgacgcccaggtccgctcgctggtcggcgagccgactgaggacctcgtggtcgaaaccacgatggacctgccgatccaggtcgccgccgaacgcgccgtgaagctgggcgtcgagggccatatcaagcagggggtccagcaggccgctctggtcgcgatcgacggcgagggccgcatccgcgcctatgtcggcggcgccgactacaacgacagccagttcgaccgcgccaccaccgcccgtcgtcaggccggatcggccttcaagccgttcgtctttctgacggccatggaagccggtcgcacgcccaatgtgatggtcgtcgacgaacccgtgaagatcggcaactgggagccgaagaactacaccaacaagtacctgggccccatcaccctgcagacggccctggcgcagtcgatcaacaccgtcgccgcacgcctcgccaatgaggtcggcaccagcaacgtcgccgccaccgcgcggcgcctggggatcaccagcaagatccagctggacccgtcgatggccctgggcgccgtcgaagtctcgccgatggagatggcccaggcctacgcccccttcgccaacggcggtttcctggccaagggctacggtatcgaacgcatccgcaccgccagcggcaaggtcctgtatgaccacagcgtcgacaagcaggcccgcgccgccgtgatcggctcgcccagcctgcagtacatgaaccagatgatgcgcgaggtcgtcgccaccggaacgggcacgcgcgcccgtgtcgccagctacgacatcgccggcaagaccggcacgaccagtgactacaaggacgcctggttcgtcggctacactggcggcttcgtcacggcggtctggacgggcaaggacgacgccacaccgatgaagcgcgtcaccggcggcggcgcaccggccgaggtctggcgtgtcttcatggcggcggcgctgccgcggctgaaggcgacccccatccccgggggctttattgaaccgccccccgtagcgccgatcgatcccatcggtgacttggtggacgcgccgccggcgccggagggccccgcagccgaggcgcccgccggcgagcctccgcccgcggaccagttgccgtactag

SEQ ID NO: 49959 - protein, 653 aa, Caulobacter crescentus CB15
MANGPFGGNPPAKPQRTPLQALIYWGSVVGVWGLIFVVAFFAVFASDLPDTSKLYDVKRQPSINYLDRSGALLAVRGSQYAPPVDLDALPKYVPAAFIAIEDRQFYHHFGFNPWGIIRSAAWNLTHDGPQRGGSTITQQLARNLFLSPAQNYRRKAQELILAIWLELKFSKKQILALYMNRVYFGAGAYGIEAASQRYFNKPANQLTIGEAALLAGMMKGPARYSPVSAKERAARRATIVLDEMVRIKAITAEERDEAFRTPVQVSATLANQRAQYFTDYIDAQVRSLVGEPTEDLVVETTMDLPIQVAAERAVKLGVEGHIKQGVQQAALVAIDGEGRIRAYVGGADYNDSQFDRATTARRQAGSAFKPFVFLTAMEAGRTPNVMVVDEPVKIGNWEPKNYTNKYLGPITLQTALAQSINTVAARLANEVGTSNVAATARRLGITSKIQLDPSMALGAVEVSPMEMAQAYAPFANGGFLAKGYGIERIRTASGKVLYDHSVDKQARAAVIGSPSLQYMNQMMREVVATGTGTRARVASYDIAGKTGTTSDYKDAWFVGYTGGFVTAVWTGKDDATPMKRVTGGGAPAEVWRVFMAAALPRLKATPIPGGFIEPPPVAPIDPIGDLVDAPPAPEGPAAEAPAGEPPPADQLPY

SEQ ID NO: 49960 - DNA, 2385 bp, Caulobacter crescentus CB15
  CDS (1)..(2385)
atgtctgatcctaccgaccctgcagacgacgttcccgccgcgccggcgccgaagcctcggcggccgcgaaagccgcgcgcccagacggtgatgaccgaggccgccggcctggatccggctgcgcccgaagacgccgcgcagaagccgcgccgtccgcgcaagtcgcgccgcgcccagcccgaagccgtggccgcccccgaggcgcagactcccacgacctccacggccgccactgacgacgccgacgcggatctgttcgagcccctgccctcgcccgagccggacgccgagccggtctcggtcgaggcagaccccgccgaaacgctcgaagccgacgccgcggcggaccttgagtccccgaccgaacccgaagtcgagcccgcgcaagacatcccgcccgaggcccctgcagagcctccgaccacggccgaggctgaggacgccccggaagccaaggccgagacgtctgtcccgacgctggacgagccggagaaagtcgccgccaagccgccgatctggaagcgtccggcctggctgatcggcgcgggcgcggcggtgctgctggtgatcgttctgatcgcctcgctgttctggtcgctgccgctgagccgcgcgctggagccgctggacaactcggcgatcgtgctggtggccgaggacggctcgcccatcgcccgccggggctcctacaaggaagcgccgatcgatgtggccaagctgccgccttacgtgccgggcgccttcatcgccatcgaggatcgtcggttctacagccacatgggtgtcgacccgaaggccatcgcccgcgctgtcggccgtaacgcccaggccggcggcgtctccgaaggcggctcgaccatcacccagcaactggccaagaacgccttcctgtccagcgaccgcaacctgcgccgcaaggcgcaggaggcgctgatcgccgtctatctggaagcgcggctctccaaggatgagatcctgtcgcgctacctgtcgtcggtctatttcggcgacggcgcctttggcctgcgcgccgcagcccgccactatttcggcaagccgcccgagcagctgtcgatcggcgaggcggcgatgctggccggtctggtcaaggcgccctcgcgcctggccccgaccaacaacatcgaaggcgcgcgcgagcgcatgcgcgtggtgctgggcgccatggtcgagaccaagaccatcacccaggcggaggccgacgcggtcggcgagatcttgcccgtcgaggccgaggaaaagctgccgaccggctcctacttcgccgactgggccctgccccaggctcgcgccctgatcggagcccgctacggcgagaccatcgtcaagacgacgctggatcccgagctgcaggaaaaggccgagcgcatcctcaacgactatatcgagcgcgacggccaggtgctgaacgtcacccagggcgccctggtcgccatgcgcagagatggccgagtcgtcgccatggtcggcggtcgcgactacaagcagagccagttcaaccgcgcggacgccgagcgtcagccgggctcggcgttcaagctgttcgtctatctggccgccctgcgcgaaggcatgacggtcaccaccccgatcctcgacacccccgtccaggtcagcggctatatgcccaagaaccacgagggcaagtaccacgcccgcgaggtgccgctgatcaccgccttcgccggttcgtccaatgtggcggcggtgcgcctggcgcatgatctgggtcccgccaaggtgatcaaggtcgcacgagacctgggcgtcaccgaggagatcccgtccgacctgaccatggcgctgggcacaggtccgatgagcctgacccgcctgaccgccgcctatgcctcggtggcggccggcgagtatccgatcgttcctcatggggtgaccgagttcaaaaagcccaagaccaaggcctatgaccccaaggtgctggccaacatgcgcgacctgctgcggtcggcgacccatcgcggcacaggcgtggaagccgccatccccggcgccttcggcaagaccggcaccacccaggactatcacgacgccatcttcgtcggttacgtcgaggacctggtcgtcggcgtctggctgggcaatgacgacaacagctcaatgaacggcgtggtcggcggcggcgagcccgccaggatctggaaggcgttcatgctttcggcgctgggccgcgatgtcgcccccgtcgtcgaggaggacccgctggaggacctgggcctgccgctggagggcgagcttgggccggacggcttgccgctggcgccgttcacctcgcctaccgacgaacccgccccgccggccaatagcggcgttccgctggcccccccgccgccggagccgcgcccctga

SEQ ID NO: 49961 - protein, 794 aa, Caulobacter crescentus CB15
MSDPTDPADDVPAAPAPKPRRPRKPRAQTVMTEAAGLDPAAPEDAAQKPRRPRKSRRAQPEAVAAPEAQTPTTSTAATDDADADLFEPLPSPEPDAEPVSVEADPAETLEADAAADLESPTEPEVEPAQDIPPEAPAEPPTTAEAEDAPEAKAETSVPTLDEPEKVAAKPPIWKRPAWLIGAGAAVLLVIVLIASLFWSLPLSRALEPLDNSAIVLVAEDGSPIARRGSYKEAPIDVAKLPPYVPGAFIAIEDRRFYSHMGVDPKAIARAVGRNAQAGGVSEGGSTITQQLAKNAFLSSDRNLRRKAQEALIAVYLEARLSKDEILSRYLSSVYFGDGAFGLRAAARHYFGKPPEQLSIGEAAMLAGLVKAPSRLAPTNNIEGARERMRVVLGAMVETKTITQAEADAVGEILPVEAEEKLPTGSYFADWALPQARALIGARYGETIVKTTLDPELQEKAERILNDYIERDGQVLNVTQGALVAMRRDGRVVAMVGGRDYKQSQFNRADAERQPGSAFKLFVYLAALREGMTVTTPILDTPVQVSGYMPKNHEGKYHAREVPLITAFAGSSNVAAVRLAHDLGPAKVIKVARDLGVTEEIPSDLTMALGTGPMSLTRLTAAYASVAAGEYPIVPHGVTEFKKPKTKAYDPKVLANMRDLLRSATHRGTGVEAAIPGAFGKTGTTQDYHDAIFVGYVEDLVVGVWLGNDDNSSMNGVVGGGEPARIWKAFMLSALGRDVAPVVEEDPLEDLGLPLEGELGPDGLPLAPFTSPTDEPAPPANSGVPLAPPPPEPRP

SEQ ID NO: 49962 - DNA, 2202 bp, Caulobacter crescentus CB15
  CDS (1)..(2202)
gtgaacgactggacgctgccgccctacaagttcgacgacgggaagagtcccggagagccgccgaagcccggtccggcctcggcgagcgatggcgtctcgcaagatccctgggcgccgcaggggcctgatccgttccgcctgtctagcgacgccgcgacacctccgccgccgcctgagcccccgccggaggagcccttccgcgccgacctcaagcacgctgcggccaagaagaaggcccgcaagtggggctgggtgtggggcactctgctggtcggctttcttcttgccgtcctgagcgtcgccggcggcggcgcctatgtctggttcaagtacctgaaggacacccccgccctgccctcacgcgaggcgctgtttgcggtgaaccgggcgccgggcattcgcttcgaggaccgcaacgggcaggtgatcgccacccggggtccgcgctatggccagcgcatcaccctgggcacggtgcccaactatgtgcccatggcgttcctggcggccgaggaccggcgcttctaccagcacggcgccatcgacgtgcaaggcatcgcccgggcggcctggatcaactggcgcgcgggcaagacccgccaaggcgcctcgaccctgacccaacaactggcaaagggcctgttcctgacccccgatcgcgtggtgaagcgtaagctgcaggagatgctgctggcctacaagctggagcagattctcaccaaggacgagatcctcgagctctatctgaaccgtatctatttcggcgcgggcacctatgggatcgacggcgcgtcccagacctatttcggcaagcccgccagccagctcaccctgtcggaagccgccctgctggccagcctgcccaaggcgccgtcgcgcctggccctgacccgcgacatggagcgggccctggcccgctctcgcctgatcctggccaatatgcgcaaggaaggctggatcacgcccgagcaggaaagccgcgcgctcgacgacacgccgcgcctgtcgccgatggcgctgcaggacgagggcgactacggctgggtgctcgactacgccaccgccgaggcggtgaagatcgccggtcagaacgcgccggacctcgtggtgcgcctgacgatcgaccccttgctccagagcgagggcgccgaggttgtccgccagaccatggccaccgagaccacccgctcaggcgccagccaggcggccctgttgtcgctgtcggccgatggggccatccgcgccatggtcggcgggaccgactattcggaaagcccgttcaaccgcgctgtccaggccaagcgccagccgggctcgaccttcaagccctttgtctacgccgccgccgtcgagaagggcgtcctgccgaccgacatgcgggtcgacgagcccgtcaagttcgggacgtgggagccagagaactacagcggcggctatcgcggcccgatgaccgtcgaagacgcgctggtcacctcgatcaacacggtcgccgtcaagctgggccaggaagtcggcggtccggcgatcggcgacctcgtccgccgcttcggcatcaccagcctgccgccctcgcccgacctgtcggtggccctgggctcatatgaggtgaacctcttgcagatcacctcgggcttccaggtgttccagcaaggcgggctccggatcgagccctatgtgatcgagtcgatcaccacccagggcgggcaacagatcttccagcaccagccgccgcagggcgagcgtcgcgtctacgacgtcgcgcacgccagcatgatggtgaagatgatgaagaaggtggtcacccaaggcaccgcccagcgcgccgccttcggtcgcccggtcgccggcaagaccggcaccagccagaactggcgcgacgcctggttcgtgggctttacccccgactatgtgaccggcgtctgggtcggcaacgacgacgaaaagccgatgaacaaggtggtcggcggcgacattcccgccagcatctggcggcgcttcatgatgaccgcgcatcagaccctggcggtgcgcgacttcgagtggctgctgcccgaccccgcgccgcagagcgagcctgatccgcgcaacggcttctacgagacgctatcggccgagttctcgcgcgcagcctcggaactggagacaactacgcctgttgcgcccgcgccggggcagccgcccccggacaacctgccctactag

SEQ ID NO: 49963 - protein, 733 aa, Caulobacter crescentus CB15
MNDWTLPPYKFDDGKSPGEPPKPGPASASDGVSQDPWAPQGPDPFRLSSDAATPPPPPEPPPEEPFRADLKHAAAKKKARKWGWVWGTLLVGFLLAVLSVAGGGAYVWFKYLKDTPALPSREALFAVNRAPGIRFEDRNGQVIATRGPRYGQRITLGTVPNYVPMAFLAAEDRRFYQHGAIDVQGIARAAWINWRAGKTRQGASTLTQQLAKGLFLTPDRVVKRKLQEMLLAYKLEQILTKDEILELYLNRIYFGAGTYGIDGASQTYFGKPASQLTLSEAALLASLPKAPSRLALTRDMERALARSRLILANMRKEGWITPEQESRALDDTPRLSPMALQDEGDYGWVLDYATAEAVKIAGQNAPDLVVRLTIDPLLQSEGAEVVRQTMATETTRSGASQAALLSLSADGAIRAMVGGTDYSESPFNRAVQAKRQPGSTFKPFVYAAAVEKGVLPTDMRVDEPVKFGTWEPENYSGGYRGPMTVEDALVTSINTVAVKLGQEVGGPAIGDLVRRFGITSLPPSPDLSVALGSYEVNLLQITSGFQVFQQGGLRIEPYVIESITTQGGQQIFQHQPPQGERRVYDVAHASMMVKMMKKVVTQGTAQRAAFGRPVAGKTGTSQNWRDAWFVGFTPDYVTGVWVGNDDEKPMNKVVGGDIPASIWRRFMMTAHQTLAVRDFEWLLPDPAPQSEPDPRNGFYETLSAEFSRAASELETTTPVAPAPGQPPPDNLPY

SEQ ID NO: 49964 - DNA, 2187 bp, Sinorhizobium meliloti 1021
  CDS (1)..(2187)
atgaagctcatcggttatatcttcggcatcacctcggctgcattggtgggtatcttcggcatcggtgccgtttatctgtgggaagtcgcgaacgacctgccggatcaccgcaagcttgcagaatgggagccggcgctcatgacgcggttttacgcgtatgacggaacgcccattgccgaatacgccagggaaaggcgtctgtatctgcccatagccgccatccccgagcgcgtgaaggcagcctttctctcggcggaagacaagagcttctactcccattccggaattgatgtcctgagtgtcgtcaaggctgcctggtccaatgccgtgaacctgagttccggccaacggttgatcggcgcctcgacaatcacgcaacaacttgccaagaactttctgctttcttcggatcgcacccttcgacgaaagatcaaggaggcggtgctttccatccgcatcgagcgctcgctcagcaaagacagaatcctcgagctctatctgaacgacatctacctggggctcggggcctacggcatcgccgccggtgcgctgacctatttcgaaaagtccgtcagcgagctgaccgttgccgaggcagcgtatctcgctgccctgccgaagggacccaacaactacaacccgcaccggcatcccgaacgcgcggtcagccggcgcaactgggtgattggccagatgcaacgcaacggcttcgttagcgccgcgcaggcaagcaacatgatggcgagacctctcggggttaagcctcaggccaaaaaccccgtcatggcagaggcaaactatttcgttgaggaagtgcgccgggaagtcgcggggcaatatggcgaggcggctctctacgatggcgggctttccgtgcgcacgacgcttgacccgacccttcaggcggctgcgctgatggcgctgcgcgccggcctcgtcgactacgaccaagcgcggggttttcgggggccggtcgcgcatatcgacatttccggagactgggcgacggcgttggctaagcacgagacattcacggatatgaaggaatggcagctcgccgtggtgctctcctgttccgatgcaggtgtgggcatcggactgcgccgtgcaaagcttggtcccgagcactcgccgaccagccctgaaacgggccttatcggcagaaataccatgcgttgggcattgaagcttgctgccggaggcaagattaggcaggtcgactccatcgacaaggtcctctcgccaggggacgtcatttatgtcgagaaggtgggaaacggttatctcctgcgccaaataccggaagtacagggcgcgatcgtgtcgatggacccgaatacagggcgcgtgctggcgagcgttggcggtttttcctttgcacagtcacgcttcaaccgtgcgacgcaggcatctcgtcagcccggctcagccttcaagccgttcgtttacgcggccgcattggataccggctacaccccggcgacgctggtcatggacgcacccttttcgatgccggacggggcgggccgtctgtggaaaccgaagaactacgatggaaaattcggcggtccttccactctgcgcacagggcttgagatgagccgcaacctgatgacggtgcgcctcgcccgacatcttggcatggacctcgttgccgaatacggccgcgccttcggcctctacgataagctcgctccctatctgccgatgtcgctcggagccggcgaaacgacgctgacgcggctcgtttcggcctatgcggtcctcgccaatggcggacacgccgtgcagccctcgatgatcgaccgcatccaggatcgtcacggtcgtacgatcttccgtcacgacgatcgcgcctgcgatcgatgcaacgccacaaggtggctgcatcaggaagagccggtgcttcgcgacacccgcaagcaggtgctcgacccaatgacggcctatcaggtgacatcgatgctgcgcggcgtggtcgagcgtggaacggcgcaccgagtgtcgcagctcggcgcccccgtcgccggcaagaccgggaccaccaacgacgagaaggatgtctggttcgtcggctacaccccgacgctcgtgaccggcatcttcatgggctacgacgcaccgaagccgatgggctatgcgaaacgggcggcggacttgcggccccgatcttcattgagttcatga

SEQ ID NO: 49965 - protein, 728 aa, Sinorhizobium meliloti 1021
MKLIGYIFGITSAALVGIFGIGAVYLWEVANDLPDHRKLAEWEPALMTRFYAYDGTPIAEYARERRLYLPIAAIPERVKAAFLSAEDKSFYSHSGIDVLSVVKAAWSNAVNLSSGQRLIGASTITQQLAKNFLLSSDRTLRRKIKEAVLSIRIERSLSKDRILELYLNDIYLGLGAYGIAAGALTYFEKSVSELTVAEAAYLAALPKGPNNYNPHRHPERAVSRRNWVIGQMQRNGFVSAAQASNMMARPLGVKPQAKNPVMAEANYFVEEVRREVAGQYGEAALYDGGLSVRTTLDPTLQAAALMALRAGLVDYDQARGFRGPVAHIDISGDWATALAKHETFTDMKEWQLAVVLSCSDAGVGIGLRRAKLGPEHSPTSPETGLIGRNTMRWALKLAAGGKIRQVDSIDKVLSPGDVIYVEKVGNGYLLRQIPEVQGAIVSMDPNTGRVLASVGGFSFAQSRFNRATQASRQPGSAFKPFVYAAALDTGYTPATLVMDAPFSMPDGAGRLWKPKNYDGKFGGPSTLRTGLEMSRNLMTVRLARHLGMDLVAEYGRAFGLYDKLAPYLPMSLGAGETTLTRLVSAYAVLANGGHAVQPSMIDRIQDRHGRTIFRHDDRACDRCNATRWLHQEEPVLRDTRKQVLDPMTAYQVTSMLRGVVERGTAHRVSQLGAPVAGKTGTTNDEKDVWFVGYTPTLVTGIFMGYDAPKPMGYAKRAADLRPRSSLSS

SEQ ID NO: 49966 - DNA, 2595 bp, Haemophilus influenzae Rd KW20
  CDS (1)..(2595)
atgcggatcgcaaaattaatattaaacaccctattaactttatgtattttaggtttagtagcaggcggaatgttgtatttccacttaaaatctgaattgccctcagtagaaacattaaaaaccgttgaattacagcaaccaatgcagatttatacggctgacggtaaattaattggcgaagtgggtgagcaacgccgtattccagtgaaattagccgatgtgccacaacgcttaattgacgcatttttagcgacggaagacagtcgtttttacgatcatcacggattagaccctatcggcattgcccgtgcattgtttgtcgcagtgagtaatggcggtgcatcacaaggcgcaagtacgattactcaacaattagcgcgtaactttttcttaacctcagaaaaaaccattattcgtaaagctcgtgaagccgtgcttgcggtagaaatcgaaaatactctcaacaaacaagaaatattagagctttatttaaacaaaatctttttaggctatcgttcttatggtgttgcagcggcagcacaaacctatttcggtaaatcattgaatgaattgaccttatcggaaatggcgattattgctggtttacctaaagcaccttcaacaatgaacccgctttattctttaaaacgttcagaagaacgccgcaatgtggtgctaagccgtatgttagatgaaaaatacatcagcaaagaagaatatgatgctgcattgaaagagccgattgtggcgagctatcacggcgcaaaatttgaatttcgagccgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattacgatatgcgtcacggttatcgcggtggcgcgccattatggcaaaaaaatgaagccgcttgggacaatgatcgcattgtcggttttctacgcaaactacctgattcagagccatttattcctgcggcagtgattggaattgtaaaaggcggtgctgatatattgctcgcttctggggaaaaaatgaccttatcaaccaatgcaatgcgttggacaggcagaagcaatcctgtgaaagtcggcgagcaaatttggattcatcagcgtgctaatggggaatggcaattaggacaaattcccgcagcaaattcagcattagtttctcttaattcagataatggtgcgattgaagcagtggtcggtggctttagctatgaacaaagtaaattcaatcgagccacacagtctttagttcaagtgggttcttctatcaaaccatttatttacgcggcagcattagaaaaaggcttaacactttcaagcgtattacaagacagcccgatttctattcaaaaaccgggacaaaaaatgtggcaaccgaaaaactcgcctgatcgttatgatggcccgatgcgtttacgcgtaggattaggtcaatccaaaaatataattgctattcgtgctatccaaacggcaggtattgatttcacagcagaatttttacaacgttttggttttaaacgtgatcaatattttgccagtgaagccttagcacttggcgcagcctctttcacaccattagaaatggcgcgagcttatgcggtgtttgataatggtggcttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagaatgccttaaaaccaacagatgacagcaccaatggcgaagaattagatcaacaacctgaaactgtgcctgaactgccagaattacaatcaaatatgaccgcacttaaagaagatgcgattgatttaatggctgctgcaaaaaatgcttcgtcgaaaatagaatatgcgccacgtgtcattagtggcgaacttgcttttctcattcgtagtgccttaaatacggcaatttatggcgaacaaggtttagactggaaaggcaccagctggcgtattgcacaaagcattaaacgtagcgatataggcggtaaaacaggtactaccaacagttcaaaagtggcttggtatgcgggatttggtgcaaacttagtaaccacaacttatgtcgggtttgatgataacaaacgagtacttgggcgtggagaagcaggagcaaaaacagcaatgcctgcttggatcacttatatgaaaacggctttgagtgataagccagaacgtaaattgtcgctaccgccaaaaattgtggaaaaaaacattgatactttgacaggtttgctttctccaaacggtgggcgcaaagaatattttattgcgggaacagaaccgacacgtacctatctttcggaaatgcaagagcgtggttattatgttcctactgagttacagcaacgcttaaataatgaaggcaatacgccagcgacgcaaccacaagaactcttctaa

SEQ ID NO: 49967 - protein, 864 aa, Haemophilus influenzae Rd KW20
MRIAKLILNTLLTLCILGLVAGGMLYFHLKSELPSVETLKTVELQQPMQIYTADGKLIGEVGEQRRIPVKLADVPQRLIDAFLATEDSRFYDHHGLDPIGIARALFVAVSNGGASQGASTITQQLARNFFLTSEKTIIRKAREAVLAVEIENTLNKQEILELYLNKIFLGYRSYGVAAAAQTYFGKSLNELTLSEMAIIAGLPKAPSTMNPLYSLKRSEERRNVVLSRMLDEKYISKEEYDAALKEPIVASYHGAKFEFRADYVTEMVRQEMVRRFGEENAYTSGYKVFTTVLSKDQAEAQKAVRNNLIDYDMRHGYRGGAPLWQKNEAAWDNDRIVGFLRKLPDSEPFIPAAVIGIVKGGADILLASGEKMTLSTNAMRWTGRSNPVKVGEQIWIHQRANGEWQLGQIPAANSALVSLNSDNGAIEAVVGGFSYEQSKFNRATQSLVQVGSSIKPFIYAAALEKGLTLSSVLQDSPISIQKPGQKMWQPKNSPDRYDGPMRLRVGLGQSKNIIAIRAIQTAGIDFTAEFLQRFGFKRDQYFASEALALGAASFTPLEMARAYAVFDNGGFLIEPYIIEKIQDNTGKDLFIANPKIACIECNDIPVIYGETKDKINGFANIPLGENALKPTDDSTNGEELDQQPETVPELPELQSNMTALKEDAIDLMAAAKNASSKIEYAPRVISGELAFLIRSALNTAIYGEQGLDWKGTSWRIAQSIKRSDIGGKTGTTNSSKVAWYAGFGANLVTTTYVGFDDNKRVLGRGEAGAKTAMPAWITYMKTALSDKPERKLSLPPKIVEKNIDTLTGLLSPNGGRKEYFIAGTEPTRTYLSEMQERGYYVPTELQQRLNNEGNTPATQPQELF

SEQ ID NO: 49968 - DNA, 2250 bp, Synechocystis sp. PCC 6803
  CDS (1)..(2250)
atggctacccgttcccgcaaagccccttctgcccctaaaaaaagtcaaactaacctttcccagggtggcaacagccaaaaggtagccctcaaaaaaggctccagggtggccaaaattcgtctgcaggaatcgggcaaaaattcccaatcccggcgggtatttcccctccttggcgatcgttattttctcggccgcagttccagttgtgatattcaactgcaaaatcccctcgtgagtcagacccattgttccctgcggcgggaccctgaccatcctaaccagttttttattcgagatgaaggctctagcaacggcatttatctgcaacgtcgccgcctaaaaagctatcgtctgcagcatggtgatgaaattaccctggggccaccggaattggtggatgtgcccaaacttgtttatttcaacccgccgccattgtggttaaagggaatgcgcacttttttttccactggtattctgttttttctcatcatcaccggggcgatcgcctggcaatggagcaaaattcccgttaaacccatgcccagtggcgtgacggggccagttaaggtttatgccggggacggggtgacggaaatcaatccggttaagcaagaaattcaccgggaatttgataatttaagtgatttttcgccctatttaccccaagcggtcattgcttcggaagatactcgcttttactggcattttggcgttgatccctacggtttgggccgagcgatttacattaacctccaggacagggatgtgaaacagggagccagcacccttactcaacagttggcccgcagtttgttcagtgaagtagggcgggaaaatacggcggggcgtaaaattcgggaaatgtttgtcgccctcaagttggaagcggtgtatagcaaagacgacattttaaaagcctatttgaatcgagtttacctaggggctggtaattacggctttgaagatgcggcccagttttatttcgacaaatctgcccaggatttggatgtgggggaagcggccaccctagtggcaatgttgccagctcccaatctttacaaccccgtgcaggattatcaaacctccgtacaattgcggaatcgggttattgagcgcatggccatgttgggcatgattgacgaacaggaagccaaccgggctaggcgatcgcgcattcaggtcagtcccaaggctacccaaaccctttcccaacggcaggctccctacttttacggttacatttttggcgaattaaaccatttactaggcgaagatgtggccaaagaaggcaattttgtcgtggaaactagccttaacttaaaaatgcaggccctagcggaaaaaagcttacaaaaattcctcaccacggagggaaaaaagtatgcggtttcccagggggcagtggttaccctggacagtcgtaccggggcagttttggccatggtggggggcaaaagttaccgggaaagtcaatttaatcgggcgagccaagcccaacggcaaccaggctcaacgttcaagctttttgcctacacagcggcgatcgccaagggagtgagcactaatcaggcttttgagtgtggccctttcacctggcagggtcaaaactacaagccctgtgaacggagcggggcagccccggccattacctttgcggaaggttttgcccaatcggaaaatgtggtggccctacgggtggcccaaacggtgggcttagacgaaattattgccctggctaaggattttggcgttaactcttccctggtgaaagaaccaggtttggtgctggggcagagtgaagctagggtgctggagatgaccggagcctacggggcgatcgccaatggaggtgtttggaaccggccccacggcattgttaacatccgggatgggggggattgtcccgatccagagcaactaaaaagctgtcgggaagtttatcaggtcagccaggatggccggggacaaaaacaggtggtttctccggcgatcgccgccaccatgacccaacttttacaagccgctgtgaccaatggcacaggcaaagctgcggacattggctacggaaccgcgggcaaaaccggcaccacggataaagcagtggatttatggtttattggctttctgccccaaaaaaatctggtcaccggcatttggttaggcaatgacgacagtagtcccacccaaggcagtagtggtctggccgctaccctttggggtcaatatatgcgacaaattgcttccttgtag

SEQ ID NO: 49969 - protein, 749 aa, Synechocystis sp. PCC 6803
MATRSRKAPSAPKKSQTNLSQGGNSQKVALKKGSRVAKIRLQESGKNSQSRRVFPLLGDRYFLGRSSSCDIQLQNPLVSQTHCSLRRDPDHPNQFFIRDEGSSNGIYLQRRRLKSYRLQHGDEITLGPPELVDVPKLVYFNPPPLWLKGMRTFFSTGILFFLIITGAIAWQWSKIPVKPMPSGVTGPVKVYAGDGVTEINPVKQEIHREFDNLSDFSPYLPQAVIASEDTRFYWHFGVDPYGLGRAIYINLQDRDVKQGASTLTQQLARSLFSEVGRENTAGRKIREMFVALKLEAVYSKDDILKAYLNRVYLGAGNYGFEDAAQFYFDKSAQDLDVGEAATLVAMLPAPNLYNPVQDYQTSVQLRNRVIERMAMLGMIDEQEANRARRSRIQVSPKATQTLSQRQAPYFYGYIFGELNHLLGEDVAKEGNFVVETSLNLKMQALAEKSLQKFLTTEGKKYAVSQGAVVTLDSRTGAVLAMVGGKSYRESQFNRASQAQRQPGSTFKLFAYTAAIAKGVSTNQAFECGPFTWQGQNYKPCERSGAAPAITFAEGFAQSENVVALRVAQTVGLDEIIALAKDFGVNSSLVKEPGLVLGQSEARVLEMTGAYGAIANGGVWNRPHGIVNIRDGGDCPDPEQLKSCREVYQVSQDGRGQKQVVSPAIAATMTQLLQAAVTNGTGKAADIGYGTAGKTGTTDKAVDLWFIGFLPQKNLVTGIWLGNDDSSPTQGSSGLAATLWGQYMRQIASL

SEQ ID NO: 49970 - DNA, 1953 bp, Synechocystis sp. PCC 6803
  CDS (1)..(1953)
gtgtcatccactagcaccctaaaaccgtcttccaccaaggtcaaagccaaagcccagcctaattttttccagcgggtattgtgcaccaccggcaccacttttctgggggtgggtctagtttctaccgctgtggtggcaggaggggtggctggcttggcctttagttttcgtaatctacccgatgtgcggggtctaacttcctacgtgcccgcccaaaccagttatatctacgatgccaaaggacgggaattgctcagcctccacggggaagaacatcgcaaaattgtgcccctggcggaaatttctcccaacctaaaacgtgccgtactggcgatcgaagacagcaatttttataaacaccaaggcatcaaccccaacagcattgggcgggccctgttagtcaactttaaaagtggtggagtaagcgaaggggcttctacccttagcatgcagttggtaaaaaatatttatctgagccaaaaaagagtttttacccgcaaattggccgaagcggttttggcgattagagtcgaacaggtattcgacaaagaccaaattttggacatgtacctcaactatatctactggggccataataactacggtatccaaacggcggctgagagctactttaaaaaatccgctgctgatctagatttggccgaatcggctatgttggctggcatgatccaagccccggaggcctatagccctttcaacaactttactgcggctaaggaacgccaggaagtcgtactagaccgcatggtcagtattggttggattacccctgccgaggccgaggcagcaaaaaaagaacccctccagaacaagttgggtcaacccactgcttggcaaaacagcaaattgccctacgttaccgatgcagttattgctgaactggaaactagattcgggaaagaagccttggcccagggcggtttgagagtacaaagtaccgttgactacgacacccaaaagctggcggaaaaaactgtcaagtccgcctatagcggtttgcggggacgcatgggaagggcaaaggatttacagattgccctagtggcggtggagccggaaacccatttcatcaaagccatggccgggggagtggactacaacaaaagccaacttaatcgggtcaccatttcccgtcgtcagccgggttcggcctttaaaccctttgtttattacagtgcctttgccagtggaaaatacacccccgattcctccattgaagaccgtcccatcagtttgagagacggagcaggtttctattctcccaaaaactatggcggcggtttttccggctctatgtccattcgccaggcagtggccagttctgccaatattccagcggtgttgattggtagtcgtgttggccttaataaggtgattgaggatgctaagcagatgggcattaaaacaccattgcaatctgttctttccttgcccctggggtcggtggatgtgactccattggatatggccgtaggttatgccaccctagctagcaatggctggtattctgagcccaccgcaattttgcgggttaccaatgtgcggggagatgtcctgctagacaatactcccaagccccaacaagtgttagatccctgggctgcggctagtacttcttcagtgctcacttccgttgtccagggagggacaggtaaatcggcctacctagggcgtcccactgctggcaaaactggcaccacagacaatgagcgcaacgtttggtttgtgggttatgtgccccaattggccaccgccgtctggattggagatgatgctaaccgttctctgggtaaggggatttcaggagggggttatgccgctcccatttggcgctcttttatgagtcaggccatcaaaaatatgccagtggaaaacttcccctctccttcccaattcccccgtcccaagccggaaaaacagcaaaaatcctag

SEQ ID NO: 49971 - protein, 650 aa, Synechocystis sp. PCC 6803
MSSTSTLKPSSTKVKAKAQPNFFQRVLCTTGTTFLGVGLVSTAVVAGGVAGLAFSFRNLPDVRGLTSYVPAQTSYIYDAKGRELLSLHGEEHRKIVPLAEISPNLKRAVLAIEDSNFYKHQGINPNSIGRALLVNFKSGGVSEGASTLSMQLVKNIYLSQKRVFTRKLAEAVLAIRVEQVFDKDQILDMYLNYIYWGHNNYGIQTAAESYFKKSAADLDLAESAMLAGMIQAPEAYSPFNNFTAAKERQEVVLDRMVSIGWITPAEAEAAKKEPLQNKLGQPTAWQNSKLPYVTDAVIAELETRFGKEALAQGGLRVQSTVDYDTQKLAEKTVKSAYSGLRGRMGRAKDLQIALVAVEPETHFIKAMAGGVDYNKSQLNRVTISRRQPGSAFKPFVYYSAFASGKYTPDSSIEDRPISLRDGAGFYSPKNYGGGFSGSMSIRQAVASSANIPAVLIGSRVGLNKVIEDAKQMGIKTPLQSVLSLPLGSVDVTPLDMAVGYATLASNGWYSEPTAILRVTNVRGDVLLDNTPKPQQVLDPWAAASTSSVLTSVVQGGTGKSAYLGRPTAGKTGTTDNERNVWFVGYVPQLATAVWIGDDANRSLGKGISGGGYAAPIWRSFMSQAIKNMPVENFPSPSQFPRPKPEKQQKS

SEQ ID NO: 49972 - DNA, 2658 bp, Synechocystis sp. PCC 6803
  CDS (1)..(2658)
gtgtttaaatccttctcccgcaaacttaagcgctctaccgtcaactttctccaccagttagcgaacacattggaagtggaggaagaggttaaatcttcggcgatcgaggaaaagactctccccgttgcacaggttgcacaacatcttgagtctgaagcgcaaaattctgtcgatggcgatgatgggttaattttccctggggatggcgatgccgccgaactggaaccgggttatggcaggggcagggaaatggttacagccattaatattcaaaacgttcaacaccatagctcagccaatggagcagcagcagcggagcaaaacaaaagcaatggtaatggtagtgaacctggggcatctaccgtcactgctgagcaagttacgtccgttcccctatcctctgccgacaatacattggagagggggagccgccgccgtcgccgccgcaaaaggggtaaacataaacagtctgcgcccaaaacgccccttgctttggtcaccggactaaaaaacgttgggcgatcggtttcccaattaactcaacagcctcgattttggttggtatttggttttggcttgggggccggcatgggaacttccgctttggcctggggcttttaccagttggaaaccatgacccaggtggcgatcgccgatgtggtcacctatgcccctaggggaaccatgaccatcaaggcggccaatggggccattctccaggaaattggtaatgtcagccacgataaagtcaccatgggggaaattccgcccctagtggagcaggcattcgttgccagtgaagatagtcgcttccgggaacaccggggcattgatctccagggcattatgcgggcgtccctgtccaatgtgcaatccgggggcgtaatgcaaggaggcagtaccattacccaacagttagcccgcctcgtgtttcttacccaagaccgcaccctagccaggaaattgaaggaggtgcgattggctcaaaaaattgagactgccttacccaaagatcaaattttggaacgctatctaaacttgatctatctgggctctggggcctacggggtagcagatgcggcccatgcctatttcagcaagactccggaagagttgaccctaggggaggcggccactttagcgggagtagtaccagcccccagtgtttattccccccgacaaaatttggagctagctacccgtcgccgtaatgaagtgttgaaccgcatggcagaagtgggttttattacccccgcagaggcccaggcggcgatcgccgaacccttagtaatcaaccccagtcccctgaagcgctttaaccgggaggcggaattttttgctgactatattttggatgagttgcgggccaaattaccggaagaagaactgcaacaggggggattaactgtgaacactaccctcaatcaacaatggcaagaggaagcccaaactgttctcagcgatgcggtgaaaagatacggccgttggcagcggttttctgaaggggccatggtggccatggatccccgcaccggggccatcaaaatgatggtgggtggcaaagactacgatgccagtcagtttaaccgagtgacccaagccaaacgacaaccaggatcaacttttaaacccattctgtacggagcggcgatcgcctccggcatttcccccaacaaaagttaccttaatgtgcccattgacattggcggctaccaaccggccaactatggcgatcgctatactggcggcaacatgtccctgacggatgctctcaccagttctgtcaatgtggtggcggtgcgcttactgctggatgtgggctggaatccagtcatcaatttggcccgacaaatggggattacttccaagctggaacctacctattccctcgctttaggcgcttgggaaatgaccccgttggaaatgaccagtgcctacggtacctttgccaataagggtacccatgtgcaaccctacgccatccaaaatgtggtcaacgctcaaggggaagtggtgtacaaggcagaacataaacaaacccaagccctagatcccgaaagcaatgccatcctcacttccatgatgcgtcgggtcgtcacttccggtactggtcgccccgctcaattaggcgatcgccaagtagcaggaaaaaccggtacatcggatgaagcaaaggatctttggtttattggttatattccccaactggtcaccggggtgtggttaggcaacgacaatagtcgccccaccaatggagccagcaccaccgccgccatggtttggggacaatttatgcgggacgccaccaaggggatgccggtgcaatccttccctgccctgcccaaaaatctcgaccaacgtaaacccagcattaaagccgaacccattaagcgtcgggtcaaaacccttgctcctcctagctcaccggaaacagacggtcagaacaccactgagcgaccccgccgtcatcgccgtacccagaccgatgccgcccgccccagtaatatccaaactgctaggactagtgctccagcttctgcaccctcagctccccctagggcagtcagtgctccggccccagttgctgctcctgcagccgcccccgccgatgctaatgccggattacccgctccccctgctgcccgtaaatctgagtaa

SEQ ID NO: 49973 - protein, 885 aa, Synechocystis sp. PCC 6803
MFKSFSRKLKRSTVNFLHQLANTLEVEEEVKSSAIEEKTLPVAQVAQHLESEAQNSVDGDDGLIFPGDGDAAELEPGYGRGREMVTAINIQNVQHHSSANGAAAAEQNKSNGNGSEPGASTVTAEQVTSVPLSSADNTLERGSRRRRRRKRGKHKQSAPKTPLALVTGLKNVGRSVSQLTQQPRFWLVFGFGLGAGMGTSALAWGFYQLETMTQVAIADVVTYAPRGTMTIKAANGAILQEIGNVSHDKVTMGEIPPLVEQAFVASEDSRFREHRGIDLQGIMRASLSNVQSGGVMQGGSTITQQLARLVFLTQDRTLARKLKEVRLAQKIETALPKDQILERYLNLIYLGSGAYGVADAAHAYFSKTPEELTLGEAATLAGVVPAPSVYSPRQNLELATRRRNEVLNRMAEVGFITPAEAQAAIAEPLVINPSPLKRFNREAEFFADYILDELRAKLPEEELQQGGLTVNTTLNQQWQEEAQTVLSDAVKRYGRWQRFSEGAMVAMDPRTGAIKMMVGGKDYDASQFNRVTQAKRQPGSTFKPILYGAAIASGISPNKSYLNVPIDIGGYQPANYGDRYTGGNMSLTDALTSSVNVVAVRLLLDVGWNPVINLARQMGITSKLEPTYSLALGAWEMTPLEMTSAYGTFANKGTHVQPYAIQNVVNAQGEVVYKAEHKQTQALDPESNAILTSMMRRVVTSGTGRPAQLGDRQVAGKTGTSDEAKDLWFIGYIPQLVTGVWLGNDNSRPTNGASTTAAMVWGQFMRDATKGMPVQSFPALPKNLDQRKPSIKAEPIKRRVKTLAPPSSPETDGQNTTERPRRHRRTQTDAARPSNIQTARTSAPASAPSAPPRAVSAPAPVAAPAAAPADANAGLPAPPAARKSE

SEQ ID NO: 49974 - DNA, 2484 bp, Listeria monocytogenes EGD-e
  CDS (1)..(2484)
atggcagataaaccgcagacaagatctcagtatcgcaataaacaaagtggtggttctaaaaagaaatcccaaaaacgaggaaaacgagtagcagcgaatattttcaaaactattttctttgtgggattatttttagctttctttggtattgcggctggtgcaactgtcttttacgattacgcaaaagacgcaccaaaactgaccgactccaagctacgagatccgctttcatctaagttacttgataaagatggaaaagttttcgcagaagttggaaccgaacggcgggaatatattgaatacaaagatatacctgaaacactaaaaaatgcaattctaacaacggaagatgcgcgtttttatgaacatgatggcattgacccaattcgacttggtggagcagtaattgccaatttgacagacggttttggtgcagaaggtgcaagtaccctttcgcaacaaatcatcaaaatgtcctaccttgattacacaaacaaaacacttgcaagaaaagctcaagaagcatggttagctcttcagttagaagaaaaatatagcaagaatgacatcttagaaatttatgttaataaagtctatatgtcagaccgtgttcacggcatgcaaacagcttccgaacattatttcggtaaaaatgtgaaagaccttacgttagctcaaacagccttacttgcaggtatgccacaaagtccgaataactacaatccttatgaacacccagaagcagcaaaaaaacgtcgtgatcaagttttaacaaacatgtatacacacgataaaattacaaaagaagaaatgaccgaagctcaaaaaacacctatcactacaggacttcgctcgaaaaaagatcgtgaagataaaatttacaaatacgattcttacgtaacacaagtgttaagtgaaatcccaaaagaatatgatgtttatcgtgatggcttaaccattcatacagctcttgaccgtgatgcccaagagtacacggagaaaatgctcaatacgaacgaaattgttaacttcactgatgatgaaatgcaagcaggtattgttctgcaagatacaaaaactggacgtgttcaagcaatcggaggcggacgtaaacaaaaagtaactcggggttataactatgcaacccaagtaaaacgttctgttgggtctactatgaaaccaattgccgattatggtcctgcttttgaatatttggattggtcgactgcccatattttagaggatgaaccatatacgtattctggtggaacccctattaacaactgggatttcggttacaaagggccaatttcagtaagacaagcactttatcaatcgcgtaatattccagccctaaaaacacttcaagctgtcgggctagataaatccgaggaatttgttaataaactcggcatcacctatgatgaaggacaaaacgtagaatccaatgctatcggagcaaacagttccaacccaatgcaaatggctggtgcctatgctgcattcggtaacaaaggaatctacaacaagccacacactgttacaaaaatcgttttatcagatggacaaacagaaattgacacagaaccacaaagtactgttgctatgaaagaatcaactgcttatatggtttcagatgttctaaaagatgttctttctatcggaacaggtacatcagcagccgtaccaggcgtccctgctgctggtaaaacaggtacaacgaatattccacctgaattcacttcgaagtactactaccctagtggtgctgcccgtgactcatggttcgctggttatacaaccaattattctattgctgtatggaccggctatgatgacaagaaaaaatatgtatctgcaagtgaacaaaaaattgcgcagcggatgtttagtaaattgatggctcatgcatctgctggtaaaactactgcagatttcaaaatgcctagcaatgttgtttccgtcccaattctaaaaggcagcaacccaatcgcccgtgctgcacaaggcacttcaagcgataaagtaagttacgaattattcttatccggaaccgctccaacaaaaactgcttctactccagaagacgagaagaaaaaagcagaagaagctgcgaagaagaaaaaagcggaagaagataaaaagaaaacagatgaagagaagaaaaaagaagaagaagctaagaagaaagcggaagaggaagcaaagaaaaaggctgaagaagaagccaaaaatcttactgcccctgccggcttgagagcaagttataacgctggctctaagcaaattaatgtttcttggtctgcagtagaaggagcaacctatgaagtaacagtcaatggttccactactacagtatcttctacctccgtttctgtaagtggcggtaatcctggagacacagtttccattaatgtcgtcgccgttaaagatggtaagcgaagcccagcttcctctaccactgttaaaattccagatagttaa

SEQ ID NO: 49975 - protein, 827 aa, Listeria monocytogenes EGD-e
MADKPQTRSQYRNKQSGGSKKKSQKRGKRVAANIFKTIFFVGLFLAFFGIAAGATVFYDYAKDAPKLTDSKLRDPLSSKLLDKDGKVFAEVGTERREYIEYKDIPETLKNAILTTEDARFYEHDGIDPIRLGGAVIANLTDGFGAEGASTLSQQIIKMSYLDYTNKTLARKAQEAWLALQLEEKYSKNDILEIYVNKVYMSDRVHGMQTASEHYFGKNVKDLTLAQTALLAGMPQSPNNYNPYEHPEAAKKRRDQVLTNMYTHDKITKEEMTEAQKTPITTGLRSKKDREDKIYKYDSYVTQVLSEIPKEYDVYRDGLTIHTALDRDAQEYTEKMLNTNEIVNFTDDEMQAGIVLQDTKTGRVQAIGGGRKQKVTRGYNYATQVKRSVGSTMKPIADYGPAFEYLDWSTAHILEDEPYTYSGGTPINNWDFGYKGPISVRQALYQSRNIPALKTLQAVGLDKSEEFVNKLGITYDEGQNVESNAIGANSSNPMQMAGAYAAFGNKGIYNKPHTVTKIVLSDGQTEIDTEPQSTVAMKESTAYMVSDVLKDVLSIGTGTSAAVPGVPAAGKTGTTNIPPEFTSKYYYPSGAARDSWFAGYTTNYSIAVWTGYDDKKKYVSASEQKIAQRMFSKLMAHASAGKTTADFKMPSNVVSVPILKGSNPIARAAQGTSSDKVSYELFLSGTAPTKTASTPEDEKKKAEEAAKKKKAEEDKKKTDEEKKKEEEAKKKAEEEAKKKAEEEAKNLTAPAGLRASYNAGSKQINVSWSAVEGATYEVTVNGSTTTVSSTSVSVSGGNPGDTVSINVVAVKDGKRSPASSTTVKIPDS

SEQ ID NO: 49976 - DNA, 2481 bp, Listeria innocua Clip11262
  CDS (1)..(2481)
atggcagataaaccgcagacaagatctcagtatcgcaaaaaaccaaagggtagctctaaaaaagcccaaccaaaacgaggaaaacgtgtagtagttaatattttcaaaacgattttctttgtagggttatttttaactttctttggtattgcggctggtgcaactattttttatgattatgcaaaagatgcacctaaactgaccgactccaaactgcgtgatccactttcatccaagttacttgataaggatggcaaggttttcgcagaagttggaaccgaacggcgggaatatattgaatacaaagatatacctgaaacacttaaaaacgccattctaacaacagaagatgcgcgtttttacgaacatgatgggattgaccctatccgtcttggcggggctgttgtagccaacgttactgacggctttggtgcagaaggtgctagtactttatcccaacaaatcattaaaatgtcttatttagattatacgaataagacacttgcacgaaaagcacaagaagcatggttagcacttcaattagaagaaaaatatagcaaaaacgacattcttgaaatttatgtcaataaagtctatatgtctgaccgcgtgcacggtatgcaaacagctgccgaacattactttggtaaaaatgtaaaagatcttacattagccgaaactgcacttcttgctgggatgcctcaaagtcctaacaattacaatccatacgatcacccagaagcagctaaaaaacgtcgtgatcaagttttaaccaacatgtacacgcatgacaaaatttctaaagaagaaatgactaccgcacaaaaatcaccaattacaactggacttcgctcgaaaaaagatcgtgaagacaaaatttataaatacgattcttacgtaacacaagtattgagtgaaattcctaaagaatatgatgtctaccgtgacggattaacgatttatacagcacttgatcgtgacgcacaagaatatacagagaaaatgctaaatacaaacaaagttgttaatttcacggatgatgaaatgcaagccggaattgttcttcaagatactaaaaccggtcgtgtccaagcaattggtggcggacgtaaccaaaaagtaactcgcggatataactatgccactcaagtaaaacggtcggtaggttccacgatgaaacctattgccgattatggtccagcttttgaatatttagattggtcaactgctcatattttagaagatgaaccttatacgtatactggcggaacccctattaataactgggacttcgggtataaaggaccaatttccgtacgacaagcgctttatgattcaagaaacattccagcacttaaaacattacaagcagttggacttgataaatccgagcagtttgttaataaacttggtatcacctatgataaaggacaaaatgtagaatccaatgctatcggtgcaaacagttctaatccaatgcaaatggccggagcttatgctgcctttggtaataaaggaatttacaataaacctcatacagtaacaaaaatcgtcttatctgacggacaaactgaaatcgatacagaaccaagtagcacagtagcaatgaaagaatctactgcttatatggtttctgatgttctaaaagatgtactttctgtcggaacaggtacgacagcagctgtaccaggagttcctgccgctggtaaaacaggtacaacaaatattccacctgaattcacttcgaagtactactaccctagtggtgctgcccgtgattcatggtttgctggctatacaaccaattattctatcgccgtctggacaggctatgacgataagaaaaaatatgtgtcagcgagtgaacaaaagattgcacaacgcatgtttagtaaacttatggctcatgtatctgccaataaaacaacaacagatttcaaaatgccaagtaacgttgtatccgttccaattttaaaaggtagcaacccaatcgctcgtgccgcagaaggtacggcaagcgataaagtaagctacgaattattcttgtcaggtacggcaccaactaaaaccgcttcgacaccagaagatgagaagaaaaaagccgaagaagaagcgaagaaaaaagccgaagaagataagaaaaaaacagaagaagagaaaaagaaagaagaagaagctaagaaaaaagcagaggaagaggctaagaaaaaggctgaagaagaagccaaaaatcttactgcccctgccggcctaagagcaagttatgatgctaattctaaacaggttaatgtttcttggtctccggtaaatggcgcaacctatgaagtaaatgtcaatggttcaaccacaaccgtctcttctacttctgtatctgtaagtggtggtaaccctggcgataccgtatcaataaatgtcgtcgccgtaaaagatggcaagcgaagtcctgccgcctccactacagttagaattccagatagttaa

SEQ ID NO: 49977 - protein, 826 aa, Listeria innocua Clip11262
MADKPQTRSQYRKKPKGSSKKAQPKRGKRVVVNIFKTIFFVGLFLTFFGIAAGATIFYDYAKDAPKLTDSKLRDPLSSKLLDKDGKVFAEVGTERREYIEYKDIPETLKNAILTTEDARFYEHDGIDPIRLGGAVVANVTDGFGAEGASTLSQQIIKMSYLDYTNKTLARKAQEAWLALQLEEKYSKNDILEIYVNKVYMSDRVHGMQTAAEHYFGKNVKDLTLAETALLAGMPQSPNNYNPYDHPEAAKKRRDQVLTNMYTHDKISKEEMTTAQKSPITTGLRSKKDREDKIYKYDSYVTQVLSEIPKEYDVYRDGLTIYTALDRDAQEYTEKMLNTNKVVNFTDDEMQAGIVLQDTKTGRVQAIGGGRNQKVTRGYNYATQVKRSVGSTMKPIADYGPAFEYLDWSTAHILEDEPYTYTGGTPINNWDFGYKGPISVRQALYDSRNIPALKTLQAVGLDKSEQFVNKLGITYDKGQNVESNAIGANSSNPMQMAGAYAAFGNKGIYNKPHTVTKIVLSDGQTEIDTEPSSTVAMKESTAYMVSDVLKDVLSVGTGTTAAVPGVPAAGKTGTTNIPPEFTSKYYYPSGAARDSWFAGYTTNYSIAVWTGYDDKKKYVSASEQKIAQRMFSKLMAHVSANKTTTDFKMPSNVVSVPILKGSNPIARAAEGTASDKVSYELFLSGTAPTKTASTPEDEKKKAEEEAKKKAEEDKKKTEEEKKKEEEAKKKAEEEAKKKAEEEAKNLTAPAGLRASYDANSKQVNVSWSPVNGATYEVNVNGSTTTVSSTSVSVSGGNPGDTVSINVVAVKDGKRSPAASTTVRIPDS

SEQ ID NO: 49978 - DNA, 2271 bp, Nostoc sp. PCC 7120
  CDS (1)..(2271)
atgaattccccccaaccccctcacaagccacaaacgttacttggtcaactgacgcaagcagtcaatacaattcaagctagggttgacttttccaagctagcgctcaagcctaatgccaaggtaccggaactctgggtgcaggatgcgggggcggataaagcagaggtgtatccgctactgggcgatcgctatgttctcggtcgtagctctaaatccagcgatatagtgattcgtaacccagtagttagccaaattcatttgtcgttatcgcgggattctagccagcgtaccccagttttcatcattaaagatgaaaactctacgaacggcatctatcgcggtaagcggcgggttaataccttagaactgcgccacggggatattcttaccttggggccaccagaattagctgcctctgtgcgcctacaatacgtcgatccgccaccctggtatataaaagcggcaacttgggcaggctacggtgtaggcggtgctagcgccttattagcattggttattggcgtggaatggctaaaattttctgtcaggcctttaccaacaacaactcgcgctccagtagttgtttatgcccgcgatggtagtaccccattacgtgagcctcggactgtttctcatgtagacatgaagcggttagaagattttggcccttatttggcggcggcggtggttgcttctgaggatagccgctttaactggcattttggggttgatcctttggggattttacgagcagtattaatcaatactcgcagtggcgatgtccaacaaggagccagtactattacccaacaagtctcccggagcttgtttcgtgattacgtgggtagacaagactccctggggcgaaaattacgagaggcgatagtttctttgaagctagaagccttttacagcaaagatgaagttttgctgatgtacctaaatcgggtatttttgggagcagatacctccggttttgaagacgcagcacaattttattttgataaaccagctaaagaattaactttggcggaagcagccactttagtgggaattttaccagcgcccaatgcttttgatttttgtggcagtggccccaataaactagaagccgccgactatcgcaatcgcgtggtgaagcggatgttggaaatgggtaaagttacgcccgaagaagcgaaccgagccagaagatccactgtccaagttagccctaaggtttgtgaacaacaagccaagacaattgccccctatttttataactatgtgttccaagaactggaagcaattttaggggaaggagcagccagggagggcaattacatcattgaaacccaacttgatccagccattcaagctcaagcagaaacagctttgcggaattcagttagtacggcggggtcaacttttcgcttttctcaaggggcaatggtgaccctggatagtagaactggtagtattttggcaatggtaggtgggagagattatcgaactagccagttcaaccgggctgtacaagctaaaaggcaaccaggctcaaccttcaaaatttttgcctatgctcaagctctgttacaaggaatacctgcatctaggacatattcttgcgctcctttgacttggcagggatttacttacaggccttgtcgttctggtgctggtgtgaacatggatgtggctacaggattggctctgtcggaaaatcctgtggcgttgagaattgccagagaggttgggttagataaggtagtatcgatggcgcaacgtttgggggtaaagtctcaacttgacgcagtaccgggtttagttttgggtcagagtgttgttaatgttttggagatgactggggcttttggggcgattagtaatcgtggtgtatggaatccaccccatgccattaacagaattttagacagtagcgactgtagcgatcgcaatgatcttaaaacctgtcgtgtgatttattcctttgatagcgatcgcgaagctaacaagcgagttttaccacaacccattgccgaccaaatgaccgatttaatgcaggctgtgattaccagaggtacaggacgtagcgccgctattggtttaggagaagcaggtaaaacaggtacaaccgataaaaacgttgacttgtggttcattggctttattcccaaccgtcgcttagtcaccggtatttggctaggaaacgatgataattcccctacctctggtagcagcgctcaagccgcccagttgtggggaaattatatgcggagaattacgagataa

SEQ ID NO: 49979 - protein, 756 aa, Nostoc sp. PCC 7120
MNSPQPPHKPQTLLGQLTQAVNTIQARVDFSKLALKPNAKVPELWVQDAGADKAEVYPLLGDRYVLGRSSKSSDIVIRNPVVSQIHLSLSRDSSQRTPVFIIKDENSTNGIYRGKRRVNTLELRHGDILTLGPPELAASVRLQYVDPPPWYIKAATWAGYGVGGASALLALVIGVEWLKFSVRPLPTTTRAPVVVYARDGSTPLREPRTVSHVDMKRLEDFGPYLAAAVVASEDSRFNWHFGVDPLGILRAVLINTRSGDVQQGASTITQQVSRSLFRDYVGRQDSLGRKLREAIVSLKLEAFYSKDEVLLMYLNRVFLGADTSGFEDAAQFYFDKPAKELTLAEAATLVGILPAPNAFDFCGSGPNKLEAADYRNRVVKRMLEMGKVTPEEANRARRSTVQVSPKVCEQQAKTIAPYFYNYVFQELEAILGEGAAREGNYIIETQLDPAIQAQAETALRNSVSTAGSTFRFSQGAMVTLDSRTGSILAMVGGRDYRTSQFNRAVQAKRQPGSTFKIFAYAQALLQGIPASRTYSCAPLTWQGFTYRPCRSGAGVNMDVATGLALSENPVALRIAREVGLDKVVSMAQRLGVKSQLDAVPGLVLGQSVVNVLEMTGAFGAISNRGVWNPPHAINRILDSSDCSDRNDLKTCRVIYSFDSDREANKRVLPQPIADQMTDLMQAVITRGTGRSAAIGLGEAGKTGTTDKNVDLWFIGFIPNRRLVTGIWLGNDDNSPTSGSSAQAAQLWGNYMRRITR

SEQ ID NO: 49980 - DNA, 1932 bp, Nostoc sp. PCC 7120
  CDS (1)..(1932)
gtgtcttcatcagaaaatattgaacaggaacaactactaattcagccttcacctaattttgagttttggagaaaagtaggtttagttacaggtggtactctcttatcaattaatatgttggcaatttctattgtgacaggagggttagttggcttatttattagtttctataatttgccacagcttagacaaatacgcaattttgtaccagcagaaacaacatatatatacgacatcaaaggtaagcttttggtagggttgcatggagaggctaatagaaaatttgtgtccttagatcaaatttctccacatctaaaaagagcagtcttagctattgaagatagttatttttacaatcatcacggtatcgaccccggaggtataggacgtgctgcgttagttaattgggcatcaggtactgtgaaagagggtggttctaccatcactatgcagttggtaaaaaatctgtttttatctcgcgatcgcgctttaagccgcaaaatagcagaggctgtattagcaattcgcctagagcgtattctcaataaagatcaaattttagaactgtatcttaatcaagtttactggggtcataataactatggtgtgcaaacagcagcccagtcttacttcaataaatcagcacaagatttaactttggctgagtcagctttgatggctggccttatccaagctccagaaaaatttagtccttttgtggacatgaatttagctagacaaaagcaaaggcaagtcttgagaaggatgcgggaattaaaatggattacgaaacaagaatatgatgatgctcttcgacaacagattcaattaggcaaaattaaatcttttaaagctagtgtttttccttatgtcactaatgccgtatcacaggaattaattgaaaaatttgggcgtgatgctgtactcaaaggtggaatgcgggtgcaaacaacagtatctagtgatttacaaataattgcagaagaaactgtaaaaaaatggcacaaaactcttaaagaacgagggttaaaaaacaatcaaattgctttagtagcaatagacccacgtactcaatttgtcaaaaccttagtaggtggtgttgattcgcaaaagagcgaatttaaccgtgcaactcaagcccagcgtcaacctgggtctgcttttaagtcgttcgtctactatactgcttttgccagtggcaagtttacgcccgatacaaaggtactagattctccagtcagctatcctgacggggataaaacttactctccacgcaactacgataatacctttaagggtgcaatgccaattcgtactgctttagcactttctcgcaacgtccctacggtgaagcttggtaaatctgtaggaatgaataatgtgatcaaaacttgccgtaccttgggaattactagtcaaatggaacctgtaagttctttaccattaggcgcgattggtgttacgccactagagatggctagtgcctatgcaacttttgctaattatggttggtactcttctccaacactcattacccgtgtgactaatagtagtggtgatttattattagataatacccctaagcctcgtcaggttcttgacccttgggcatcggccgccattttagatgtgttgcaatcagcagtgaaggagggaaccggtagaggtgcggctttaaaccgtccagttgctggcaaaactggtacaacctcttcagaaagagatatctggttcataggtacagtaccacagttaacaacagccatttgggtaggtagagatgataacggacaattagctaggggtgcaacaggcggaggtatggttgctcccatttggcgtgattttatgcagaaggcgcttcacgatgtaccagtcgagaaattcaagccaccttctaattttcctcgccctcagccaaagaagaaataa

SEQ ID NO: 49981 - protein, 643 aa, Nostoc sp. PCC 7120
MSSSENIEQEQLLIQPSPNFEFWRKVGLVTGGTLLSINMLAISIVTGGLVGLFISFYNLPQLRQIRNFVPAETTYIYDIKGKLLVGLHGEANRKFVSLDQISPHLKRAVLAIEDSYFYNHHGIDPGGIGRAALVNWASGTVKEGGSTITMQLVKNLFLSRDRALSRKIAEAVLAIRLERILNKDQILELYLNQVYWGHNNYGVQTAAQSYFNKSAQDLTLAESALMAGLIQAPEKFSPFVDMNLARQKQRQVLRRMRELKWITKQEYDDALRQQIQLGKIKSFKASVFPYVTNAVSQELIEKFGRDAVLKGGMRVQTTVSSDLQIIAEETVKKWHKTLKERGLKNNQIALVAIDPRTQFVKTLVGGVDSQKSEFNRATQAQRQPGSAFKSFVYYTAFASGKFTPDTKVLDSPVSYPDGDKTYSPRNYDNTFKGAMPIRTALALSRNVPTVKLGKSVGMNNVIKTCRTLGITSQMEPVSSLPLGAIGVTPLEMASAYATFANYGWYSSPTLITRVTNSSGDLLLDNTPKPRQVLDPWASAAILDVLQSAVKEGTGRGAALNRPVAGKTGTTSSERDIWFIGTVPQLTTAIWVGRDDNGQLARGATGGGMVAPIWRDFMQKALHDVPVEKFKPPSNFPRPQPKKK

SEQ ID NO: 49982 - DNA, 2295 bp, Agrobacterium tumefaciens str. C58
  CDS (1)..(2295)
atggcaggcaagggtaaatcacgcgaacgggtagaaccttctttcggggattttcacgagtccggtgatgacctgcgtcttgacgccagcgaacgcatcagcggagcctcaaaacagcaagccaagaaaccgagaccggcatccggccgtaccaaatcccggaagaaagaaaagcgtagccgcaattcgggccggggcgtgacgggcttcatccgctccctcttctactggtgcatcgtgctcggcatctggggcggtatcggcgttgccgggcttgtcctttattatggtgcgcgcatgccgagcgccagcagctggtccattcccgaacggccgccgaatgtgaagatcgtttcggtcaatggcagcgtgcttgccaatcgcggcaccaccggcggcgaggcgctcgcgctggaagacatgtcgccctatattccgcaggcggtcatggcgatcgaagatcgccggttttattcgcatttcggggtcgatccgctgggtctcggacgcgccatcgtgacgaatgtgctgacgggacgagctgtccagggcggatcgacgctgacgcagcaactggcgaaaaacctgtttctctcgcccgaccggacgctggaacgcaaggtgcaggaagtgcttctgtccttctggctggagcacgaattcaccaaggaccagatcctcgcgatgtatctcaatcgcgtctatttcggctccaatgcctatggcgtcgaagcggcttcccggcgctacttcaacaaatccgcgcgcgacgtcaatctgggcgaagcggcaatgctggccgggcttctcaaagcgccctcacgcctttcgccggcgcgcgatccgcaggcggcggaagagcgggcgcaggtggtgctgcaatccatgcgcgatgtcggcttcatcaccgatgacgaaatcaagaccgcgatgtcgcagccgccgacaaaggcgaagcggttctggtcgggtgccgaacattacgccgccgatatggtgctggaggaagtccgcggcctggtgggcgaggtcaagcaggacatcgttgtcgatacaaccatcgaccccaatctcgagcgcgacgccgaaaaggcgctgacccatgtgctgcagggtgacggcaaaaaacagggtgcctcgcaggcggcgctggtttcgatagacggtacgggcgcgatccgggccgtcgtcggcggggcagattatgcgcaaagccagttcaaccgcgccgtaaaggcaaaacggcaaccgggttccgccttcaagcccttcgtttacgtcgccgcactcgaatcggggcttaccccctacacgatccgcaatgacgggccggtgcgcatcggaaactggacaccggaaaactacgaaaagaagtatcgcggcgaagtcacgctcgccaccgcgcttgccaattcactgaacacgatcgccgcacaactggtgatggaggtcggcccggaacgggtgacgcaggtggcgcatcgcatgggcatcgaatcggagctgcagaacaatgcctccatcgccctcggcacctctgaggtgtcgctgatggagctgaccgcctcctatgctcccttcatgaatggcggctacaaggcgacgccgcacatcgtcaagcgtatcaccgatgccgacggcaaggttctttacgaaaacaaatacgataatccaccgcgcgtgctgagcgaagagattgccgcgaccatgaacggcatgttgtcccgcgtcatcaccgaaggcaccggcaaggccgcgcgcctgcaaggctggcaggcggcaggaaaatccggcacgacccagtccttccgcgatgcactttttgtcggctacacaagcaacctcaccaccggcgtctggttcggcaatgacgacggcacctccatgaagaaggtcaccggcggcggactgccggcacgggcatggaaggatttcatgaccgctgcccattccgggctctcgccttcgccgcttttcggcctcggcgcaggtggcgtaccgccgctcggggacatgcagcagccggcaccggaagccgccccctcatccatcggcgagatcatttccaatgcgctgggtggcggaacgacggacacccgcgcctatcccgatgcgccggtttcacccaaccagccgggcatggccatgccgccggcgaacataccctcccgcgatatcgaaccaggctaccaggccggcaacgggcccgtgccacccgccgacataggcggccaggcccccgcacaatcggggccgaagcagacgacgctgcttgacattctgatgggaaattga

SEQ ID NO: 49983 - protein, 764 aa, Agrobacterium tumefaciens str. C58
MAGKGKSRERVEPSFGDFHESGDDLRLDASERISGASKQQAKKPRPASGRTKSRKKEKRSRNSGRGVTGFIRSLFYWCIVLGIWGGIGVAGLVLYYGARMPSASSWSIPERPPNVKIVSVNGSVLANRGTTGGEALALEDMSPYIPQAVMAIEDRRFYSHFGVDPLGLGRAIVTNVLTGRAVQGGSTLTQQLAKNLFLSPDRTLERKVQEVLLSFWLEHEFTKDQILAMYLNRVYFGSNAYGVEAASRRYFNKSARDVNLGEAAMLAGLLKAPSRLSPARDPQAAEERAQVVLQSMRDVGFITDDEIKTAMSQPPTKAKRFWSGAEHYAADMVLEEVRGLVGEVKQDIVVDTTIDPNLERDAEKALTHVLQGDGKKQGASQAALVSIDGTGAIRAVVGGADYAQSQFNRAVKAKRQPGSAFKPFVYVAALESGLTPYTIRNDGPVRIGNWTPENYEKKYRGEVTLATALANSLNTIAAQLVMEVGPERVTQVAHRMGIESELQNNASIALGTSEVSLMELTASYAPFMNGGYKATPHIVKRITDADGKVLYENKYDNPPRVLSEEIAATMNGMLSRVITEGTGKAARLQGWQAAGKSGTTQSFRDALFVGYTSNLTTGVWFGNDDGTSMKKVTGGGLPARAWKDFMTAAHSGLSPSPLFGLGAGGVPPLGDMQQPAPEAAPSSIGEIISNALGGGTTDTRAYPDAPVSPNQPGMAMPPANIPSRDIEPGYQAGNGPVPPADIGGQAPAQSGPKQTTLLDILMGN

SEQ ID NO: 49984 - DNA, 2274 bp, Agrobacterium tumefaciens str. C58
  CDS (1)..(2274)
atggttttgcgtcgggaatgggttgaaacgcagaaataccgacgggccgcgttgcctcgaacaggaaaacatcgccaggtgcaggaagaaaaagacgataataaaggccgcaggaagcggcatatcctgctccggatcgatagcttcatcgactccggcctgtggacggctgcggcacggctggtggatttctgggaagacgtcaccatcgcctcgcgcaaactgcatgtgcgcggctggaagaagcttgtcgtcaacctgacctgtgacgcgctgaccttcggaacggccggctcgattgtgcttctggcgctcgccatgcctgctttcgaggaaaccaagaaggactggcgttatcgcggcgatttcgccgtcaccttcctcgatcgttacggcaacaccatcggccatcgcggcatcatccatgaagacagcgtgccgatcgaccagatgcctgatcatttcatcaaggcggtgctggccaccgaggaccggcgtttcttcgaccatttcggcatcgatttcatcggccttgcccgcgccatgagcgaaaatgcccgcgctggcggcgtggtgcagggcggctcgacgctgacgcagcagcttgccaagaacctgtttctcaccaatgagcgctcgctggagcgcaagatcaaggaagccttcctcgcgctctggcttgagagcaacatgtcgaagaaggaaatcctcagcctttatctcgaccgcgcctatatgggcggcggcacctttggcgcggcggcggcggcgcagttttatttcggcaagaacctgaccgacgtgacgctctccgaatccgccattctggccggcctgttcaaggcgccggccaaatatgcgccgcatgtcaatttgccggcggcccgcgcccgcgccaataccgtgctttccaacctggttcagagcgggctgatgaccgagggccaggtgattggcgcacggcgcaacccggccaccgtcatcgaccgcgccgatgtgaaggcgccggattatttcctcgactgggccttcgacgaggtgcaacgactggccgccgaaggcaagtttaaggatcataccgtcgttgtgcgcaccaccatcgataccggcctgcagcaggccgccgagcaggcgatggaaatggagctgcgtgaatatggcgagggttaccgcgtcaaacagggcgcgatggtgatgatcgagaatggcggcggcgtgcgcgccatggtcggcgggcgtgattatggcgaaagccagttcaaccgcgccacggcggcgctgcgccagccgggctcttccttcaaggtctacacctactcggccgcgatggaaaagggcatgaagccggacacgctgatatcagacgcgccggtgacctggcgcggctggtcgcctcagaattacggccgctcctatgccggcaaggtgacgctgcaggtagcactcgccaaatcctacaataccgtgccggtccggcttgccaaggacgtgctaggcacgcaggtgatcgtcgacaccgccaaggcaatgggtgtcgccacaccgcttcgcagcgacaagaccattccgctcggcacgtcggaagtcacggttctcgatcaggccaccgcctatgccgtgttcccggccgacggtatgcagtcccgccgccacggcatcgagcaggtgatggattacgagggcaacgttctctacgatttcagccatgacgagccgcccgccaagcgggtgctttccgaagaagccaattcgaagatgaaccagatgctggtgaccattccggtgatgggcacggcccggcgcggcgcactggataacggcatcgtctccggcggcaagaccggcacctcacaggcttatcgcgacgcctggtatgtgggctttaccggcaactatacgaccgctgtctggttcggcaatgacgagttcacgccgatgaacaacatgaccggcggcgcgcttcccgccatgacctacaagcggctgatggactatgcccatcagggcatggagctgcgccccattcccggcatccagaacctgctgccgacaggcgcgcgtccgcagccttcggcacaggtcgccgccgcatccgccaccactgcgcccgccatgccggcactcacccgcccccgctcgctctcagccgaggcaacccgtgtcatccggtccatcgccaagacgatgaaggaagccccgcctctagcggtcacgacgcagaaggtggccgaagccactatccgcgatggcagggatgaagcggggcggcgttag

SEQ ID NO: 49985 - protein, 757 aa, Agrobacterium tumefaciens str. C58
MVLRREWVETQKYRRAALPRTGKHRQVQEEKDDNKGRRKRHILLRIDSFIDSGLWTAAARLVDFWEDVTIASRKLHVRGWKKLVVNLTCDALTFGTAGSIVLLALAMPAFEETKKDWRYRGDFAVTFLDRYGNTIGHRGIIHEDSVPIDQMPDHFIKAVLATEDRRFFDHFGIDFIGLARAMSENARAGGVVQGGSTLTQQLAKNLFLTNERSLERKIKEAFLALWLESNMSKKEILSLYLDRAYMGGGTFGAAAAAQFYFGKNLTDVTLSESAILAGLFKAPAKYAPHVNLPAARARANTVLSNLVQSGLMTEGQVIGARRNPATVIDRADVKAPDYFLDWAFDEVQRLAAEGKFKDHTVVVRTTIDTGLQQAAEQAMEMELREYGEGYRVKQGAMVMIENGGGVRAMVGGRDYGESQFNRATAALRQPGSSFKVYTYSAAMEKGMKPDTLISDAPVTWRGWSPQNYGRSYAGKVTLQVALAKSYNTVPVRLAKDVLGTQVIVDTAKAMGVATPLRSDKTIPLGTSEVTVLDQATAYAVFPADGMQSRRHGIEQVMDYEGNVLYDFSHDEPPAKRVLSEEANSKMNQMLVTIPVMGTARRGALDNGIVSGGKTGTSQAYRDAWYVGFTGNYTTAVWFGNDEFTPMNNMTGGALPAMTYKRLMDYAHQGMELRPIPGIQNLLPTGARPQPSAQVAAASATTAPAMPALTRPRSLSAEATRVIRSIAKTMKEAPPLAVTTQKVAEATIRDGRDEAGRR

SEQ ID NO: 49986 - DNA, 2448 bp, Agrobacterium tumefaciens str. C58
  CDS (1)..(2448)
atgatcagactgattggatattttttcggcttggccagcgtgctctttctgtgcgctgccgtcgtcggtgcgatttatttgcacggcgtgacgaaggacctgccggattatgcagttctgagcacgtatgaaccgccggtaacgacccgtgtgcacgccggcaacggtgctctgatggcagaatatgcccatgaaaagcgccttttcctgcccatccaggcaattcccgaccgcgtgaaggccgccttcctgtccgccgaagacaagaatttctacaatcaccccggtgtcgatatctggggtctcggtcgcgccattctcgtcaatctccagaatctgggctctggccgccgcccggtcggcgcttccaccatcacccagcaggttgcgaagaacttccttctgacaaacgatcagaccatcgaccgcaagctcaaggaagccattctttccttccgcatcgagcagacctattcgaaggacaagatcctcgaactttatctcaacgagatctttttcggcctgaattcttacggcatcgccggcgcggcgctcacctatttcaacaaatcggtgacggaactgactatcgccgagaccgcctatctcgcatcgctgccgaaaggcccggccaattaccatccgatccgtcgcgaaaaagcagcgctggagcgccgcgactgggtgatcgaccgtatggccgagaacggctatatcaccgttgccgacgccaccgatgccaaaaagcagccgctcggcgtcaatctgcgtcgcggcggcgcccatattgccgcatccgattatttcgccgaggaagtccgccgccagatcgtcgagaaatatggcgaagaagcgcttctcgaaggcgggctctctgttcgcacctcttttgatccgcagatccagatggaggcgcgcaaggcgcttcaggatgggcttgtgcaatatgacgaacgccgcggtttccgtgggccgatcgaaaagatcgagacggccggcgactggacggcggcgctggccaaggtcaagggtctccgggacgttcccgaatggaaggttgccgtcgtactcgccgttgccgccgatggcgtcgatatcggtgtccaggccgacccggatgcggaagatggcgacaagcgcacgcgcggccatatctcggctgaaaacatgcgctgggcattccgtgacgccagcggcaagaaagcgacatccaagtcgccggtcggcgttgtgacggcgggcgacgtcgtctatgcgcagccgctttccggctctggcaacgaataccgtctgcgtcagccgccgaaagtgcagggtggcatggtggtgatggacccgcataccggccgcgttctggccatggtcggcggcttctcctacgcgcagtcggaattcaaccgctccacgcaggccatgcgccagccgggttcgtccttcaagccgttcatctatgcggccgcgctcgacaatggctacacgccggcatcggtcattctcgatgcaccgatcgaagtcgtgtcgggcggtcaggtctggaaaccgcagaattacggcgggggttccgcgggtccgtcgacgttgcgtctcggcatcgaaaaatcccgtaacctgatgaccgtgcgcctggcgcaggacatgggcatgaaccttgtggcggaatatgccgaacgcttcggcatctacgacaagatgccgccgcttttgtccatgtcgctcggttcgggtgaaaccactgtcatgcgtatggtctcggcctactcggtccttgccaatggcggcaagcagatcaagccgacgctgatcgaccgcattcaggaccgttacggcaagacgatcttccggcacgaggagcgcggctgcgagggctgcaatgcgacgagctggcagaaccaggacgagcccgtcatcgttgacaatcgtgagcaggttctcgatccgatgactgcctaccagacgacgtccatgctggaaggcgtggtgaagcgcggtacggcggcgggcaagatcaaggtcgatctgcctgttgccggcaagacgggcacgaccaatgatgaaaaggacgcctggtttgtcggttatacgcccgacatggtcgccggcctctatatcggtttcgactcgccggcaccgctcggtcgcggcggcaccggtggctcgctgtcagcgccgatcttcggtgaattcatcgccgatgcggccaagcatctggagccgagcaagttcatcgtgcctgctggcatgaacttcgtcgccgtcaaccgcaagacaggcatggcggcggctgaaggcgaaccggacacgatcatggaagcgttcaaacccggcacgggtccggcttccaccttctcggtgattggtgctgaaggctacatgtcgcaggaagacattctgaagacgtcgccgcaggcacagcaggccatcactggcggtggcggcggtctttattga

SEQ ID NO: 49987 - protein, 815 aa, Agrobacterium tumefaciens str. C58
MIRLIGYFFGLASVLFLCAAVVGAIYLHGVTKDLPDYAVLSTYEPPVTTRVHAGNGALMAEYAHEKRLFLPIQAIPDRVKAAFLSAEDKNFYNHPGVDIWGLGRAILVNLQNLGSGRRPVGASTITQQVAKNFLLTNDQTIDRKLKEAILSFRIEQTYSKDKILELYLNEIFFGLNSYGIAGAALTYFNKSVTELTIAETAYLASLPKGPANYHPIRREKAALERRDWVIDRMAENGYITVADATDAKKQPLGVNLRRGGAHIAASDYFAEEVRRQIVEKYGEEALLEGGLSVRTSFDPQIQMEARKALQDGLVQYDERRGFRGPIEKIETAGDWTAALAKVKGLRDVPEWKVAVVLAVAADGVDIGVQADPDAEDGDKRTRGHISAENMRWAFRDASGKKATSKSPVGVVTAGDVVYAQPLSGSGNEYRLRQPPKVQGGMVVMDPHTGRVLAMVGGFSYAQSEFNRSTQAMRQPGSSFKPFIYAAALDNGYTPASVILDAPIEVVSGGQVWKPQNYGGGSAGPSTLRLGIEKSRNLMTVRLAQDMGMNLVAEYAERFGIYDKMPPLLSMSLGSGETTVMRMVSAYSVLANGGKQIKPTLIDRIQDRYGKTIFRHEERGCEGCNATSWQNQDEPVIVDNREQVLDPMTAYQTTSMLEGVVKRGTAAGKIKVDLPVAGKTGTTNDEKDAWFVGYTPDMVAGLYIGFDSPAPLGRGGTGGSLSAPIFGEFIADAAKHLEPSKFIVPAGMNFVAVNRKTGMAAAEGEPDTIMEAFKPGTGPASTFSVIGAEGYMSQEDILKTSPQAQQAITGGGGGLY

SEQ ID NO: 49988 - DNA, 2460 bp, Brucella melitensis 16M
  CDS (1)..(2460)
atggtaaggcttatcggatatttcttcgggataggcaccgttttgatgctgttggtggcaggcggtgcggcgctttatattggaagccttgcgaaggatttgccggattatgaggtgctcgccaagtacgagccaccggtgatgacgcgagttcatgcttccgatggcagcctgatggccgagtttgcccgtgagcgacgcctttatctgccgattcaggccgtgccgaaccgcgtgaaggcggctttcgtttccgccgaagacaagaccttttatgagcatcatggcctcgatttcggtggccttgcgcgtgcggtggtcacgaatctgaagaatataggttctggccgccgtccggtcggcgcctccaccatcacgcaacaggtggcgaagaacttcctgctgagctccaagcagacctatgatcgcaagatcaaggaagccatccttgcgatgcgcattgagcaggcatattccaaggatcgcattcttgagctttacctgaacgagattttctttggtctcggttcctatggcattgccagtgcggcactgacctatttcgacaagtcggtgggcgaactgaccattgcggaaagtgcctatcttgcggccctgcccaaggggccgaacaattaccatcccttccgccagcccgagcgcgccatcgagcgccgcaactgggtgatcgaccgcatggccgagaatggctatatcacgactgccgaagcggaagacgcaaagaagcagccccttggcgtcaccccccgcacggctacccattatctctttgcttccgaatatttcaccgaagaagtgcgccgccagatcattcagaaatacggtgtcgatgcgctttacgaaggcggcttgtcggttcgcacgaccctcaatcccaaattgcagcttgaagcgcgcaaatccttgcaggcggcattgatacgctatgacgaggcgcgcggctggcgcggcccgttgaaaaatgtcgagcttggcggcgattggggtacggctttcggcaatatggagccctattcggatgtgccggaatggcagcttgccgtcgtcctgaatgttacgcctgccggtgctgatatcggcctccagccgcagtttgacgcgtccggttcacgcagcaaggagcgcaagcgcgctttcatcgctgccgacgatatgaaatgggcaatgcgcatcgtcaatatcggcggaaagcgcaccagtgccaagtcgccggaaggcgtgctgaagccgggcgatattatctatgtgtcaaagacgggcgattcccggtatagtctccagcagccgccgaagcttgaaggagcactggttgccatggacccccatacgggccgtgtgctggccatggttggcggtttttcctttggcgaatcggagtttaatcgcgccacgcaggcctatcgccagccgggttcgtccttcaagccgtttgtctatgcggctgcactggataatggctatacgcctgcttccgtggtgctggacgggccgctggaaattgaccagggcgggtcgctcggtatctgggctccgaaaaacttttcgggcaagttcgccggcccctctacgctgcgctacggcatcgagcagtcccgtaacgtcatgaccgtgcgtctggcgcaggatatgggcatgaagctcgtggtcgaatatgccgagcgtttcggtatctacgacaagatgttgcctgttctctccatggtgcttggcgcgggcgaaaccacggtgcttcgtatggtgacggcttattcgattatagccaatggcgggcagagcatcacgccatcgatgatcgaccgcattcaggaccgctacggcaagaccgtgttcaagcatgacaaccgccagtgcgaaggttgcaatgcgcaggaatgggccaatcaggacgagccgacactgatcgacaatcgcgatcaggttctcgatcccatgacggcctatcagatcacgtcgatgatggaaggtgtcgtgcagcgcggaacggcacagatattgaagagcctggaccgcccgctggcgggcaagaccggaacgaccaacgaggaaaaggatgcctggttcgtgggcttcacacctgatctcgtggttggcgttttcatgggatatgatacgcctactccgcttggccgcggcaatacgggcggtggccttgccgcgccggtgttcaagtccttcatggagcaggctttggctcgaacgccgaaggttgatttccgtgtgccggaaggcatgaccgtcatcgcgatcgaccgcaagacgggcatgcgcgccaatccgggcgatccgaatgtcattatggaagctttcaagccgggcaccggcccgtccgacagctattcggtcatcggcatggacacgttccgcgaaggctccccggttgcgccgcagtccccgcaggcaacccgcgcgatcaattccggttccggcggactttactga

SEQ ID NO: 49989 - protein, 819 aa, Brucella melitensis 16M
MVRLIGYFFGIGTVLMLLVAGGAALYIGSLAKDLPDYEVLAKYEPPVMTRVHASDGSLMAEFARERRLYLPIQAVPNRVKAAFVSAEDKTFYEHHGLDFGGLARAVVTNLKNIGSGRRPVGASTITQQVAKNFLLSSKQTYDRKIKEAILAMRIEQAYSKDRILELYLNEIFFGLGSYGIASAALTYFDKSVGELTIAESAYLAALPKGPNNYHPFRQPERAIERRNWVIDRMAENGYITTAEAEDAKKQPLGVTPRTATHYLFASEYFTEEVRRQIIQKYGVDALYEGGLSVRTTLNPKLQLEARKSLQAALIRYDEARGWRGPLKNVELGGDWGTAFGNMEPYSDVPEWQLAVVLNVTPAGADIGLQPQFDASGSRSKERKRAFIAADDMKWAMRIVNIGGKRTSAKSPEGVLKPGDIIYVSKTGDSRYSLQQPPKLEGALVAMDPHTGRVLAMVGGFSFGESEFNRATQAYRQPGSSFKPFVYAAALDNGYTPASVVLDGPLEIDQGGSLGIWAPKNFSGKFAGPSTLRYGIEQSRNVMTVRLAQDMGMKLVVEYAERFGIYDKMLPVLSMVLGAGETTVLRMVTAYSIIANGGQSITPSMIDRIQDRYGKTVFKHDNRQCEGCNAQEWANQDEPTLIDNRDQVLDPMTAYQITSMMEGVVQRGTAQILKSLDRPLAGKTGTTNEEKDAWFVGFTPDLVVGVFMGYDTPTPLGRGNTGGGLAAPVFKSFMEQALARTPKVDFRVPEGMTVIAIDRKTGMRANPGDPNVIMEAFKPGTGPSDSYSVIGMDTFREGSPVAPQSPQATRAINSGSGGLY

SEQ ID NO: 49990 - DNA, 2193 bp, Brucella melitensis 16M
  CDS (1)..(2193)
atggctcgctcgcaacagcgcaggcaaaagcaatccgcagatcgtgctccccgctcttcgcggggcggtaaaagaaagcaacgcggctttttcggttttctgcgccgttcgatctactggtttctcgtgctgggcctttggggcggcatcgcctttgctggccttctggtctatttcgcggccaagatgccgccgacgaccgcctgggccattcctgacaggccacccaatgtgcgcattgtcgatgtgaacagcaatctcatcgccaaccgtggcacgacgggcggcgaggccgtgagcctgcatgaaatgtcgccctatattccccaggccgttatcgccattgaggaccgccgcttcaattcgcatttcggtatcgacccgatcgggcttgcgcgcgctatcgtaaccaatgtggtttcgggccgcgcggtgcagggcggctccacgctgacacagcagcttgccaagaatctctttctttcgcctgaccgcacgctggagcgcaaggtgcaggaagtgatgctcgccctttggctggagcataaatataccaaggaccagatattggagatgtatctgaaccgggtttatctgggttcgggcgctttcggcgtcgatgcggcatcgcggcgctatttcaacaaatcggccaaggacgtgaacctgatggaagcggcaacgcttgcagggctcctgaaagcgccttcgcgcctctcccctgcccgcgacccggaagccgccgcagcgcgcgccaggctggtgctgggcgccatgcgcgagaaaggcatgatcgacgacaggcaggtggcgattgccgaaagcgaaccaccgacgcgcgcgccttcctactggcagggttcggaaaactatgtggccgacaaggttgtcgccgaattgcccgaactgatcggcgaagcaaaggatgacatcatcgtccagacgaccatcgatcttaacctccagcgcgctggcgaagaggcgatcaaggatcagatcgagcagaacggcaaaaagatgaatgcgagccagggcgcgcttgtttccatcgataatacgggcgcggtgcgcgccatggtgggcggggtggactatgcggccagccagtttgaccgcgtgaccgatgcgcatcgccaaccggcttcctcgttcaagccctttgtctatctttctgcgctggaacagggccggacaccggattccgtgcgcaacgacgcacctgtgcgcatcggcaaatggacaccgagtaatgataacggcaagtatatggggccagtgacgctcgccaccgcactttcccattcgctgaactcggtcgcagcccagcttgtgatggaagtcggcccccaaaccgtgatcgacacggcccaccgcctcggtgtgcagtcgaagcttgaacccaatgcttcgctggcgctaggcacgtcggaagtgacacttcttgaattaaccgacgcctatgttcccttcgccaatggcggctatcgcgcgccggtctatttcattaccaaggtgacggattccgatggaaacgtgctttaccagaaggaagatggtgtcggcccgcgcgtgatcgacgagcgcaatgtcggcatgatgaacgccatgctgcgccgcaccgtggaagatggcaccgccaaacgcgccgccttcggctggccggccgcaggcaaaaccggcactagccagaatttccgcgatgcctggttcatcggctacacagccaatcttacgaccggcgtttggttcggcaatgacgacggcaagggcatgaagcgcgtttttggcgcaacacttcccgtggcggcctggaaaagcttcatgaaggaagcacataagggtgttcccatcgccgagcttcccggccattacgatatccagaacgtgctgcccggcggcagcgacggcatagaccccaatgcgccttatgatcccggcatgatgcagcaggataattatggcaaccagccgatggcaggcaccggcgacgatggctactggccaccggcgccggatttgcccggccgaagcggtatccagcagggcgaaaccggacagccccttgcctcttccgccaggaataacggcgattaccggcccatgcctgcgggcaatgtgggcgaacagccgcaagcccagcctgcgagaaaatccaccaccctgctcgatatcatcatgggtaattcacagtaa

SEQ ID NO: 49991 - protein, 730 aa, Brucella melitensis 16M
MARSQQRRQKQSADRAPRSSRGGKRKQRGFFGFLRRSIYWFLVLGLWGGIAFAGLLVYFAAKMPPTTAWAIPDRPPNVRIVDVNSNLIANRGTTGGEAVSLHEMSPYIPQAVIAIEDRRFNSHFGIDPIGLARAIVTNVVSGRAVQGGSTLTQQLAKNLFLSPDRTLERKVQEVMLALWLEHKYTKDQILEMYLNRVYLGSGAFGVDAASRRYFNKSAKDVNLMEAATLAGLLKAPSRLSPARDPEAAAARARLVLGAMREKGMIDDRQVAIAESEPPTRAPSYWQGSENYVADKVVAELPELIGEAKDDIIVQTTIDLNLQRAGEEAIKDQIEQNGKKMNASQGALVSIDNTGAVRAMVGGVDYAASQFDRVTDAHRQPASSFKPFVYLSALEQGRTPDSVRNDAPVRIGKWTPSNDNGKYMGPVTLATALSHSLNSVAAQLVMEVGPQTVIDTAHRLGVQSKLEPNASLALGTSEVTLLELTDAYVPFANGGYRAPVYFITKVTDSDGNVLYQKEDGVGPRVIDERNVGMMNAMLRRTVEDGTAKRAAFGWPAAGKTGTSQNFRDAWFIGYTANLTTGVWFGNDDGKGMKRVFGATLPVAAWKSFMKEAHKGVPIAELPGHYDIQNVLPGGSDGIDPNAPYDPGMMQQDNYGNQPMAGTGDDGYWPPAPDLPGRSGIQQGETGQPLASSARNNGDYRPMPAGNVGEQPQAQPARKSTTLLDIIMGNSQ

SEQ ID NO: 49992 - DNA, 2040 bp, Clostridium perfringens str. 13
  CDS (1)..(2040)
atgactgaaagaaaaagagagcataaagatagaaagcagaataaaaattcacctaaaaatcaatcgaaagtaacaaaatttttgaaatggttctttatagggattctgcttctagggataactgccgtaacagtagttggaatttacgttctttctattatacgttcatctccagagttagatgttcaggcaattcaatctctaaatcagccatccattctttacgatgatcagggaaactttatggataatgttataactcgtgaacaacgttatgtagttaaatctgaagagatacctgataacttaaaaaaggcttttgtagctattgaagacgaaagattttatgagcataaaggaatagacattaaaagaatttttggggtaatagcttctaatattaaaggtaaactttcaggaagtaatacagttcaaggggcttcaaccataactcagcaacttataaaaaatgccgtacttactaatgaagttagttatgaaagaaaaattaaagaaatgtacttagctttggaattagaaaagcacctttcaaaagatgaaatccttactacgtatttaaatacaattcctatgggtggataccaatatggggttagcgcagctgctcaaagattttttagtaagaatgtttcagatttgaatttagttgagtgcgcttatttaggaggacttactcaagcaccaacttcttatgatggtctttcagaagcaaataaagaaaatccaagtagatatttaaatagaactaaatctgtactatttaaaatgcatgaacttggatatatttcaagtgaacaatataatgacgcaataaatgaaattgacacaaatggtataaaattcacaccaaataataaattaagtaaaactaactttgagtggttcacaagaccagctataactcaagttaaacaagacttaatggataaatataaatatacacaagaggaagttgacaaacttatagctaatggtggattaaaaatctatacttcaatggatagaaatcttcaaaataatgttcaaaaagttttagatgatccaaataactataaagctataactaataatcctaatgaaaaaaatgaagatggtgtttataaattacaagcatctgccacaataatagactataaaacaggccatgttaaggctttagttggaggaagaggggaacaacctgctatgtctcacaatagagcttattatgatttaaaatctataggttctgcaacaaaaccattaacagtttatggtcctgctattgatttaggacttggtggcgctggctctgtagtaaatgattctccattaagtaataaagagttatcttctacaggatataaagatcaacctaagaatgaatacaatagttatagaggccctttaacttttagagaagcaattaaaatctctagtaacttagcagccataaaagttgctaatgaagtaggtgtttcaaactctatagcttatggagaaaaattaggtcttgtttatggacctcattctagaggtatttccacaacagccttaggtcaattccaaaatgaccctaataatcctgatggaggaaatacttatactctagcttcagccttcggtgtttttggtaataacggtgttaaaacaaatgctaaattatatacaaaggtattagattctcatggaaatgtaattcttgatacaagtactccagaagaaactaaaatatttagtcctcaagcgtcttatatagtttatgatatgcttaaggatcaagtagaaagtggctctgcaaaatctgctaaatttggtaatattcctgtggcgggtaaaacaggaactactactggagataaagactatttatttgcaggattaactccatattattctgcggctatttggattggatatgataagcctagagaaatgagaactagtagtggtactgttacctctcctattttcggaaaaataatgggcttagctcataaagacttacagtacaaagaggttgacaacctagtggaataa

SEQ ID NO: 49993 - protein, 679 aa, Clostridium perfringens str. 13
MTERKREHKDRKQNKNSPKNQSKVTKFLKWFFIGILLLGITAVTVVGIYVLSIIRSSPELDVQAIQSLNQPSILYDDQGNFMDNVITREQRYVVKSEEIPDNLKKAFVAIEDERFYEHKGIDIKRIFGVIASNIKGKLSGSNTVQGASTITQQLIKNAVLTNEVSYERKIKEMYLALELEKHLSKDEILTTYLNTIPMGGYQYGVSAAAQRFFSKNVSDLNLVECAYLGGLTQAPTSYDGLSEANKENPSRYLNRTKSVLFKMHELGYISSEQYNDAINEIDTNGIKFTPNNKLSKTNFEWFTRPAITQVKQDLMDKYKYTQEEVDKLIANGGLKIYTSMDRNLQNNVQKVLDDPNNYKAITNNPNEKNEDGVYKLQASATIIDYKTGHVKALVGGRGEQPAMSHNRAYYDLKSIGSATKPLTVYGPAIDLGLGGAGSVVNDSPLSNKELSSTGYKDQPKNEYNSYRGPLTFREAIKISSNLAAIKVANEVGVSNSIAYGEKLGLVYGPHSRGISTTALGQFQNDPNNPDGGNTYTLASAFGVFGNNGVKTNAKLYTKVLDSHGNVILDTSTPEETKIFSPQASYIVYDMLKDQVESGSAKSAKFGNIPVAGKTGTTTGDKDYLFAGLTPYYSAAIWIGYDKPREMRTSSGTVTSPIFGKIMGLAHKDLQYKEVDNLVE

SEQ ID NO: 49994 - DNA, 2163 bp, Corynebacterium glutamicum ATCC 13032
  CDS (1)..(2163)
ttgacgaatagtaaaaatcctcctgccaaaaagagcagcggcaaaaggcgcttaaagagcgactctaagggctacgctgtaagaaacaccatcattggtgccattgttgctgtcattttgattccagtaatggtcttcatgggtgcttacatcatggttgatgttccagaaccggaagagttggtttcaccccaggtttcgcagatttacgcatctgacggtgagactgaattggcacgcatcgttcctccagaaggcaaccgccagatggtgacgatcgatcaggtgcctgacactgtgaaaaatgcggtggtggctgcggaagaccgagagttttacacaaaccccggtttttccattactggctatgcccgagcagcacttggcgtaatcactggtgattcttcagcgggtggtggttccaccattactcagcagtatgtgaagaaggctgtggttggtgatgagcgttcgctgatccgtaaggctaaggaattggtctattccgcgaagatggccaatgagtggtctaaggacgaggtccttgaggcttatctcaacactgtgtacttcggtcgaaatgcctatggtgtgcaggctgcagctcatgcattctttgataagccagtagaagagctcacggctgctgagggcgcagtgctggcggccagtattcagctgccaagccagttggatccttggacaaatccagttgaggcggaaacgcgttggaactatgtcatggacggcctggtggaaattggcgctatctcggcagaggagcgcgcagttgctacctaccctgaaaccactgaccctgcgtccaacagtgcgtacaccgaagccaccggcactaatggtttgattaagaaccaagtgatggcggagttgtctgagcttggtatcactgaggatgatgtgcaaacccgtggtttgcaggtcaccaccaccattgatccaaagactcaggaaggtgccgttgaagcggtacaaaaccagttggatcttctgtctgagaacaaccgtgcagcggtagtctccattgatccttctaatggtgcggttcgtgcttattacggcggcgaggatgcgactggttgggactttgcaaacgctccgcttcagaccggttctacattcaagatctttggtctggcagcagcacttcagcaaggtattccactgtctcagccatacagctctgcgccggtgactgtgggtgatgctcaaatcggaaacgtcggtggcagcggttgtggttcctgttccatcgagcaggcgttgttgcattcttacaacaccagcttcattcgtttgcagcaggatctggaaaatggttcacaggatactgcggacatggcgcatgctttgggtatcgcgaagtctttgccaactatccctgagacactgactgaaaacggagagaccccttatgagggcatcatcttgggtcagtatgagtcccgcccacttgatatggcttctgcgatggcaactatcgctaatgaaggtgtctggcaccgcccgcacttcgtgtccaaggtggagactgtcagcggtgaggttctctacgagttcgaggatggcgacggcgagcgtcgtgtttctgaaaaggttgcactgaatctgctcaaggccatggggccaatcgctgcatactccaacggaaacgctctggctgatggccaggtttctgcatccaagactggtaccactcagcttggtgataccggtgcaaacaaggatgcgtggatgttgggtgcggcacctcagctagctactgcggtgtgggtcggaactgctgataacactgcattgtataacacctggggtggcagtatgtatggttctaactcccctgccacgatctggaagcagaccatggataacgccctcgagaactcccctctcgaaacttgggatatcgctccagcattggggtacggtaacccaccagttccggaatatgtgtggactccaagtccaaacatcgcgactaatgatccagaaggagcaaccgaggaagctccagtggaggatccaaatgcagtaatcgatacccctgctgtagatcccactgcacctgcagaggagaccggtaacggtcaggtagaaatcctgccggggctgactatcccgggagatctcttagggatcggctaa

SEQ ID NO: 49995 - protein, 720 aa, Corynebacterium glutamicum ATCC 13032
MTNSKNPPAKKSSGKRRLKSDSKGYAVRNTIIGAIVAVILIPVMVFMGAYIMVDVPEPEELVSPQVSQIYASDGETELARIVPPEGNRQMVTIDQVPDTVKNAVVAAEDREFYTNPGFSITGYARAALGVITGDSSAGGGSTITQQYVKKAVVGDERSLIRKAKELVYSAKMANEWSKDEVLEAYLNTVYFGRNAYGVQAAAHAFFDKPVEELTAAEGAVLAASIQLPSQLDPWTNPVEAETRWNYVMDGLVEIGAISAEERAVATYPETTDPASNSAYTEATGTNGLIKNQVMAELSELGITEDDVQTRGLQVTTTIDPKTQEGAVEAVQNQLDLLSENNRAAVVSIDPSNGAVRAYYGGEDATGWDFANAPLQTGSTFKIFGLAAALQQGIPLSQPYSSAPVTVGDAQIGNVGGSGCGSCSIEQALLHSYNTSFIRLQQDLENGSQDTADMAHALGIAKSLPTIPETLTENGETPYEGIILGQYESRPLDMASAMATIANEGVWHRPHFVSKVETVSGEVLYEFEDGDGERRVSEKVALNLLKAMGPIAAYSNGNALADGQVSASKTGTTQLGDTGANKDAWMLGAAPQLATAVWVGTADNTALYNTWGGSMYGSNSPATIWKQTMDNALENSPLETWDIAPALGYGNPPVPEYVWTPSPNIATNDPEGATEEAPVEDPNAVIDTPAVDPTAPAEETGNGQVEILPGLTIPGDLLGIG

SEQ ID NO: 49996 - DNA, 2196 bp, Fusobacterium nucleatum subsp. nucleatum ATCC 25586
  CDS (1)..(2196)
gtgataggagtttttgcaataattataaaatataggttggaattaccaaatatacaaagtatggttgaggactataaacctcaaatggcaacaataatctatgacaaaaataataatgttgtggatactctttctgtggaatcaagagaaattgctaaacttgaaaatatttctccctacgtaaaagaggcttttttatctattgaagataaacaattttattctcatcacgggttaaattttagagggataacaagagcaattgttacaacttttttaaaaggaagaccaacacaaggtggaagttctataactcaacaattagctaaaaatgcttttttgacacctgaaagaacattttcaagaaaagtaaaagaagcaattttaacttaccaaatagaaagaacttatacaaaagatgaaatcttagaaagatacttaaatgaaatatactttggttcaggttcttatggtataagaaatgcggcagaacaatattttaaaaaagatgttaaagacttaaatattgctgaggctgctttacttgctggaattccgaatagacctacaaaatatgacccgaatagaaatttagaaaatgctttatataggcaaaaaattattttaaaagaaatgtatactgatggaagaattacaaaagagcaatatgatgaagccttagcatataaatttgaattagaaaatgaagagaacataaaaaatgttcctaaaaatacttcaattatttataataaaagaactaaaaatacatataaaaatcctgaacttacaacaatagttgaagattacttggcagaaatttatgatgaagaacaaatctatacttctggattaaagatttatacaactattgacttagaatatcaaaaagtagctaaggaaacttttaatagctatccatattttaaaaataaagaaataaatggagctatgattactttagacccatttactggtggaatagtatcaatagttggtggaaagaattttaaagctggtaactttgatagagcaactatggcaagaagacaattaggatcatcatttaaaccatttgtatatttagaagctttacaaaatggttttgacccttattctgttgtagtaaatgattttgttgcttttggaaaatgggcacctaaaaactttgatggtagatatacatataacagtacacttgtaaattcattaaatttatctttaaatgtcccagcagtaaaattattagatgctgtaactgttgaggcttttaaagaagctattggagataatgtaaaattaacatctgaggttaaggatttgactgctgcacttggttcagttgatagtactcctgtaaatgttgcagctaatttctctatctttgtaaatggtggttacatagtaaaacctaatatcataagagaaattagagataatcaagatatacttatctatgttgcagaaatagagaaaacaaaagcttttgatagtgttgatgtaagtgttataactgctatgttaaaaacagttgtaagtaatggtactgcatcaaaagcaagagttgttgataaaacaggtaaacctatacaacaaggtggaaaaacaggaacaacaaacgaacatagaacagcttggtttgttggaattactcctgaatatgtaactgcttgttatattggtagagatgataataaacctatgtatggtaaagcaactggaggaagtgctgttgcacctatgtgggctaagtattatcaaactttaataaataaaggattatatacaccaggaaaatttgaattcttagaaaactatttagaaactggtgacttagtaaaacaaaatattgatatctattctggtttattagatggacctaatagtaaagaatttactgttagaaaaggtagacttcaagttgaaagtgctggtaaatataaaaatggtattgcctctgtcttcggtttagatggaaatgtaactgatggagcaggtattgatatgtctgaaggaatgataattgatactgaaattgaagaaggtacagttacagaaggaggtactggtgagggaacaactcaaactcttaacacaaatactactacttcaacagaaggaaatattccacctgttcaaaataacacttctaataaagatgaagatagcttgacagatagacttttaggagattaa

SEQ ID NO: 49997 - protein, 731 aa, Fusobacterium nucleatum subsp. nucleatum ATCC 25586
MIGVFAIIIKYRLELPNIQSMVEDYKPQMATIIYDKNNNVVDTLSVESREIAKLENISPYVKEAFLSIEDKQFYSHHGLNFRGITRAIVTTFLKGRPTQGGSSITQQLAKNAFLTPERTFSRKVKEAILTYQIERTYTKDEILERYLNEIYFGSGSYGIRNAAEQYFKKDVKDLNIAEAALLAGIPNRPTKYDPNRNLENALYRQKIILKEMYTDGRITKEQYDEALAYKFELENEENIKNVPKNTSIIYNKRTKNTYKNPELTTIVEDYLAEIYDEEQIYTSGLKIYTTIDLEYQKVAKETFNSYPYFKNKEINGAMITLDPFTGGIVSIVGGKNFKAGNFDRATMARRQLGSSFKPFVYLEALQNGFDPYSVVVNDFVAFGKWAPKNFDGRYTYNSTLVNSLNLSLNVPAVKLLDAVTVEAFKEAIGDNVKLTSEVKDLTAALGSVDSTPVNVAANFSIFVNGGYIVKPNIIREIRDNQDILIYVAEIEKTKAFDSVDVSVITAMLKTVVSNGTASKARVVDKTGKPIQQGGKTGTTNEHRTAWFVGITPEYVTACYIGRDDNKPMYGKATGGSAVAPMWAKYYQTLINKGLYTPGKFEFLENYLETGDLVKQNIDIYSGLLDGPNSKEFTVRKGRLQVESAGKYKNGIASVFGLDGNVTDGAGIDMSEGMIIDTEIEEGTVTEGGTGEGTTQTLNTNTTTSTEGNIPPVQNNTSNKDEDSLTDRLLGD

SEQ ID NO: 49998 - DNA, 2532 bp, Thermoanaerobacter tengcongensis MB4
  CDS (1)..(2532)
atggacaaaaatagcgatttaaacctaaaaagaagccggcgaaaaaagaatagtgaaaaaaagaaaaaaagctccattaagctttttttcaaatgggttggaattgcttttctcattctgttttttgcagcggttggggcaatcggcggaaaagtcttggctataattaaaaatactcctccaatttctcaggaagctttgacgtctcaggcgcagtcttctgttgtttatgcaaaagacgaaaatggtaactggcagagagtagcaatacttcatggtgctgataacaggctgtgggttccaatagagaaaatacccaagaatttgcaaaatgcttttgtggcaatagaggaccagcgtttttataagaacaaactaggaattgacccaaagagaattattggagctcttattgcagatattatggcgggaggaaagcctgtagagggagccagtactattacacagcaacttgtgaaaaacaccatgctgtccagtgaaaaaactattactagaaaaatacaggaaatggttttggcttggagattggagcagatatattcaaagcaacagatactggaagcttatcttaataccatctatttaggcggtcccaatgtgaatgcctatggtgtccaggcagcttctttagcttattttggcaaagatgtgagccagttagaccttgcggaatgtgctatgattgcgggaattacaaagaatccatcccgttattctccttatgctgatctagaagccgctacagaaaggcagcatttagtgttaaagaaaatgctggaacaaggctatataacaaaagaagagtatgaaaaggcaatctcagaaaaattggttttcaagaaaaccaattttaccacttatgagcataaatactttattgaccaagttataaatgatgtggcagatgctttgtctcagcaccttaacatttcccacgatgaggcaataaagaaaatatacaacgggggtttgagaatttattctactatggatttgcaaatacaaaaaacaatggaagaagcttttaaaaatccaaaattgttccctcctgatataaaggatagaagtgggaatacgagaatagttcaaggtgcaatggtagtaatggactggaagactggcgaggtaaagggaattgtaggaggcagggaaacagaagagactaaaggtaagacaaggatatttaactatgcaacacaaggtggaagaccagctggttcttctataaaacctcttacagtttacggacctgctttagagaaaggttatacggcagctactgttgtggatgatgtccctgttttttataaacaatggaactgggagccccataactacgaaagcgggaagtacagagggcttatgacctttagagaggctttaacttattccgaaaatgttcctgcggcgaggatagttgtagaaatgattggacttcatactgcagcggaatatggaaagaaatttggacttactgtaacaaaagatgttgcctcttctcctgctgctcttgcattaggagcgggaggcgcagttacacccttacaggaagctgcagcttacggtgccattgccaatggaggagtatatactactcctatcacttttacaaaagtcactgattcaaaaggaaaagtaattttggaaaacaagccttcacagcatatggtcttaacgccacagaacgcatacattttaacaagtatgatgcaggacgtagtgaaatacgggacaggtacaaatgcaaggttgcctaatatgccggtggcaggtaaaacaggtacaaatgaaagttacaacgatgcatggtttacaggctttactccttactacgttgggtctgtgtggatgggtacaggggaaaacattcctatgatatatggagggaggggagttgtaggaggctcctatccagccatgctatggagaacagtcatggcagagatacacaaaagcttgccttacaaagattttgaaagacctccaggtattatttctgtgacagtgtgcaaagattctggggagcttccaactgacctgtgccatcaagacctgagaggcgacagaacctatactgaaatttttgcagaaggcacgcaacccactacctactgtactgtccatgtgctggcaaaaattaattcacaaaatggcaaattggcgacagaatttactccaccagatttagttaaagaggctgtgttcattgaccctccaggcaggactcctgagcaaaatgctgtggcgctagacggcaaatatgtggtgccaaaggattatgacgacacacctccaccagcacaaccaccgtcgggagaagtgttgccgccagagaatacgcaaaatccaccatctcagcctccgaatgagatacaacagcctcccgggaatactcctcccaataatggagggaataacggtactacacagaatccgcctcagaataacaacaataatacgtcaagtaaccctctggaaaagatctttcctcctaaaaatagcaagccttga

SEQ ID NO: 49999 - protein, 843 aa, Thermoanaerobacter tengcongensis MB4
MDKNSDLNLKRSRRKKNSEKKKKSSIKLFFKWVGIAFLILFFAAVGAIGGKVLAIIKNTPPISQEALTSQAQSSVVYAKDENGNWQRVAILHGADNRLWVPIEKIPKNLQNAFVAIEDQRFYKNKLGIDPKRIIGALIADIMAGGKPVEGASTITQQLVKNTMLSSEKTITRKIQEMVLAWRLEQIYSKQQILEAYLNTIYLGGPNVNAYGVQAASLAYFGKDVSQLDLAECAMIAGITKNPSRYSPYADLEAATERQHLVLKKMLEQGYITKEEYEKAISEKLVFKKTNFTTYEHKYFIDQVINDVADALSQHLNISHDEAIKKIYNGGLRIYSTMDLQIQKTMEEAFKNPKLFPPDIKDRSGNTRIVQGAMVVMDWKTGEVKGIVGGRETEETKGKTRIFNYATQGGRPAGSSIKPLTVYGPALEKGYTAATVVDDVPVFYKQWNWEPHNYESGKYRGLMTFREALTYSENVPAARIVVEMIGLHTAAEYGKKFGLTVTKDVASSPAALALGAGGAVTPLQEAAAYGAIANGGVYTTPITFTKVTDSKGKVILENKPSQHMVLTPQNAYILTSMMQDVVKYGTGTNARLPNMPVAGKTGTNESYNDAWFTGFTPYYVGSVWMGTGENIPMIYGGRGVVGGSYPAMLWRTVMAEIHKSLPYKDFERPPGIISVTVCKDSGELPTDLCHQDLRGDRTYTEIFAEGTQPTTYCTVHVLAKINSQNGKLATEFTPPDLVKEAVFIDPPGRTPEQNAVALDGKYVVPKDYDDTPPPAQPPSGEVLPPENTQNPPSQPPNEIQQPPGNTPPNNGGNNGTTQNPPQNNNNNTSSNPLEKIFPPKNSKP

SEQ ID NO: 50000 - DNA, 2388 bp, Streptomyces coelicolor A3(2)
  CDS (1)..(2388)
atgatcgactacccgcgccacaacaaggacgggtggcagcgctgggtgccctcctggaggctcgtctccgggctgtgcatcgcgttcttcggctgcctggtcggcgccgccggcatcgcgtacgccatggtgagcgttcccgtcatcgacgagagtgccaccgcgcagaacaacgtctactactgggccgacaacacccagatggtggccacgggcggtgaccgcaaccgccagagcgtcaatctctcgcagattcccaaggcgatgcgctatgccgtcatctcgcaggagaacaagacgttctactccgacagcggcatcgatcccaagggcatcgcccgcgccgtgttcaacatggccaagggcggggacacccagggtggctccaccatcacccagcagtacgtcaagaacgcgatgctgaacgaccagtcgcagacgatctcccgcaaggtcaaggagatcttcgtctcgatcaaggtcggagccgaggagccgaaggacaagatcctcgagggctacctcaactccgcctactacggccgcggtgcctacggcatccaggcggccgcccgggcgtacttcaacgtcgacgccgtcgacctcaacccgggacagtgcgccttcctgtcggcggtgctcaagggcgccacctactacgacccggcgggctcgatcgcgatcgacccggcggccacgcccgacgccaacaagaagcgggcccagtcccagatgcaggacaccctcgacaagatggtggagtacgggcatctgagccaggcggatcgggccaagtacaccgagctccccaccacgcagaacccgcagtcgaacgcgaagctgggcggccagatcggctacctcgtcaggctcgccaaggcctccgtggtcaggagcggcgcggtgacggagcagcagctggagaagggcggctactcgatctacacgaccttcgacaagaagaaggtcgacgagatggagaaggcggtccagaaggtctacaaggagaagatcgaccccaagaagcggcccgagaaggacacgcacgtccagttcggcggggcgtccatcgacaccaggaccggggccatcaaggccatctacggtggccaggacgccaccaagcacttcaccaacaacgccgacgtgaccggtgcccaggtcggttcgacgttcaagccgttcgtgctcgcggccgcgatgaagtggggcgtgcgcgacccggacctcggcccggtccaggcccaggacgagcgcaccgtcgtctcccccaagagcctctacagcggcaagaacgacctgaagatcaataactatgacgggtcgatctgggagaacgagaagggggagcagtggcgtcaggagaacgacggtcaggacaacgtcggtgacccgccggactacatgatcgaccttcgtgaggcgatgcgggagtcggtgaactccgccttcgtgcagctcggcatggacgtcggtctggacaaggtgaaggagtccgccgaagacgcgggactcctggaggacagcctggccggcgccggctacccgtccttctccatcggtgtctcggaccccagcgccatccgcatggcgggcgcgtacgccaccttcgccgacagcggcaagcagcgcgagccgtactccgtcacgaaggtgacgaacaaggacggcacgctctacacgcacaaggtcgaggagaagcaggcgtacacggccaaggtcgcggacaacgtgacggacgtcctgaagaccgtcgtcgagaagggaacgggctccaacgcccagttgcccggccgtgaggtggccggcaagaccggtaccaccgacggcaacaagtccgcctggttcgtcggctacaccccgcagctgtcgacggcgatcagcatgtaccgctacccggacgacgagtccatcaaggaccgaacgttcctggagatgttcgggaccggtggcgagaagaagatccacggtgcctccttcccgtccacgatctggcaggactacatgtccgatgcggtcaagggcatgaaggtggagaagttcccgaagccggagcccatcggtgaggtcatcaacgacgccccgtcgccgactccgactccctccccctctccgtccgcttccgagaccgaggaagtcagcccgtcgccgtccccgtcgcccagcgacacgcagaccagcccctcgcctcccgcgccgaccgagtcctgcgatttctgggacatcaactgcggcaacgggaacaacggcggcaacgccaacggaggcaatgggccgggcggttccgaggggagtgaatcgccttctccctcggccaccgcgacagaaggagagggcgacggcggcggaaacacgcgtggaaacaccatctggggcacgaacggctag

SEQ ID NO: 50001 - protein, 795 aa, Streptomyces coelicolor A3(2)
MIDYPRHNKDGWQRWVPSWRLVSGLCIAFFGCLVGAAGIAYAMVSVPVIDESATAQNNVYYWADNTQMVATGGDRNRQSVNLSQIPKAMRYAVISQENKTFYSDSGIDPKGIARAVFNMAKGGDTQGGSTITQQYVKNAMLNDQSQTISRKVKEIFVSIKVGAEEPKDKILEGYLNSAYYGRGAYGIQAAARAYFNVDAVDLNPGQCAFLSAVLKGATYYDPAGSIAIDPAATPDANKKRAQSQMQDTLDKMVEYGHLSQADRAKYTELPTTQNPQSNAKLGGQIGYLVRLAKASVVRSGAVTEQQLEKGGYSIYTTFDKKKVDEMEKAVQKVYKEKIDPKKRPEKDTHVQFGGASIDTRTGAIKAIYGGQDATKHFTNNADVTGAQVGSTFKPFVLAAAMKWGVRDPDLGPVQAQDERTVVSPKSLYSGKNDLKINNYDGSIWENEKGEQWRQENDGQDNVGDPPDYMIDLREAMRESVNSAFVQLGMDVGLDKVKESAEDAGLLEDSLAGAGYPSFSIGVSDPSAIRMAGAYATFADSGKQREPYSVTKVTNKDGTLYTHKVEEKQAYTAKVADNVTDVLKTVVEKGTGSNAQLPGREVAGKTGTTDGNKSAWFVGYTPQLSTAISMYRYPDDESIKDRTFLEMFGTGGEKKIHGASFPSTIWQDYMSDAVKGMKVEKFPKPEPIGEVINDAPSPTPTPSPSPSASETEEVSPSPSPSPSDTQTSPSPPAPTESCDFWDINCGNGNNGGNANGGNGPGGSEGSESPSPSATATEGEGDGGGNTRGNTIWGTNG

SEQ ID NO: 50002 - DNA, 2151 bp, Streptomyces coelicolor A3(2)
  CDS (1)..(2151)
atgggcgccttcatcgtgctgtacatgatgatcgacatccccgagggcaaccccgaggccgatctgcagagcaacgtctacaagtacagcgacggcagcatcatggcgcgcacgggcgagcgcaaccgcgagatcgtcgacctcgccaagatccccaaggacgtccagcgcaccttcgtcgccgccgagaacaagaccttctacaacgacgccggcgtcgacctcaagggcaccgcgcgcggcgtgctcaacaccctctccggcaagggcgcgcagggcggttcgacgatcacccagcagtacgtcaagaactactacctgacccaggaacagacggtctcgcgcaagctgaaggaactggtcatctccctcaagctggaccgggagaagtccaaggactacatcctcgccggctacatcaacaccagctactacggccgcggcgcctacggcatccaggccgccgcacaggcctactaccgcgtcgacgccgaggacctgacggtcgaacagggcgcgtacctctccgcgctgctccaggcgccgaaccagtacgactgggcgatcgccagcgagaccggcaagaagctcgtccagcagcgctggaactacgtcctggacaacatggtcgagcagaagtggctcggcgcgggcgaccgccagggcatgaagttcccggagcccaaggaacccaaggccgccgcgggcaaggagggccaggtcggctacctggtcgacgcggccgaccacgcgctcaagaagcagctcgtcgcccagggcgccgccgaggacatggagcaggccaaggccctggtggacctcggcggctacaccgtcaccctcaacatcgacaagaagaagcaggccgcgctggaggcggcggtcaagaagcagctcacgagcaagctggaccccgacgagcgcaaggtcgacgccgacgtccaggccggagccgcctccgtcgacccgaagaccggctccgtcgtggcgatgtacggcggcgtgaactacctgaagcacttcaccaacaacgccacccgcgacgactaccagcccgcctccaccttcaagccggtcatcctcgccgccgccgtggaccacgacgccgagacccaggacggcgtgccgatcacggccaacaccctctacgacggcgacagcgagcgccccgtgatggacggcgacaagaaggtcggcttcgcaccgcccaacgaggacgaccacgactacggcgagatcgacgtccaggaggcgatgaacaagtccgtcaactccgtcttcgcccagatgggcatcgacgtcggcatgcccgaggtcatgaaggtcgccgccgacctcggcatggacaccgagggcgagcaggccgtgcccgcgcagaccctgggcagtatgggcgccagcccgctggagatggcaggcgtctacgccaccttcgacaaccacggcaagaaggtcaccccggcgatcgtgaagtcggtcgagcacaaggaccgcaaggtcgagatgcccgacccgatcggcgagcaggtcatcagccgggaggccgccgacacggtgacctcggtgctcaccggcgtggtcaacgacggtacggccaagaagtccgtccgggagaacccgctgcgcgacggccagaaggtggccggcaagaccggtacgtccgacaacaacaagtccgcctggttcagcggcttcacccccggcctcgtcacctccgtcggcctgttcggcgaggacgacgagccgccgcacaagcaggtcccgatgtacaaggcggccggggtcgactaccgcgtcaacggtggtggcccgccggcggagatctgggccgcgtacaccttcggcgtcatggacgaggtcaccgagttcgacctggagaccaagcagggcgccgcggtgcggccgagcaagtcgccgacggcccccgagtcgccgaccaagtcgccgacgcgggaggagacctccgaggcgccgccgccgtccagcgacccgacgaccgaggcgccgccgtcaagcgacccgacgaccgaggaaccgccggagtcgccgacgaactcgccgtcgaacagcccgtccaccgaaccaccgccggacggcgggtccaccgagtcgggggacccggagctccccggcgtggactgggggcagtag

SEQ ID NO: 50003 - protein, 716 aa, Streptomyces coelicolor A3(2)
MGAFIVLYMMIDIPEGNPEADLQSNVYKYSDGSIMARTGERNREIVDLAKIPKDVQRTFVAAENKTFYNDAGVDLKGTARGVLNTLSGKGAQGGSTITQQYVKNYYLTQEQTVSRKLKELVISLKLDREKSKDYILAGYINTSYYGRGAYGIQAAAQAYYRVDAEDLTVEQGAYLSALLQAPNQYDWAIASETGKKLVQQRWNYVLDNMVEQKWLGAGDRQGMKFPEPKEPKAAAGKEGQVGYLVDAADHALKKQLVAQGAAEDMEQAKALVDLGGYTVTLNIDKKKQAALEAAVKKQLTSKLDPDERKVDADVQAGAASVDPKTGSVVAMYGGVNYLKHFTNNATRDDYQPASTFKPVILAAAVDHDAETQDGVPITANTLYDGDSERPVMDGDKKVGFAPPNEDDHDYGEIDVQEAMNKSVNSVFAQMGIDVGMPEVMKVAADLGMDTEGEQAVPAQTLGSMGASPLEMAGVYATFDNHGKKVTPAIVKSVEHKDRKVEMPDPIGEQVISREAADTVTSVLTGVVNDGTAKKSVRENPLRDGQKVAGKTGTSDNNKSAWFSGFTPGLVTSVGLFGEDDEPPHKQVPMYKAAGVDYRVNGGGPPAEIWAAYTFGVMDEVTEFDLETKQGAAVRPSKSPTAPESPTKSPTREETSEAPPPSSDPTTEAPPSSDPTTEEPPESPTNSPSNSPSTEPPPDGGSTESGDPELPGVDWGQ

SEQ ID NO: 50004 - DNA, 2463 bp, Bacillus anthracis str. A2012
  CDS (1)..(2463)
atgtcagaaaattatcgttctcgagaggagcgacgacaagttaaaaagaaaaaacagccagcttctaaaacacaaaaaccaaaaggtaaaacatcgttctttcgcaagtttttaattacttgtttattacttggtattgttggtttagtggggggagttgctacctttttcgtaatgattaaggatgcaccaaaacttgagaaagcaaaacttgttaatccgttatcctcaaaaatttatgataaaaatggcgatttggtatatgaatacgggaaagaaaaacggacgaatgttacgtatgatcaaattcctaaattagtagaaaatgcatttttagcaacagaagatgcacgtttttacgagcatagcggagtagactttaaaggtactgcccgtgctgttttggtgagtcttaaaggcgattacggttcacaaggtggaagtacgataacacagcaggttattaaaaattacttcttatcgatggaaaaaacatcaaaacgtaagattcaagaaatatatttagcgtataagctagaacaacagtattcaaaacatgaaattttagaaatgtatttaaataaaattaatttaggtaatcgttcatatggtatcgcaacagcagcacaaaactactacggtaaagaattaaaagagttaactttaccagaagttgcgatgcttgcaggtttaccaaaagcaccgaataactatgatccaacgaagacagaaaatgttcaaagagcaacagaaagaagaaatgttgtcctaaaattaatgaatcgacatggttatattacgaaggcagaaatggaagaagcttcgaaagttgaagtaacagatggacttaagactgcaactgtacaagcaatgccatatcctgcatttatggatgcggttgtgaaagaagttgaaaaagaattgccagatgctaatattggttctgacggtttagaaatttatacaacattagacatagacgcacagaaggctgccgacaggatattagatgctaatattattaattatccaaatgataaattccaaagtgctttcacatttatggatacgaaaacaggagaagttcgtgctataggtagtggacgtggtgaaaataaagcagtatttaaagggcataatatggcaattgaattagatcgtgcagctggttcaactatgaagccaatctttgattacggtcctgcaattgaatacttaaaatgggctacgtatcatcaaattgatgattctccatttaaatattcaactggacaagaagttcgaaatgcggacagaagtcatttaggatcaattacgatgcgtgaagcattaaaaatgtcacgtaacgttccggcagttaaagctgcaaaagaagtaggacttaataaagcgaaggaattctctgagaaattaggtattacacttaagtcagcaccagaatctacagcgattggtacaaacgaagtatcaccaactgaaatagcgggtgcttatgcgacatttggtaatggtggaaagtatgcaaaaccgcattttgttaagaaagtagtttatccagacggcaagtcacaaagttttggacaaaaaccaaaacaagttatagctgactctacagcatatatgattactgatatgcttcgttcagtagtgacatcaggtactggtacagcagcaaatataagttctttagatgtagctggaaaaacaggtacaacaaactatgattcaaaacaattagcgaaatttaatattccggaaagtgcaactcgtgatagttggtttgcaggttatacgccgcaatatacgatggcagtatggactgggtatatgaaagatggtaaggacgagtatattagtagtaaaaatacgaaaattgcacagttgatctttaaagaaatgatgagcgagatggctacagataaatcaagatttaaaatgccaagtagtgtaattcaagaaggtagtgagctgcgtataaaaggtgaaaaacgtgattcttctccaaatacgagcgtaccggatacaacagaaaaaccaaaacaagatcaacagcaaaaaactgaagaagagaaaaagcaagaagaattaaaaaaacaagaagaacttaaaaaacaagaagaagaaaagaaacaagaggaactgaagaagcaggaagaacaaaagaaactagaagagcaaaagaaacaagaagaagaaaagaaacaaaatgaacaaaataatggaaacggtcaaggaacgacccctccagcaaataacggaggaggtcaaggaacgacccctccagcaaataacggaggaggtcaaggaaatacgactcctccagcaaataacggaggaggtcaaggaaatacaacccctccagcaaataacggaggaggtcaaggaaatacaactccaccagcgaccacacaaccggagactggcggtaatgcaggagaggcccctgctaataatggtcaataa

SEQ ID NO: 50005 - protein, 820 aa, Bacillus anthracis str. A2012
MSENYRSREERRQVKKKKQPASKTQKPKGKTSFFRKFLITCLLLGIVGLVGGVATFFVMIKDAPKLEKAKLVNPLSSKIYDKNGDLVYEYGKEKRTNVTYDQIPKLVENAFLATEDARFYEHSGVDFKGTARAVLVSLKGDYGSQGGSTITQQVIKNYFLSMEKTSKRKIQEIYLAYKLEQQYSKHEILEMYLNKINLGNRSYGIATAAQNYYGKELKELTLPEVAMLAGLPKAPNNYDPTKTENVQRATERRNVVLKLMNRHGYITKAEMEEASKVEVTDGLKTATVQAMPYPAFMDAVVKEVEKELPDANIGSDGLEIYTTLDIDAQKAADRILDANIINYPNDKFQSAFTFMDTKTGEVRAIGSGRGENKAVFKGHNMAIELDRAAGSTMKPIFDYGPAIEYLKWATYHQIDDSPFKYSTGQEVRNADRSHLGSITMREALKMSRNVPAVKAAKEVGLNKAKEFSEKLGITLKSAPESTAIGTNEVSPTEIAGAYATFGNGGKYAKPHFVKKVVYPDGKSQSFGQKPKQVIADSTAYMITDMLRSVVTSGTGTAANISSLDVAGKTGTTNYDSKQLAKFNIPESATRDSWFAGYTPQYTMAVWTGYMKDGKDEYISSKNTKIAQLIFKEMMSEMATDKSRFKMPSSVIQEGSELRIKGEKRDSSPNTSVPDTTEKPKQDQQQKTEEEKKQEELKKQEELKKQEEEKKQEELKKQEEQKKLEEQKKQEEEKKQNEQNNGNGQGTTPPANNGGGQGTTPPANNGGGQGNTTPPANNGGGQGNTTPPANNGGGQGNTTPPATTQPETGGNAGEAPANNGQ

SEQ ID NO: 50006 - DNA, 1932 bp, Thermosynechococcus elongatus BP-1
  CDS (1)..(1932)
gtgtccaccactacccttggcaaacacccctcccaaactcgcccccaacatgaaaacttctggcgtggggtactgcgaattgctaaccgcaccttcctcgtggggatgacctttgggagtgcggctattgggggcagcctgttgggcctagcgattagctttcggaatctgccggatgtgcgatcgctacggggctatgtccccagtgaaaccacccacatttacgatgccaagggcacactccttgtgagccttcacgatgaagaaaaccgcgaagtcgttcccctcaacgaaatctcgcccaatttgaagctggccgtgctggcgatcgaagacagcagtttctaccagcatcgcggtattaatcccattggtattgcccgtgccttgatggtcaacctcacctctgggcgtactgtgcagggcggctctaccctgacgatgcaattggtcaaaaatctctttttgtctcgcgatcgctccctgagccgtaaagtggctgaggccgttttggccatgcgcctcgagcagatcttcaacaaagacgaaattttagagatgtacctcaatcaggtctattggggacacaacacctacggtgtgcaaactgcagcccaaagctacttcaaaaaaaatgctgcagatctcacgcttgctgaagccgccatgatggctgggattattcaagctccagaagcctatagcccctttgtggattttgatctcgccaaggaacggcagcaattggtcctggatcggatggtggagttgcattggattaccccccaagaggctgctgccgctgcccaagaacccatcaagctgggggaaattacctccttccagcgcagtcgtagcccttggataaccgatgctgtgttgcaggaattgacccgccaatttggccgtgaagcagtcattcgtggtggcatgcgggtgcaaagcagccttgatctcaaaatgcaaacaatggcggaagaggccatccgacggggatatgacagcctacaagccagtggcgtgcgcgcagatcagttagctttagctgctgtggatccgcgtacccactatgtcaaagcactggtggggggagtggactacagccgcagtcaatttaatcgagccacccaagccctgcgccagccggggtctgcttttaagccctttgtctactatgccgcctatgccagtggcaaatatacccctgagtcagtcattagcgactcgccagtgcagtatcgggatggggacggatggtatgtgcctcgcaactacgatggctcatttatgggtgggatgtctatgcgcatggccttggccatgtcccgcaatattcccgcgattgtccttggccaagaggtgggcattgagcgcgtaattgaaatttgccgcacccttggcatcaccagtcccatgctgccggtggtttccctgcccttgggagcggtggatctcacccccttggaaatggccgctgcctatgccacattcgccaataatggttggcaatctcccacgacaacaattattcaggtcaccgacaacaatggcaatttgctgttggatcacacaccgcgccccaaactcgtgcttgatccttgggccgccgccgctgtaaataacacactgcagagtgtgatcaccagtggtacagggacagcagccaacattggccggcctgccgcaggaaaaacaggcaccacttcttcggagcgggatatttggtttgtgggttatgtgccccaactctcagcggctgtttgggcagggaatgacaactatgcgcccttggggcagggggcaacggggggtggttttatggcacccatttggcgagatttcatgagtcaggcactcaaggatgtgcccgtagaggactttaccccgatgtcgaagttccagcggcccaagccgccgcggccaaaaaattaa

SEQ ID NO: 50007 - protein, 643 aa, Thermosynechococcus elongatus BP-1
MSTTTLGKHPSQTRPQHENFWRGVLRIANRTFLVGMTFGSAAIGGSLLGLAISFRNLPDVRSLRGYVPSETTHIYDAKGTLLVSLHDEENREVVPLNEISPNLKLAVLAIEDSSFYQHRGINPIGIARALMVNLTSGRTVQGGSTLTMQLVKNLFLSRDRSLSRKVAEAVLAMRLEQIFNKDEILEMYLNQVYWGHNTYGVQTAAQSYFKKNAADLTLAEAAMMAGIIQAPEAYSPFVDFDLAKERQQLVLDRMVELHWITPQEAAAAAQEPIKLGEITSFQRSRSPWITDAVLQELTRQFGREAVIRGGMRVQSSLDLKMQTMAEEAIRRGYDSLQASGVRADQLALAAVDPRTHYVKALVGGVDYSRSQFNRATQALRQPGSAFKPFVYYAAYASGKYTPESVISDSPVQYRDGDGWYVPRNYDGSFMGGMSMRMALAMSRNIPAIVLGQEVGIERVIEICRTLGITSPMLPVVSLPLGAVDLTPLEMAAAYATFANNGWQSPTTTIIQVTDNNGNLLLDHTPRPKLVLDPWAAAAVNNTLQSVITSGTGTAANIGRPAAGKTGTTSSERDIWFVGYVPQLSAAVWAGNDNYAPLGQGATGGGFMAPIWRDFMSQALKDVPVEDFTPMSKFQRPKPPRPKN

SEQ ID NO: 50008 - DNA, 2235 bp, Thermosynechococcus elongatus BP-1
  CDS (1)..(2235)
atgcctaatcctgcccgagatctttggcagtcggtgacccaaaccgtcacccaagcggtgcagacggttcactctcgctttgattggcaacaggtctccctgcgggaaaatgcccgcacccctgaactatgggtggagtaccgaggtcaacggcaagtctttcccttagttggcgatcgctacattcttggccgtagtcagagtcgcgccgacattatgattgacgcggagattgtcagtggcacccatgcccgcctcaagcgactcactcccaccggtgtctttgaaatccaagatctagattccaccaatggcatctatcgccaacggcagcgcctgcaaatgggtgagctgcaccatggcgatgtgatcaccctagggccaccagaggtcaaaggcgccgttaccctccgcttccacaatccaccgccccgctgggtttctcgtctcacctatggcatttggggggtcatgggtctcagtgcccttgggattgccttagtgagcattgaggccaacaaagtggcggtgcgtcccctacctcccctggagcaaggtcccattattctccgcgatcgccagggggaactgatcaatccccttgaagatcgcccccaccgtgaactcaagacgctcaatgatttttccccctacttggttcatggggttctggcctctgaggatgttcgctactattggcactttggtgtcgatcccatgggcatggcgcgggcaatggtcaccaatgtactcacggggcaaacccgcgaaggggccagtaccctctgccagcaactggcacgtaccctctttcgctcccaagtcggcacggaggatagtttaggccgcaaatggcgagaaatggcggttgccctgaaattggaatttttctacagcaaagatgagttgcttttggcctacctgaaccgtgtctatttgggcatgggcaatcgcggctttgaagatgcggctcaattctactttgataagtccgccaaagacctgacgctgaatgaggcggccacgctggtggggattctgcctgcacccaaccgttttaatccggtgcgcgactacgatgcggcggtggattatcgcaatcgggtcattttgcgcatggtgcagcagggctacatcagcaaggaagagggcgatcgcgcccggcgctcccggattgaaattagccccaaggcgcgcaaattccttagtgcccaacgctttccctactacacggatcatgtctatcaggagcttgcccaactcctgggggatgaactggctcacgagggcaacctcattgtcgaaactggcctcgacccccgctggcaagaactggccgaaaccagtctgcgcaatttcatcagtagcacaggtagtgcctatggggtgcagcaaggagccttaatgaccctccagcccagcagtggtctcattcgtgcccttgtggggggtgtcgactaccaaaaaagccagtttaatcgtgccaccctggccctgcgccagcccggttcgaccttcaaggtgtttgtctacaccgaagcactcatcaaaggacacaccgccggcgaagtgttttcctgtgcccccgttttctggcagggacaacaattcgaggggtgtcgtggcgggggtggcgctatggatctcgccacgggcttggcgctttctgaaaatcctattgccttacgccttgcccaagccgttggtttagaagctattatccgcttggccagagcaatgggaattacgacaccgctgcaagctgtgcccggccttgtccttggtcaaagtgaggtaacccttctggaaatgagtggggcctttgccgtgctcgccaatggggggcagcgcattccgccccatgccattctcgcagttcgcgatggcggcgattgcagccaacccaatgactggcaaacctgtcgcctcatttatgcagccaaggaggaaacgccccaacaagttctcgatcctgcgatcgctaacgaaatgacgatcctcttgagtgcggttgtcagtcgcggcactgggcgtgctgccgccattggtcgccctgttgctggcaaaaccggcacgacgaatgatggccgcgatctctggtttattggttacgtgcccaccgccgatgtcctcaccggtatttggctaggcaatgatgacaatagccccacccaaggtagtagtgggctggcggcggccctttggggtgagtatatgggacgcgccctaaattag

SEQ ID NO: 50009 - protein, 744 aa, Thermosynechococcus elongatus BP-1
MPNPARDLWQSVTQTVTQAVQTVHSRFDWQQVSLRENARTPELWVEYRGQRQVFPLVGDRYILGRSQSRADIMIDAEIVSGTHARLKRLTPTGVFEIQDLDSTNGIYRQRQRLQMGELHHGDVITLGPPEVKGAVTLRFHNPPPRWVSRLTYGIWGVMGLSALGIALVSIEANKVAVRPLPPLEQGPIILRDRQGELINPLEDRPHRELKTLNDFSPYLVHGVLASEDVRYYWHFGVDPMGMARAMVTNVLTGQTREGASTLCQQLARTLFRSQVGTEDSLGRKWREMAVALKLEFFYSKDELLLAYLNRVYLGMGNRGFEDAAQFYFDKSAKDLTLNEAATLVGILPAPNRFNPVRDYDAAVDYRNRVILRMVQQGYISKEEGDRARRSRIEISPKARKFLSAQRFPYYTDHVYQELAQLLGDELAHEGNLIVETGLDPRWQELAETSLRNFISSTGSAYGVQQGALMTLQPSSGLIRALVGGVDYQKSQFNRATLALRQPGSTFKVFVYTEALIKGHTAGEVFSCAPVFWQGQQFEGCRGGGGAMDLATGLALSENPIALRLAQAVGLEAIIRLARAMGITTPLQAVPGLVLGQSEVTLLEMSGAFAVLANGGQRIPPHAILAVRDGGDCSQPNDWQTCRLIYAAKEETPQQVLDPAIANEMTILLSAVVSRGTGRAAAIGRPVAGKTGTTNDGRDLWFIGYVPTADVLTGIWLGNDDNSPTQGSSGLAAALWGEYMGRALN

SEQ ID NO: 50010 - DNA, 2322 bp, Streptococcus agalactiae 2603V/R
  CDS (1)..(2322)
atgaaattatttgataagtttatagacttatttcgtgttgatgaagacaacgacgaaatgacaagaaaaaatgaacaagaaactagagaagaaactagcaatttggatggcgaagaagtctatgatattgatgatattacccgacctagtaaatcccagtatcagcgaggcattcgtcaccaaaaggaaaatgctaaatctcgacctgaatggctacaaaaagttgatcgttacctcccttctcctaaaaatcctatccgtcgtttttggcggcgctatcgtattgggaagttgctttttatcgccttaatggcttttattcttatatttggtagctatcttttttatctttctaaaactgctacagttagtgatttacagagtgctctaaaaacaaccaccaccatttatgataagaataaagaatatgctggaaaactttcgggacaaaagggaacttatgtagagttaaatgctatttctgatcatctcaaaaatgctgttatagcaactgaagatagaactttttatgaaaataatggtgtaaactttaagcgattttttttggcagtagctacacttgggaaatttggcggaggctcaactattacccagcaattagcaaaaaatgcttacttgtcacaggaccaaacgattaaacgcaaggcgcgtgaattctttttagcgctagaattgactaagaaatatagcaaggctgagattctgaccatgtatcttaataactcttattttggtaatggtgtttggggtgtggaagatgctagtaggaaatattttggaaccagtgctgctaatttgacagtagatgaggctgctacacttgctggaatgcttaaaggaccagaagtttataatccttattattctgttgaaaatgcaactaaccgaagagatactgttttggcagcgatggttgatgcaggtaaactaaccaagtctcaagctaaagaagctgcttcaattggtatgaaaaatagattagcagatacctatgctggtaaaattaatgattacaggtacccatcctattttgatgctgttgtcaatgaagccattgatacttatggtatttcagaaaaagatattgtcaataatggctataagatttacactgcattagatcaaaattatcaatcaggaatgcaaaaaacatttgatgatactagcctcttccctgtatctgactatgatggtcaatctgcccaaggtgctagcgtagctttagatccaaaaactggtggtgtaagaggtttagttggacgtgttcaaagtactaaagatgcacagtttagaagttttaactacgcgactcaatcaaagagaagtccagcctcaaccataaaacctttagttgtttattcaccagctattgcttcaggatggtcaatagataaagaacttcctaataaagttcaagattttcatggttataaaccaagtaactatggtgggattgagactgaaagtatcccgatgtatcaagcactagctaattcttataatattcctgctgtttatactttagacaaactaggaatcaataaagcctttacttatggcaggaagtttggtctaaatatgtcatcagcaaacaaagagctaggagtggcgctaggtggaagtgtaaccactaatcctttagaaatggcacaagcttactcaacttttgcaaatgacggtataatgcatcgcgctcatttgattactcgaattgagacagctaatggaaaattagtaaagcaatttacagataagcctaagcgagttattagtcgctcagtggctagtaaaatgactagtatgatgttaggaacattctcaaatggtacagctattaatgccaatgtttatggttatacaatggcaggtaaaactggaacaaccgaaacagattttaaccccaatttatctggagaccagtgggtagtcggctatacgcctgatgtcgttattagtcaatgggttggctttaagaacacagataaacaccattatttgacagattctagtgcaggtacagcttcaaatatatttagcacgcaagcttcatatatactaccgtatactaaggggtctagttttactcatattgagaatgcttatttccaaaacggtattggttcagtttataatgcacaagatgctagtaatacaacgaaccaagaatcacgctcaattattaatgatttaaaagattcggcaagtaaggctgcacaagatatttctagagcggtggaagattcaaatttccaagagaaggtaaaagatgcttggaatagtctaaaggactactttagatag

SEQ ID NO: 50011 - protein, 773 aa, Streptococcus agalactiae 2603V/R
MKLFDKFIDLFRVDEDNDEMTRKNEQETREETSNLDGEEVYDIDDITRPSKSQYQRGIRHQKENAKSRPEWLQKVDRYLPSPKNPIRRFWRRYRIGKLLFIALMAFILIFGSYLFYLSKTATVSDLQSALKTTTTIYDKNKEYAGKLSGQKGTYVELNAISDHLKNAVIATEDRTFYENNGVNFKRFFLAVATLGKFGGGSTITQQLAKNAYLSQDQTIKRKAREFFLALELTKKYSKAEILTMYLNNSYFGNGVWGVEDASRKYFGTSAANLTVDEAATLAGMLKGPEVYNPYYSVENATNRRDTVLAAMVDAGKLTKSQAKEAASIGMKNRLADTYAGKINDYRYPSYFDAVVNEAIDTYGISEKDIVNNGYKIYTALDQNYQSGMQKTFDDTSLFPVSDYDGQSAQGASVALDPKTGGVRGLVGRVQSTKDAQFRSFNYATQSKRSPASTIKPLVVYSPAIASGWSIDKELPNKVQDFHGYKPSNYGGIETESIPMYQALANSYNIPAVYTLDKLGINKAFTYGRKFGLNMSSANKELGVALGGSVTTNPLEMAQAYSTFANDGIMHRAHLITRIETANGKLVKQFTDKPKRVISRSVASKMTSMMLGTFSNGTAINANVYGYTMAGKTGTTETDFNPNLSGDQWVVGYTPDVVISQWVGFKNTDKHHYLTDSSAGTASNIFSTQASYILPYTKGSSFTHIENAYFQNGIGSVYNAQDASNTTNQESRSIINDLKDSASKAAQDISRAVEDSNFQEKVKDAWNSLKDYFR

SEQ ID NO: 50012 - DNA, 2172 bp, Oceanobacillus iheyensis HTE831
  CDS (1)..(2172)
atgagaatggaaaagcgtaagcaaaataagttagcttacaaaaagaaaactcaatggtttttcattgcaattgcctctctttttatattactacttcttggatatggtgtcgttttattaggtggaaaaattatagcaaatgatgaagaattgattctcgatttaaaaacgacaatacgaacagaagaaggagaagtaattgggacattatataaagaaaatagggagtttacaaatctagacagtctaccagatcatgtgaaagaagcttttatcgcgattgaagacaggcgtttttatgaacatcaaggaattgatcttaaatcaattagcagagctgtataccgtgatattattgcgatgagcaaagttgaaggtggaagtacgattacacaacaacttgctaaaaatttatttttgagcaatgacaaaacatggtcgaggaaaataaaagagacaatggcagccttatatttagaaagggaattatcaaaggatgaaattcttgagttatatgtgaatgaagtttacttcggtcaaggtatttatggtattcaaactgcctcaaagtatttcttttccaaatcagctgatgaattaactgtagctgaaggagcaatgcttgcaggattaatgaaaggtccaaacgggtattctcccattaatcatccagatcgtgcgctagaacgaaggaatgttgttttacattcaatggaagatgcaggatttttgagtactgaacaacgagttgcggaggaagaaaaaactttaggtattgctgtgcaagaaccgaaagcttctgatccatgggtggatagttatattgatctcgtaatgaaagaggcttcagagaaacatcaactttctgttgaagcactacaaacgggtgggtatgacattactgtttatatggaccctgaaattcaacagattgcatattcagaaatgcaaaacgatgcatatttccctggaaatacggaaggtgtggaaggagcatttgtgatgttagatgctactaatgctcgggttgtttctgcaattggtgggagagattaccaaattggagatttaaatcgaactgtagttaatcgtcaacctggttccacttttaaacctatagctgtatatggacctgcattaatgcagggggatgtatatactcctttcactttgattccagataaaaaatcggaagaatataatgttgtcaatgcaaatgatgagtataaaggtgaaattcctatttatcaagccattatggagtcgaccaatacttcggctgtttggttattggatgagcttggaattgactactcgaagggttatttggaaaaactaggtattagtctcgaggatgatggtttatctatagcattaggtggtcttaagtatggagtaactcctttaaaaatggcgcagagctatcaggcttttgcctccggtggtgatttaacccgagcaacatcgatatccagtattgaaaatcgaaacgaagaagtgatatatgaatcaacgttagagagggaaaatgtatttactagtcaagtcgcttggaatatgacagaaatgttatctgatactgtgctatctggaacggcttcttctggtgagtttactaaagcactcgcaggaaagactggatctacacaacatacaattgtagatggtgctacgaaagatgcttggtttgttggatatactcctgaatatgtaagtgctatgtggatggggtatgatagcacagataaagatcattacttaacaggcggtagttcttatcctacatctttaacaaagaaaattttaaccgaaatagataggcaaacagatcgagaaatgtcgagcagttttgaaatacctgagaatgttgaaccacttccagaaccaattgaattacctacaatttcggatattaccgccaactatgaatttggaggattttcgataatcaaaggaaatcttaattggaatggttcatctgatgaacgtgttgtttatcgtatttatcaagagtcagaaggtgaagataaacttattgatgcagtaaaaggagtaaccgaatatacaattgacaatgtttggtttaaaaacaataaatattacgttgttccttacgatccgaacacaaaaatggaaggaaccaagtcagattctgtgacgtttagttggtaa

SEQ ID NO: 50013 - protein, 723 aa, Oceanobacillus iheyensis HTE831
MRMEKRKQNKLAYKKKTQWFFIAIASLFILLLLGYGVVLLGGKIIANDEELILDLKTTIRTEEGEVIGTLYKENREFTNLDSLPDHVKEAFIAIEDRRFYEHQGIDLKSISRAVYRDIIAMSKVEGGSTITQQLAKNLFLSNDKTWSRKIKETMAALYLERELSKDEILELYVNEVYFGQGIYGIQTASKYFFSKSADELTVAEGAMLAGLMKGPNGYSPINHPDRALERRNVVLHSMEDAGFLSTEQRVAEEEKTLGIAVQEPKASDPWVDSYIDLVMKEASEKHQLSVEALQTGGYDITVYMDPEIQQIAYSEMQNDAYFPGNTEGVEGAFVMLDATNARVVSAIGGRDYQIGDLNRTVVNRQPGSTFKPIAVYGPALMQGDVYTPFTLIPDKKSEEYNVVNANDEYKGEIPIYQAIMESTNTSAVWLLDELGIDYSKGYLEKLGISLEDDGLSIALGGLKYGVTPLKMAQSYQAFASGGDLTRATSISSIENRNEEVIYESTLERENVFTSQVAWNMTEMLSDTVLSGTASSGEFTKALAGKTGSTQHTIVDGATKDAWFVGYTPEYVSAMWMGYDSTDKDHYLTGGSSYPTSLTKKILTEIDRQTDREMSSSFEIPENVEPLPEPIELPTISDITANYEFGGFSIIKGNLNWNGSSDERVVYRIYQESEGEDKLIDAVKGVTEYTIDNVWFKNNKYYVVPYDPNTKMEGTKSDSVTFSW

SEQ ID NO: 50014 - DNA, 2778 bp, Oceanobacillus iheyensis HTE831
  CDS (1)..(2778)
atggcagagaataaaggccaaagtagaacagcaagaagacaacaacagaagaaatcaaagaaatcaagaaaatcgaataaaccaacttggaaaaaggttttaaaaatatttttaatcattatgttagcaatgttagtcattggtattggagttggtgcatattggattgctactgccccagacattgacgaagaaaaacttaccgttcctttctcttctacattattagataagaatggggaacaatttgcagaacttagtgcagaagaacgtagaacgcaagtgacatatgaggatcttccagatgtgctaatcgatgcagtaacagctacggaagacgctaggttttttgatcatgctggtgtcgatccacgaagagttggcggagcaatacttgcaaacgttacggatggatttggttcccaaggtgctagtacaatcacacaacaggtggttgaacgagcattcttaacaccagataagaaagtaagtataaaagtacaagaaatgtggttagctcttaagttagagcgcgaatatacaaaagaagaaattatggaaatgtatttaaatagtattttctatggctcacaagcttatggtgttgcaaacgctgcggaaacctattttggtaaaacagatcttaatgatttaactttacctgaagccgcaatattagcaggattgccgcaacgcccttcggcttataatccgtatgaaaacccagaactcacaaaagaacgaatgaataccgttcttacactaatggttcgccacggtaaaattacagaagaagaagctgaagaagcaagacaagtagaagtaacttctctattaaatgaatcaaaaccagaccctactccttatgaggcgtttatacaacaagtaagaaaagaagtagaagcaaaagttgaagatgcaaatattgatacagacggattgaaaattcatacaacaattgatccagatgcacaagagcatgtagagtctctcttagcaaatgatgggaattcgattaattatccagaaaatacacaaggtgctatcgtcgtactcgatacacaatctggtgcgatagaagcaattggaggtagagtagatactggcgatgttagtggctttaactatgcaactcaaggaaaaatgcaaattggttctgtagctaaaccacttctagcttatggtccggcaattgaatacaatcaaatgtctacttaccaccaaattaatgatgatggaccgtttgaaatagatggatcttctccaattcaaaactatggtcaatatcatggttgggtatctgcaaggtatgcagtacaaatgtctctaaatgttccggctgctaaaaccatagaatctgttggatatgaaaatgcacaaaaatttgcggagaatttaggtcaaacttttgattataatctagatgtaagagatgtaattggaggtacacgaaaccattccaatccaatgaagatggctggtgcataccgcgcatttggtaatgaaggaatttacaatgaaccatacgcagtaacaaaagtagaatttccagatggtcgaactattgatttgacacctgaagctgaaccggtcatggaagattctacagcatatatggttacggatatgatgcgttctgtagtagaagatggtaccggctcatcagttcaaatccctggccttgatatagctggtaaaacaggaacaacgacattagatggcgctgaaggaagtccagatgcttggtttgttggttatactacagactacacgattgcagcttggacgggaggtcaacgtataaatgaaaatggaggtgttagtcgagtagctttaacagatactagcctttctcgggaaatgttccgacaaacaatggcacatatctcagagggtaacgatactgccagctttgagaagccagattccgttgcagaggtaaaagtagaaaaaggatctaatccacctgctttagctagtgattatacacctagtgaacagacgttaacagaactatttgtaaaaggaacagaaccaacaagtgtatcagagaagttcgatcagcttgatgcagtaagtggtttgaatgctacgtataatgaagattccaattcaattgatgtaagttgggattacgagtctgatgatgatattagtttcgatgttcgagctagtgtcaatggtggcgatatgcaagatctttcttctactgaggatacttcgatggaaatatctgaagtggaagccggagcggaatacgttatagaagtaacagcttccaatggtaacttaacaagcgaaccggccacaacttccgtaacggttccaggtgaagatgaagaacaagaagaaatcgatgaactcccttctgttagcggattatctgctcagtatgtaggagatggagtaattgatgtaagttggtcttatgatggaccatcagcatcatttgaagtaaatgttaatggccagacacaaacagttcaatctcaaggattagaagtaacgggtgcgagtcctggtgaatacacgattgaagtgacaccgattagtaacgatgatagtgaaattaccggccctcctcaatctacctctactactgttccagatgaatctggcggtgatggagaagatagtggaaatgacgaaggcaatggtaatgatgaaggtaatagtgatgaggataatagtggggatggaactcccgaggatgaaaatgaagattctggtgatggaaatcccgaagatgaaaccggagattctggtgaagaaaattaa

SEQ ID NO: 50015 - protein, 925 aa, Oceanobacillus iheyensis HTE831
MAENKGQSRTARRQQQKKSKKSRKSNKPTWKKVLKIFLIIMLAMLVIGIGVGAYWIATAPDIDEEKLTVPFSSTLLDKNGEQFAELSAEERRTQVTYEDLPDVLIDAVTATEDARFFDHAGVDPRRVGGAILANVTDGFGSQGASTITQQVVERAFLTPDKKVSIKVQEMWLALKLEREYTKEEIMEMYLNSIFYGSQAYGVANAAETYFGKTDLNDLTLPEAAILAGLPQRPSAYNPYENPELTKERMNTVLTLMVRHGKITEEEAEEARQVEVTSLLNESKPDPTPYEAFIQQVRKEVEAKVEDANIDTDGLKIHTTIDPDAQEHVESLLANDGNSINYPENTQGAIVVLDTQSGAIEAIGGRVDTGDVSGFNYATQGKMQIGSVAKPLLAYGPAIEYNQMSTYHQINDDGPFEIDGSSPIQNYGQYHGWVSARYAVQMSLNVPAAKTIESVGYENAQKFAENLGQTFDYNLDVRDVIGGTRNHSNPMKMAGAYRAFGNEGIYNEPYAVTKVEFPDGRTIDLTPEAEPVMEDSTAYMVTDMMRSVVEDGTGSSVQIPGLDIAGKTGTTTLDGAEGSPDAWFVGYTTDYTIAAWTGGQRINENGGVSRVALTDTSLSREMFRQTMAHISEGNDTASFEKPDSVAEVKVEKGSNPPALASDYTPSEQTLTELFVKGTEPTSVSEKFDQLDAVSGLNATYNEDSNSIDVSWDYESDDDISFDVRASVNGGDMQDLSSTEDTSMEISEVEAGAEYVIEVTASNGNLTSEPATTSVTVPGEDEEQEEIDELPSVSGLSAQYVGDGVIDVSWSYDGPSASFEVNVNGQTQTVQSQGLEVTGASPGEYTIEVTPISNDDSEITGPPQSTSTTVPDESGGDGEDSGNDEGNGNDEGNSDEDNSGDGTPEDENEDSGDGNPEDETGDSGEEN

SEQ ID NO: 50016 - DNA, 2028 bp, Oceanobacillus iheyensis HTE831
  CDS (1)..(2028)
atgatgaagcaatcgaaaatttggaaaagaataagaaccattatatgggtaatcgttggtttagttataacggctatactaggtacatatatcatttcttatctactcggaccaccagaattagctggtaaacaaccaacaaccgtctacgatcgatatgatgaaaaaattggagaagaacgcttgttaaactccatggaatgggtcccgcttgaagatatgaacaaaaatatcatccaagccaccttacttatcgaagatcagcagttttttgaacataatggatttaattatcaacgaatcgcaaaagcgatttggacaaatataacgcatggttccttaaaagaaggagctagtacaataacacaacaatatgcaaggaatctttatctctctcctgaaaaaaaatggtctcgaaaaatacaggaggctttttatgctatacgtttagaaatgttttactcaaaagaagagattttagaaggatatctaaataccatctattacggacatggcgcttatggaattgaagctgctagtcgttatttttttgatacgacagcaacagatttatcattagcgcaagcagcaatgctagcaggaattcctaaaggacccacctattattctccattaaataatgaaaaattggctaatgaacgtcaacaacttatattatctgaaatgcttcaacatggtgtgattacacaagaggggtacaatcgtgcaacccaagaaaaattaatctatgctgaaactgctgcagaggaagaagttgcaccatacttctccgatgaagcggttttagaagctgctgaactattagacattgctactgaagaaatacaatcaggtggatatgaattatatactacattagatctatctcatcaatcagaaatggatgaggcagtatccaagaatatgaatggttcagaggatttagaaacagctggggtgtctattaaccctaaaactggagaaattactgccatgactggcggaaaaaattacctaaccagtagttataatcgatctaccaaatcaaaaagaatggcaggttcttctttcaaaccaatcctttattatgaagctctcgagaatggttatacaccaagtactcgattggtgagcgaggcgacgacatttactttagaagatgggacaacctatcagcctggaaattttaacggctattacgcgaatggcccaattactctagcacaagcgattgcactttctgataatatctatgcagtaaagactaatttgtatcttgggccgaaaaatctagtggaaacagctaaagattttggtattacaagtgaacttgatgctgtaccttccttagctttaggtacttcatctattagcgtcttagaattaacgcaagcttatggcaggatagctaacggtggaaaagaaattgaaccctataccatacgaaaaataatcgataaaaaaggaaatacagtttatgagcatgataatgataaattagatcaagttttagacgagaaaaatacgtttatacttactcaattattgaccggtatgtttgatgaagaattaaataattatacaagtgttactggttcgacgattaatcatcaactttccaacatttatgctggtaaatcaggtacgacagattacgatagctggatggtaggttatagtccggaggttgttactggtatatgggtaggttatgatgatcaccgtaaaataacgcaagttcaagaaactactttctctaaacaaatctgggctaattatatggaagctattcacgaaccatcaagcaaacacacatttgcgatgccttctggggtaatcggcttaccaattgatcctgtgagcggaaagagagctacatcctcctgtggccaaagtcgtattatgttttttgagaaaggtacagaaccactcggctactgtacagatagaaatcatcccgaagatctagaggaagaagaaaatgatcagaagggcttcatgaaaaaaatctttgatgaattcttctag

SEQ ID NO: 50017 - protein, 675 aa, Oceanobacillus iheyensis HTE831
MMKQSKIWKRIRTIIWVIVGLVITAILGTYIISYLLGPPELAGKQPTTVYDRYDEKIGEERLLNSMEWVPLEDMNKNIIQATLLIEDQQFFEHNGFNYQRIAKAIWTNITHGSLKEGASTITQQYARNLYLSPEKKWSRKIQEAFYAIRLEMFYSKEEILEGYLNTIYYGHGAYGIEAASRYFFDTTATDLSLAQAAMLAGIPKGPTYYSPLNNEKLANERQQLILSEMLQHGVITQEGYNRATQEKLIYAETAAEEEVAPYFSDEAVLEAAELLDIATEEIQSGGYELYTTLDLSHQSEMDEAVSKNMNGSEDLETAGVSINPKTGEITAMTGGKNYLTSSYNRSTKSKRMAGSSFKPILYYEALENGYTPSTRLVSEATTFTLEDGTTYQPGNFNGYYANGPITLAQAIALSDNIYAVKTNLYLGPKNLVETAKDFGITSELDAVPSLALGTSSISVLELTQAYGRIANGGKEIEPYTIRKIIDKKGNTVYEHDNDKLDQVLDEKNTFILTQLLTGMFDEELNNYTSVTGSTINHQLSNIYAGKSGTTDYDSWMVGYSPEVVTGIWVGYDDHRKITQVQETTFSKQIWANYMEAIHEPSSKHTFAMPSGVIGLPIDPVSGKRATSSCGQSRIMFFEKGTEPLGYCTDRNHPEDLEEEENDQKGFMKKIFDEFF

SEQ ID NO: 50018 - DNA, 2157 bp, Brucella suis 1330
  CDS (1)..(2157)
atgcgtaatacggcagaaaaagatcgcagaaacgacaagcgtaaacccttccgggtttcgcgcctgatcggactcgacgcctggattgattccgcgctctacaatttacatttccgcttgggcgaatggtgggaaaacatcacgattttctcccggcgttttcgcgtgcgcggctttcgccgtttcacggtggaagtgctggacgaaggctttacgctcggcgtcgccggttccgtgctgatgttgatgctggcgctgccagcctttgaggaaaccaagaaggactggcgcgcgcaggacgattatgccgtcacctttcttgaccgttatggcaacgagattggccggcgcggtattctgcaccggcaggcggtgcctatcgatgaattgccggatcatgtcatcaaggctgtgctcggcaccgaggaccgtcgcttcttcgaccattacggcattgatctcatggggcttagccgagcgttaagccagaacatgcgcgccaacggcgtggttcagggcggctcgaccatcacgcagcagcttgccaaaaacctgtttctttccaatgagcgcaccatcgaacgcaaggtcaaggaagcctttctcgcgctctggcttgaaagcaatctcagcaagaagaaaatcctccagctttacctcgaccgtgcctatatgggcggcggcactttcggcattgcagccgcgtccgagttttatttcggcaagaatgtaaaggacatctcgctggccgaggcagccatgctggccggcctgttcaaggctccggcgaaattcgcgccgcacgtcaacctgcctgcagctcgcgcccgcgccaatgtcgttctctccaacatggtggaaagcggctttctcagcgaaggtcaggttgccgtcgcgcgccgccacccggccagcgtcatagatcgcgccaaggatgaaagccccgactatttcctggactgggccttcgacgaggtgaaaaaggttgcagacaggttcaaccagcatacgctgatcgtgcgcaccacgcttgaccgcaatatccagaaagccgccgaagaatcgcttgaatttcaccttcgccaatatggcaaggaatataacgtatcggaggcggccaccgtcgtgcttgccaatgacggttccgtgcgcgcgctcgttggcgggcgcgactatggcgaaagccagttcaaccgcgcaaccagggcgctgcggcaggccggttcatccttcaagccctatgtctatgcggctgccatggaaaaggggctgacaccaagcaccatcgtttccgatgcaccgatcagctggggcaactggtcgccgcgcaattacgggcgcagttttgctggccgggttgatctcaccaccgcgctcgtccgctcgctcaacagcgtgccggtgcgccttgcccgcgattatctgaccacggcgcccgttgtcgcgctcacaaaggcaatgggtgtggaatcgcccatctcctcccataagacgatggtgctcggcacatccgaaatgaccgtcatggatcaggcaacaggctttaacgtcttcgccaatgcgggcatggccggaaaccgtcacgctttcacgcaaatcctggcatccgacggaaaggttctttgggattttggccgtgacgcaccaaagccgcaccgcgccctttcggaaaaggccgcacttgagatgaactccatgctggtgcaggtgcccgagcgcggcacgggccggcgcgccgcacttacgatgacgcgcgtggcaggcaaaacgggtacgacccagaactatcgcgatgcctggttcgtgggctttaccggaaatttcaccgccgccgtctggttcggcaacgataatttcacgcccatgaaggaactgaccggcggtgttctgccagccatggcctggcagcgcatgatggcatacgcccatcagaatatcgaattgaagccgctgccgggcgtcaacccgcccttccccgcccagccgaagaacccgcccgcacaggtggccgatacgaggccgcacgaaacaatggctgccccaccacgggttttatcgccgctggcgacaaaaattctcaaggaactgcatgaccgcttccttgccgcgccgcctctgcctacgatagccgagcgcacaaaagtttcggtactctga

SEQ ID NO: 50019 - protein, 718 aa, Brucella suis 1330
MRNTAEKDRRNDKRKPFRVSRLIGLDAWIDSALYNLHFRLGEWWENITIFSRRFRVRGFRRFTVEVLDEGFTLGVAGSVLMLMLALPAFEETKKDWRAQDDYAVTFLDRYGNEIGRRGILHRQAVPIDELPDHVIKAVLGTEDRRFFDHYGIDLMGLSRALSQNMRANGVVQGGSTITQQLAKNLFLSNERTIERKVKEAFLALWLESNLSKKKILQLYLDRAYMGGGTFGIAAASEFYFGKNVKDISLAEAAMLAGLFKAPAKFAPHVNLPAARARANVVLSNMVESGFLSEGQVAVARRHPASVIDRAKDESPDYFLDWAFDEVKKVADRFNQHTLIVRTTLDRNIQKAAEESLEFHLRQYGKEYNVSEAATVVLANDGSVRALVGGRDYGESQFNRATRALRQAGSSFKPYVYAAAMEKGLTPSTIVSDAPISWGNWSPRNYGRSFAGRVDLTTALVRSLNSVPVRLARDYLTTAPVVALTKAMGVESPISSHKTMVLGTSEMTVMDQATGFNVFANAGMAGNRHAFTQILASDGKVLWDFGRDAPKPHRALSEKAALEMNSMLVQVPERGTGRRAALTMTRVAGKTGTTQNYRDAWFVGFTGNFTAAVWFGNDNFTPMKELTGGVLPAMAWQRMMAYAHQNIELKPLPGVNPPFPAQPKNPPAQVADTRPHETMAAPPRVLSPLATKILKELHDRFLAAPPLPTIAERTKVSVL

SEQ ID NO: 50020 - DNA, 2307 bp, Shewanella oneidensis MR-1
  CDS (1)..(2307)
atgacaactcatacgacaaaaaaagcgccagcccaacgtaaagcgaagcgaagccgtggcctgtttgggcacatttggtcgctcacctggaagctcgccttaatcggcctcgccgttgtgaccttctacggtatttacctcgaccaaattatcgcccgtaagtttgaagggcaaaaatggcatttgcctgctcaagtttttagccgctccatggcgttatacccaggagctgcggtgagtcatccgcagttgatggccgagttaaagctacttggctatcgcaaagtggctaacccccgcgaggttggtgagttttcggcatcgagcaccaaaatcgaattatggcgtcgaccctttttacatcccgaaggcgatcagccagaacagcgagtgatgatcacgttcgatagtgaaggcgtcagcgcgattgcccgaatggaagataagcgccagttagcggtattccatttagaacccgttttacttgaccgcatgatcaccggcgacggtgaagacaggctctttgtctctaccgaagagatgcccaaacctattgtgcaggcgctattgctggtggaagaccggagtttttacgagcaccacggggtgaatccttttgcaattttgcgtgcggcctttgtgaacatcaccgctgggcgaaccgtacagggtggctcaacccttactcagcagttggcaaaaaacttctttctgtcgagcgagcgctcgttgctgcgtaaagttcgcgaagctctaatggcggtgattatcgattttcgctacagcaaggacgagattctcgaggcttatctcaacgaagtgtatatggggcaagataaatcccgtgccgtacatggtatgggcttggcttcgcaattctattttggtcgtcccatcggcgagctaaccacggcgcagcaagcctttttagtggcggcgattaaggggccatcttactacaacccatggcgttacccagagcgcagcttagagcgccgcgatttagtgctgcggctattaatggagtcgggcgagttaaacactgcgcaatataaggtagctgtggagtcgcccttaggtttgcgtaatgccaataagccagtgcatcaaaaattaccatcgttttatgccttggtaaaacaagaggttaatcagcgctacggtgatgcgttattaaaacaatctggggtgaagatttataccactcttgatcctatggcgcaggaagccgccgaaatcgctgtgactcaaacctttaagagcttagataagggcaataagtcgttgcagattggtatggtggtcaccgacaaatacactggcggtatcgcggctatggtgggtgataaaacgccgggctttgacggttataaccgcgcagtggagatccgcagaccgattggctcgcttatcaagccatttgtgtatgcgaccgccttggcgcctaatagtcaatttaccttggcatcgccactgaaagatcagccgattaccttgaaaaatgagcaaggcaaaacctggtcaccgcagaactttgataagacgtttagcggccaagtctcgctgttaacggcgcttaaaaaatcgatgaacgtgccgacggtaaaccttgggattgccgttggagtcgatgcagtggtgacgacgttagccaaatcgggttgggaagaaccgcttaacgaatatccatcgatgctactgggcgcggtgaatggctcgcccttaatggtggcgcaggtttatcaaaccctcgccgatagcggcgcttaccgtaaactcactacagtcaccgcagtgctcgatagtgataatcagcctttacccgtaacgcgttcagccaaggagcaagcgattacgccggataccgactttttggtgcaatatgccatgcagcaagtcgtgcgctccggaacggcaacgcgcttaggcaacgccttccccggtgtggcactggcgggtaaaactggtaccagtaacgatagccgtgattcttggttcgccggttttgatgagcgtaacgtggcggcaatttgggtcggacgcgacgataacggtaaaaccagtctttatggcagcagcggggcgatggcggtataccaagcctttttgaaggaacgaccacccattgggctgcgttctattccacccagtggcgtgatcaaaggttattttgaccgtgacaccggtgaagcaaaagaagcaggatgcagcaataccgaggcattacccgcgctgagaggcacctataatcccgctaaaaactgtggcgagccgttgcagtggtggcagaagattttaggtcagtaa

SEQ ID NO: 50021 - protein, 768 aa, Shewanella oneidensis MR-1
MTTHTTKKAPAQRKAKRSRGLFGHIWSLTWKLALIGLAVVTFYGIYLDQIIARKFEGQKWHLPAQVFSRSMALYPGAAVSHPQLMAELKLLGYRKVANPREVGEFSASSTKIELWRRPFLHPEGDQPEQRVMITFDSEGVSAIARMEDKRQLAVFHLEPVLLDRMITGDGEDRLFVSTEEMPKPIVQALLLVEDRSFYEHHGVNPFAILRAAFVNITAGRTVQGGSTLTQQLAKNFFLSSERSLLRKVREALMAVIIDFRYSKDEILEAYLNEVYMGQDKSRAVHGMGLASQFYFGRPIGELTTAQQAFLVAAIKGPSYYNPWRYPERSLERRDLVLRLLMESGELNTAQYKVAVESPLGLRNANKPVHQKLPSFYALVKQEVNQRYGDALLKQSGVKIYTTLDPMAQEAAEIAVTQTFKSLDKGNKSLQIGMVVTDKYTGGIAAMVGDKTPGFDGYNRAVEIRRPIGSLIKPFVYATALAPNSQFTLASPLKDQPITLKNEQGKTWSPQNFDKTFSGQVSLLTALKKSMNVPTVNLGIAVGVDAVVTTLAKSGWEEPLNEYPSMLLGAVNGSPLMVAQVYQTLADSGAYRKLTTVTAVLDSDNQPLPVTRSAKEQAITPDTDFLVQYAMQQVVRSGTATRLGNAFPGVALAGKTGTSNDSRDSWFAGFDERNVAAIWVGRDDNGKTSLYGSSGAMAVYQAFLKERPPIGLRSIPPSGVIKGYFDRDTGEAKEAGCSNTEALPALRGTYNPAKNCGEPLQWWQKILGQ

SEQ ID NO: 50022 - DNA, 2199 bp, Corynebacterium efficiens YS-314
  CDS (1)..(2199)
ttgacgaacaacaacaaatccccggccaggcccgccaccgggaaacgacgggccaagaacggtcacaccctgcgcaacagcatcatcggtgttctcatcgcgatgatcgcgatcccggcgctggtcttcatgaccgcgtacatcgtggtggacgtgccggagcctgaggaacttgtcactccgcaggtatcccagatctacgccgccgacggcgaaaccgaactggcgcggatcgtcccgcccgagggcaaccgtcagatggtgagtctggatgaggtaccggaatcggtgcgtaacgcggtcatggcagcagaagaccgggaattctacaccaacccgggtttctccatcaccggctacgcccgtgccgcactgggtgtgatcaccggtgattcctccgccggtggtggctccaccatcacccagcagtatgtgaagaaggcggtggtcggtgacgagcgttccgtcatccgcaaggccaaggaactggtctactccgccaagatggctaatgagtggtccaaggatgaggtgctgcaggcctacctgaacaccgtatacttcggccgcaacgcctacggagtccaggcagccgcccacgcctacttcggcaagcccgtcagcgaactctcccccgaggagggtgccgttctggctgccagcatccagctgccgagtgccctggaaccgtggaccaaccgtgaggcagctgaagcacgctggaactacgtcctggacggcatggtggaaatcggtgccatcacgcctgagtaccgtgcgcaggcgcagtacccggaaaccaccgacccctccctcaaccgtgcctacaccgaggccaccggcaccaacggactgatcaagaacaatgtgatggcggaactggcctcggtgggtatcaccgagcaggacgtgcaaaaccgtggcctgcagatcaccaccaccatcgacccggtggcccagcagggtgccgtcgacgcggtgcacaagcagtatgagacccacggcgaagaggtccgcgcggcggtggtctccatcgacccggacaacggcgccgtccgtgcctactacggtggtgaagacgccgcaggctgggattacgccaactccccactccagaccggttccaccttcaagatcttcggtctcgccgccgcactgcagcagggcatcccactgtcccaggggtacagctccgacccggtgacctccggaaatgcgaccatcagcaacgtcaacggttccggctgtggctactgctccatcgaggaggcactgaagcactcctacaacaccagcttcatccgtctgcagcaggatctcgagaacggcccacaggacaccgccgacatggctcacgcactgggtgtggcccgttccctgccgggtatcccgaagaccctcacggaaaacggtgagaccccctacgagggcatcatcctcgggcagtactcctcccgccccatcgacatggcatccgccatggccaccatcgccaacgtgggtatctggcaccgcccgcacttcgtggagagggtggagacccggtcaggtgaggtcctgtacgaggctgagaagagcgaaggtgagcgccgggcctccgagaaggtcatgaccaacctcctcgatgccatggccccgatcgccgcctactccaactacaacaaccttgcgggtggtcgtccgtcggcagccaagaccggcaccacccagctgggtgacacggggtacaacaaggatgcctggatggtcggtgcgaccccgcagctggccaccgccgtctgggtgggaaccgtggagaatactcccctgttcaacgaatggggcggcaatatgtacggttccctcgccccgtccgtgatctggaaggacaccatggacaccgccctggaggacgaggacatcgaggagttccccaccgcccgtccactgggctacggtaacgccccgtcctacaattactgggccccctccgccccatcctccggcagcggaacaggaaccggcacgggcaccggtggcaccggtgatggaaccggcaccacctcccctgccacacctgagggttctgaccaggcacccgcgacgggggatgcgccggcaccggaggcaccagcccccgaggccccagctgaggacaccggtgacattgagctcgcgccgggcatcgttatcccgggagacctgctcaacctgggttag

SEQ ID NO: 50023 - protein, 732 aa, Corynebacterium efficiens YS-314
MTNNNKSPARPATGKRRAKNGHTLRNSIIGVLIAMIAIPALVFMTAYIVVDVPEPEELVTPQVSQIYAADGETELARIVPPEGNRQMVSLDEVPESVRNAVMAAEDREFYTNPGFSITGYARAALGVITGDSSAGGGSTITQQYVKKAVVGDERSVIRKAKELVYSAKMANEWSKDEVLQAYLNTVYFGRNAYGVQAAAHAYFGKPVSELSPEEGAVLAASIQLPSALEPWTNREAAEARWNYVLDGMVEIGAITPEYRAQAQYPETTDPSLNRAYTEATGTNGLIKNNVMAELASVGITEQDVQNRGLQITTTIDPVAQQGAVDAVHKQYETHGEEVRAAVVSIDPDNGAVRAYYGGEDAAGWDYANSPLQTGSTFKIFGLAAALQQGIPLSQGYSSDPVTSGNATISNVNGSGCGYCSIEEALKHSYNTSFIRLQQDLENGPQDTADMAHALGVARSLPGIPKTLTENGETPYEGIILGQYSSRPIDMASAMATIANVGIWHRPHFVERVETRSGEVLYEAEKSEGERRASEKVMTNLLDAMAPIAAYSNYNNLAGGRPSAAKTGTTQLGDTGYNKDAWMVGATPQLATAVWVGTVENTPLFNEWGGNMYGSLAPSVIWKDTMDTALEDEDIEEFPTARPLGYGNAPSYNYWAPSAPSSGSGTGTGTGTGGTGDGTGTTSPATPEGSDQAPATGDAPAPEAPAPEAPAEDTGDIELAPGIVIPGDLLNLG

SEQ ID NO: 50024 - DNA, 2409 bp, Vibrio vulnificus CMCP6
  CDS (1)..(2409)
gtggcgacactcaaaaatgttgagttacaaactccgatgcaggtgtttagccaagatgggaaattaattgcgcaatttggtgaaaagcgtcgcattccagtgacctacgaccaaattcctcaatcgctgatccacgcgctgatcgcgactgaagatagccgtttctatgatcattacggtatcgacccgattggtattacccgagcggcgttagttgtcgcgatgtcaggttccgctaaacagggcgcaagtaccattactcagcaattggcacgtaacttcttcctctcgaatgaaaagaagttaatgcgtaaagtgaaagaaatttttatcgccatccatattgagcaactgctgagcaagcaggagatcatggagctttacgttaataaaattttccttggttatcgctcatacggttttggggcggcagctcgagtctattttggcaaagatttgcaagatctctccttaagcgagattgcgactttggcgggtatgccaaaagcaccatcgacactgaaccctatctattcgctagaacgcgcaaccaatcgtcgtaacgtcgtcctaatgcgcatgttggatgaaaaatacatcacccaagaagagtatgacgcagcacgagcggaaacattgatttctcaattccacggcgcggagatcgaggtcagtgctccttatgtggctgagctcgcgcgtgcatggatggtacaggagtacggcgaagagaaagcgtatacgtccggtatgaatgtctacatgaccatcgactctaagctccaagccgcagccaacaaagccgcgattgacaacttattagcctacgatgagcgtcacggctaccgtggtgaagaaagtgtgctgtggaaagcaggcgaagccgcttgggatgaagcgaagatggacgatcatctgagcaaccaaccgacttacggcgaattgattccagcgattgtgaccaaggttgaaagcaaaaacgcaaccatttgggttaaacgtgaacaaagccaaaccatcgcatggtcaggcatgaactgggcgcgcaagttcatcactgatgaacgtcaaggcagtgcaccaaactcagccaaagacatcttagcgccgggcgagcaaatttgggttcgcaaagtagtgactaccgatgacaaaggcgaaagccaggaaagctggcacttaagtcaagtgcctaacgccaataccgcctttatcgccatgaaccctgataatggcgcggtactttccctcgtgggtggctttaactttgttcacaacaagtttaaccgtgccaccatgtcggttcgccaagtaggttcgagtatcaaaccctttatttactcggcggcgattgataacggcatgactctggccacgctgatcaacgatgcaccaatcaacaaatgggatgagagccaaggtacagcatggcgtcctaagaactctcctccgacttacattggcccaacccgtttacgtattggcttagcaacgtcgaaaaacgtcatggcggttcgtactctgcgtgaagtcgggctggatgaaacgcgtgaatacctcactcgctttggttttgagctcgaccaactgccacgttcagaaaccattgccttgggtgcaggtagcttaaccccaatgaagatggcacagggattctcggtttttgccaatgggggctactatgtagagccttattacatcagccatattgaagatccttatggcaatgtcgtgtttgagtcacagccacaaaccatctgtcagcaagattgcccagtggccacgcaaaccattgtagagaatgagaatggtgaaagcaccgagagcactcagccatttgccaagcaagtgatcagcgaacagaatgcttttatcatgcgcgaaatgatgtacagcaacatctgggggggtggtaactggcgtgaaggtacaggttggaatggcacaggctggcgtgcacaaacgttgggtcgacgcgatatcggcggtaaaaccggtacaaccaacgattccaaagacgcttggtataacggttatggcccgggtgtggtcgcgatttcttgggtaggttttgatgaccatagtcgcacgctcggaaaaaccaccactaacgccaacttagatggtaaacaaacctctggggccgaatctggagcgaaaactgcattgccagcgtggattgattttatgaaactggctttagaaggcgtgcctgaacatgaaaaagtgttacccgcgaatatagtgcgtgtgcgcatcgatcgtgaaaccgggctattaaccaacaagaccgatgacagcgctatgtttgagtacttcattaaagggacagagccgactgagtatgtttctagcgtcgaggaagaaagcatctattcctcttccagtgatgaagaagcgctgttctaa

SEQ ID NO: 50025 - protein, 802 aa, Vibrio vulnificus CMCP6
MATLKNVELQTPMQVFSQDGKLIAQFGEKRRIPVTYDQIPQSLIHALIATEDSRFYDHYGIDPIGITRAALVVAMSGSAKQGASTITQQLARNFFLSNEKKLMRKVKEIFIAIHIEQLLSKQEIMELYVNKIFLGYRSYGFGAAARVYFGKDLQDLSLSEIATLAGMPKAPSTLNPIYSLERATNRRNVVLMRMLDEKYITQEEYDAARAETLISQFHGAEIEVSAPYVAELARAWMVQEYGEEKAYTSGMNVYMTIDSKLQAAANKAAIDNLLAYDERHGYRGEESVLWKAGEAAWDEAKMDDHLSNQPTYGELIPAIVTKVESKNATIWVKREQSQTIAWSGMNWARKFITDERQGSAPNSAKDILAPGEQIWVRKVVTTDDKGESQESWHLSQVPNANTAFIAMNPDNGAVLSLVGGFNFVHNKFNRATMSVRQVGSSIKPFIYSAAIDNGMTLATLINDAPINKWDESQGTAWRPKNSPPTYIGPTRLRIGLATSKNVMAVRTLREVGLDETREYLTRFGFELDQLPRSETIALGAGSLTPMKMAQGFSVFANGGYYVEPYYISHIEDPYGNVVFESQPQTICQQDCPVATQTIVENENGESTESTQPFAKQVISEQNAFIMREMMYSNIWGGGNWREGTGWNGTGWRAQTLGRRDIGGKTGTTNDSKDAWYNGYGPGVVAISWVGFDDHSRTLGKTTTNANLDGKQTSGAESGAKTALPAWIDFMKLALEGVPEHEKVLPANIVRVRIDRETGLLTNKTDDSAMFEYFIKGTEPTEYVSSVEEESIYSSSSDEEALF

SEQ ID NO: 50026 - DNA, 2232 bp, Staphylococcus epidermidis ATCC 12228
  CDS (1)..(2232)
atgacggaaaataaagggtcttcccaacctaaaaagaacaacaatgggaagtccaatggaaaaaagaataggaatgtaaagagaacgattattaagattataggttttatgattattgcctttttcgttctattgctactcggtatcttgttgtttgcttattatgcgtggaaagctccagcatttagcgaatcaaaattagatgatccaattccagcaaagatttacgataaaaacggagaacttgtaaaaacacttgataacggacagcgacatgaacatgtgaatatcaaagatgttcctaaagacatgaaaaacgctgttttagctactgaagataaccgtttctaccaacatggagcattagattacaaacgtttatttggtgccattggtaaaaacttaacaggtggatttggttcgcaaggtgcgtctacacttacacaacaagttgtaaaagactcattcttgacacaacaaaagtctatcggtcgtaaagcacaagaagcttatctttcttatagattagaacaagagtacagcaaagatgaaatattccaagtttacatgaataagatttattattcggatggcgttactggaattaaggccgccgctaaatattacttcaacaaagatatgaaggatttaaatttagctgaagaagcttatctagctggtttacctcaagttcctaacctttacaacatttacaacaatcctaaggaagctaataatcgtaaagatactgtgctttatcttatgcataaacataaccgtattaatgataaacaatatgcggatgcgaagaagattgatcttaaagctaacttagttgaacgtactaaaaaagaacgtcaagtcactggaaatgaaaaaaatcctgagtatgattcttacgttaatttcgttcaatctgaattaatgaataacaagtactttaaggataaaaatttaggttcagttcttcaaagtggtataaaaatttatactaatatggataaagatgttcaacaaacgttacaagatcgaattaacaatggttctttctacaagaatgaagaccaacaagttggtgcaacaattctagatagtaaaactggtggattagttgcgatctcaggtggacgtaattataaaaatgttgttgaaagaaaccaagctactgaccctcaccctactggttcatcattaaaacctttcttagcttatggacctgcaatagaaaatatgaagtggtcaacaaatcatgcgattcaagacgaatcatcatattgggtagatggttctcaattcaagaactatgatacgaaaggccatggaacagtttctatctatgatgcattgcgtcaaagtttcaatattccagctttaaaaacttggcaacaagttaaaagtcaagctggtaatgatgcacctcagaaatttgcatctaaattaggattggattatagtggcaaaattggaccttctgaagtattaggtggatcttcatcagaattctcacctactcaactagcttccgcttttgcagcaatagcaaatggtggtacttataataacgcgcattcaatacaaaaagttgttactcatgaaggagatacaattgagtatgaacatacgagtcacaaagctatgaaagactatacatcatatatgttagctgaaattcttaaaggtacatttaaagcatatggttcggcttatggacatggtgtgtcaggcgtaaacatgggtgcgaaaactggtactggtacgtatggacaagaaatatacgaaaagtataatttacctgataatgctgccaaagatgtttggattaatggtttcagtccagaatatactatgtcggtatggatgggcttcaataaggttaaacaatatggaacaaattcatttatcggtcattcagaacaagattatccacaatacttgtatgaagatgtgatgtctagtatctcatctaaagatggtgaagatttcaaaaagcctaatgatgtacaaggaagttcaccggacagtctatctgtatcaggtcattctgataataatactactaaccgtagtgttcatggaagtagcgatacatcttcttcatcaaatggtggctctaactcagcatcaagtggaaacaactcgaatagttcgaatggtaccagtcaaggtaactcaggcaatgcatttacacgtctgttcaatttaaactctatattcgattataaagtttcataa

SEQ ID NO: 50027 - protein, 743 aa, Staphylococcus epidermidis ATCC 12228
MTENKGSSQPKKNNNGKSNGKKNRNVKRTIIKIIGFMIIAFFVLLLLGILLFAYYAWKAPAFSESKLDDPIPAKIYDKNGELVKTLDNGQRHEHVNIKDVPKDMKNAVLATEDNRFYQHGALDYKRLFGAIGKNLTGGFGSQGASTLTQQVVKDSFLTQQKSIGRKAQEAYLSYRLEQEYSKDEIFQVYMNKIYYSDGVTGIKAAAKYYFNKDMKDLNLAEEAYLAGLPQVPNLYNIYNNPKEANNRKDTVLYLMHKHNRINDKQYADAKKIDLKANLVERTKKERQVTGNEKNPEYDSYVNFVQSELMNNKYFKDKNLGSVLQSGIKIYTNMDKDVQQTLQDRINNGSFYKNEDQQVGATILDSKTGGLVAISGGRNYKNVVERNQATDPHPTGSSLKPFLAYGPAIENMKWSTNHAIQDESSYWVDGSQFKNYDTKGHGTVSIYDALRQSFNIPALKTWQQVKSQAGNDAPQKFASKLGLDYSGKIGPSEVLGGSSSEFSPTQLASAFAAIANGGTYNNAHSIQKVVTHEGDTIEYEHTSHKAMKDYTSYMLAEILKGTFKAYGSAYGHGVSGVNMGAKTGTGTYGQEIYEKYNLPDNAAKDVWINGFSPEYTMSVWMGFNKVKQYGTNSFIGHSEQDYPQYLYEDVMSSISSKDGEDFKKPNDVQGSSPDSLSVSGHSDNNTTNRSVHGSSDTSSSSNGGSNSASSGNNSNSSNGTSQGNSGNAFTRLFNLNSIFDYKVS

SEQ ID NO: 50028 - DNA, 2214 bp, Bradyrhizobium japonicum USDA 110
  CDS (1)..(2214)
atggcgtggggaaagaaaaagggtgggcggaaggagccgctgttcggcttgcccgcggcgctcgccgacctgcgcctgaccgcggccgaccgcgtcccgggcggcgaggacaaaccgaagaagtcagcgaaatcatccgccaagcgcaaagctgaggattccggcgacgagccgccgcgcgagcggaagccaccggccggccgcagcggcgccaagcgccggtcgaagtcgcgtatcggcgccagccttggccgcctggtctactggggcgcggtggtgggcctgtggggcgccatcgccgtggtcggcgtcgtgatctatgtcggggcccatctgccgccgatccagtcgctggagattcccaagcgtccgccgacgatccagatcgtcggcatggacggcagcatgctggcgcagcgcggcgagatggccggcgccaatgtcgcgctgaaggatctgccgccatacctgcccaaggccttcatcgccatcgaggaccgccgcttctattcgcatttcggcatcgatcccgtcggcatcctgcgcgccctcgtcaccaacgtgctccatcgcggcgtgtcgcagggcggatcgacgctgacgcagcagctcgcgaagaacctgttcctgacccaggagcgcaccatgcagcgcaagctgcaggaggcggagctcgcgatctggctggagcgcaagcattccaaggacgagatcctggagctctatctcaaccgcgtctatttcggctccggcgcctacggcgtcgaggccgccgcgcagcgctatttcggcaagtcggcgaagaacgtgaccatcgcggaagccgcgatgctggccggcctcgtcaaatcgccctcgcggcttgcgccgaaccgcaacccggaaggcgcggaagcgcgcgcgcaaatcgtgctcacggcgatggcggatgcaaggttcatcaccgaagcgcaggcgcaggcctcgatcggccatccctcctacaacgtgaagccggtcggcgccggcacggtcaattacgtcgccgactggatcggcgaggtgctggacgacctcgtcggccagatcgacgagagcatcaaggtcgagaccacgatcgatccgaagctgcagggcgtggcggaagccgccatcatcgacgaactcgcggccaagagcgtgaagttcaatgtcagccagggcgcgctggtggcgatgacgcccgacggcgccgtgcgcgccatggtcggcgggcggaactattccgagagccagtacaaccgcgcggtgaccgccaagcgccagccgggctcctcgttcaagccgttcgtgtacctgaccgcgctcgagcagggcctgacgcccgataccgtgcgccaggacgcgccgatcgaggtcaagggctggagacctgagaactacacccatgaatatttcggcgcggtgacgctgacccaggcgctggcgatgtcgctcaacacggtcgcgatccgcctcggcctcgaggtcgggccgaagaacgtggtgcgcaccgcgcaccggctcggcatctcctcgaagctcgagcccaatgcctcgatcgcgctcggcacctccgaagtctcggtcgtcgagctggtcggcgcctatgcgcccttcgccaatggcggcttcgcggtgacgccgcatgtcgtcacgcggatcaggacgctcagtggcaagctgctctacatgcgccagcccgacgagcgcaaccaggtgatcgacccgcgctatgtcggcatgatgaattcaatgatgcgggaaacgctgatatcaggcaccgccaagaaggccgagatccccggctggccggcggccggcaagaccggcaccagccaggattaccgtgacgcctggttcatcggctacaccgccaacctcgtcaccggcgtctggctcggcaatgacgacaacgcgccgaccaagaaggccaccggcggcggcctgccggtcgaagtctggtcgcgcttcatgcgcaccgcgcacgagggcgtgccggtcgcgaacttgccgaactcgcaagcgagctggggcctgtcgaacctcgcgcaggcggcatcgcaggtgtcgccgccgacggcggccgcgcccggaccggcgccggcgagcaatggcggctatcgcccgccaccgacgcgcgccaatgcgcggccggaagcggcggcggggctggatggctggctgatggaccggctgtttggcggcaatcgatag

SEQ ID NO: 50029 - protein, 737 aa, Bradyrhizobium japonicum USDA 110
MAWGKKKGGRKEPLFGLPAALADLRLTAADRVPGGEDKPKKSAKSSAKRKAEDSGDEPPRERKPPAGRSGAKRRSKSRIGASLGRLVYWGAVVGLWGAIAVVGVVIYVGAHLPPIQSLEIPKRPPTIQIVGMDGSMLAQRGEMAGANVALKDLPPYLPKAFIAIEDRRFYSHFGIDPVGILRALVTNVLHRGVSQGGSTLTQQLAKNLFLTQERTMQRKLQEAELAIWLERKHSKDEILELYLNRVYFGSGAYGVEAAAQRYFGKSAKNVTIAEAAMLAGLVKSPSRLAPNRNPEGAEARAQIVLTAMADARFITEAQAQASIGHPSYNVKPVGAGTVNYVADWIGEVLDDLVGQIDESIKVETTIDPKLQGVAEAAIIDELAAKSVKFNVSQGALVAMTPDGAVRAMVGGRNYSESQYNRAVTAKRQPGSSFKPFVYLTALEQGLTPDTVRQDAPIEVKGWRPENYTHEYFGAVTLTQALAMSLNTVAIRLGLEVGPKNVVRTAHRLGISSKLEPNASIALGTSEVSVVELVGAYAPFANGGFAVTPHVVTRIRTLSGKLLYMRQPDERNQVIDPRYVGMMNSMMRETLISGTAKKAEIPGWPAAGKTGTSQDYRDAWFIGYTANLVTGVWLGNDDNAPTKKATGGGLPVEVWSRFMRTAHEGVPVANLPNSQASWGLSNLAQAASQVSPPTAAAPGPAPASNGGYRPPPTRANARPEAAAGLDGWLMDRLFGGNR

SEQ ID NO: 50030 - DNA, 2286 bp, Bradyrhizobium japonicum USDA 110
  CDS (1)..(2286)
atgcgccagatcataccaccgcattggaagcagaaggtccggaatttcttcctggatctcgatgcgcgcatcgactcctcgctgttctcctcggccaagggcatccgcgagctctacgagcgctactcgaccttcatggaccgcttctatgtcgggcggtggaagcgctgggtgttcatcgagccgctgtcggaagccgcgaccctcgggctcggcggcctcgtcgtgatgctcacgctcgctatccccgccttccgcgagaccgcggacgaggactggctgaagaaatccgacctcgcggtgaccttcctcgaccgctacggcaacccgatcggcagccgcggcatcaagcacaacgactcgatcccgctggaagattttcctgacgtgctgatcaaggcgacgctggcgaccgaggaccgccgcttctacgagcatttcggcatcgacatcgccggcaccgcgcgcgcgctcgtcaccaacgcccaggccggcggcgtccgccagggcggctcctcgatcacccagcagctcgccaagaacctgttcctgagcaacgagcgcaccatcgagcgcaaggtcaacgaagccttcctcgcggtctggctggaatggcgcctgaccaagaacgagattctcaagctctatctcgaccgcgcctatatgggcggcggcacgttcggcgtcgacggcgcggcgcatttctacttcaacaagtccgcgcgcgacgtgacgctggcggaggctgcgatgctcgccggcctgttcaaggcgccgaccaaatacgccccccacatcaacctgcctgccgcgcgcgcccgcgccaacgtcgtgctcgacaacctcgtcgatgccggcttcatgaccgagggccaggtgttcggcgcccgccgcaaccccgccttcgcggtcgaccgccgcgacgaggcttcgccgaactactatctcgactacgccttcgacgagatgcgcaagctggtcgacaccttcccgaagtcctacaccgagcgcgtcttcgtggtgcgcctcgccatcgacgccaacgtgcagaaggccgcggaagacgccatcgagaaccagctgcgccagttcggccgcgactatcacgcgacccaggccgcgaccgtcgtctccgatctcgacggcggcatccgcgccatggtcggcggccgcgactacggcgccagccagttcaaccgcgccaccgacgcctatcgccagcccggctcctcgttcaagccctacgtctacaccaccgcgcttctgaacggcttcacgccgaactcgatcgtggtcgacggcccggtctgcatcggcaattggtgtccgcagaactatggccattcctattccggcgcggtgacgctgacgcaggcgatcacgcgctcgatcaacgtggtgccggtcaagctctcgatcgcgatcgggcagaaggagcagccgaaggcgccgaacccggccaagatcggccgcgccaagatcgtcgaggtcgcccgccgcttcggcctcaaggcgccgctgcccgacacgccctcgctgccgatcggctcggacgaagtcaccgtgctcgagcacgcggttgcctacgcgaccttccccaatcgcggcaagtcggtgacgccgcattcggtgctggaggtgcgcaccggcgccggtgatctcgtctggcgctgggaccgcgacggcccgaagccgaagcaggccattccgccgaacatcgccgccgacatggccgggatgatgagccacgtcgtcagcgaaggcacggcgcgccgcgccgcgctcgacggcattccgaccgcgggcaaaaccggcacgaccaatgcgtatcgcgatgcctggttcgtcggctacaccggcaatttcacctgcgcggtctggtacggcaacgacgactattcgccgaccaaccgcatgaccggcggctcgctgccggcgcagacctggcacgacatcatggtcgcggcgcatcaaggcgtcgaggtccgggaaatccccggcatcggcatgggccagaagctgccgccgcagccgatggccgcgcaagccaatgcagcgccaaaagtgctggagaccaagcccggtccgccgcccgtgctgaccaagcgcggcgccgacatcctggtgcgcgtcgagaagctgctggatgaagcggccaagaccgcgaacaagtcggccgcgagcgacggcaagcccgccaggccggcctcatcgacaagcgcgctcgccttcccgcagaactatgcggaagagaatgcgaacgcatccgccccgcgtaagaactga

SEQ ID NO: 50031 - protein, 761 aa, Bradyrhizobium japonicum USDA 110
MRQIIPPHWKQKVRNFFLDLDARIDSSLFSSAKGIRELYERYSTFMDRFYVGRWKRWVFIEPLSEAATLGLGGLVVMLTLAIPAFRETADEDWLKKSDLAVTFLDRYGNPIGSRGIKHNDSIPLEDFPDVLIKATLATEDRRFYEHFGIDIAGTARALVTNAQAGGVRQGGSSITQQLAKNLFLSNERTIERKVNEAFLAVWLEWRLTKNEILKLYLDRAYMGGGTFGVDGAAHFYFNKSARDVTLAEAAMLAGLFKAPTKYAPHINLPAARARANVVLDNLVDAGFMTEGQVFGARRNPAFAVDRRDEASPNYYLDYAFDEMRKLVDTFPKSYTERVFVVRLAIDANVQKAAEDAIENQLRQFGRDYHATQAATVVSDLDGGIRAMVGGRDYGASQFNRATDAYRQPGSSFKPYVYTTALLNGFTPNSIVVDGPVCIGNWCPQNYGHSYSGAVTLTQAITRSINVVPVKLSIAIGQKEQPKAPNPAKIGRAKIVEVARRFGLKAPLPDTPSLPIGSDEVTVLEHAVAYATFPNRGKSVTPHSVLEVRTGAGDLVWRWDRDGPKPKQAIPPNIAADMAGMMSHVVSEGTARRAALDGIPTAGKTGTTNAYRDAWFVGYTGNFTCAVWYGNDDYSPTNRMTGGSLPAQTWHDIMVAAHQGVEVREIPGIGMGQKLPPQPMAAQANAAPKVLETKPGPPPVLTKRGADILVRVEKLLDEAAKTANKSAASDGKPARPASSTSALAFPQNYAEENANASAPRKN

SEQ ID NO: 50032 - DNA, 2379 bp, Xylella fastidiosa Temecula1
  CDS (1)..(2379)
atgccgggccattccccctggtggggctggctgatcgcttgtggcttggcaggcttggcgcttgccatgggctttctgatcccttacacgctttacctgaatcagcaggtgaccgctcgctttggtgagctgcgctggcagatcccaacccgggtctatgctcgccctttgatgctacaaccggggatggcattagatgcgcgcacgttgaagatcgaactggatgctgcatcctatcgtgaggacaatcacggcgagttaccaggcacttaccaacaacaaaatggccgattcactgtctccagccgtggctacgttgatgtggatggtgcaataccagcaagccgtctgatcatcacgctgaacaacaaccaagtgtctgcactgcggaatgcagatacacgtaaaccaatcaggcgcgggcgactggatccagcacggatcgccacactgtacggccagaagcaggaagaacgccgtttggtcaggttggaggaagttccccaactgctcgtcaccggcttacaagtggtggaagaccgcgatttcaaacatcaccacggcatcgacatcaccagcattttgcgcgcagcctgggtgatggtgcgttcaggcggtggcgttcgccaaggtgccagtaccctaacgcaacagctggcgcgtagcggactgcttggtatcggcaaagaacagacgttgcagcgcaaatgcaacgaaatcctgtatgcactgatcctggaggcacgctactccaagcgcgttatcctggagtcctatctcaatcaagtctacctgggtcaacgtggcagtcaggccgtacatggtgtcgcaactggcgcggagttctggtatggacgtgagctaggctcgctcactactgagcaggtcgccctgctcatcggactggtcaaaggaccttcgtactacgatccacgccgtttccctgatcgcgcattgtcccgacgcaatttcgtgcttggcaaactgcatgaaaacaaactgatcgacgatgctgaatacatgcgcgcccaagcatcgcccctaggtgtccccaaagaacctggcctggttgcagccaaccgcttcgtcgcgtacctggacctggtacgccgccagcttgctcacgattacccagagaatgtgttgcgtggcgcaggcatgaccgtacttaccggcatgtcgccctcagcacaagcctatgctgagagaggagtaaaaaccacgctcagtgcactggaaaaggtcaaggggctgaaacgtccgccactgcaagccggactggtactgacggacgtgcataacggcgatgtcctggccgtggtcggtagtcgcgatgcaacccaatcgggtttcaatcgtgccattgaagcgcaacgccaggtgggttcgctgctgaaaccgttcgtctatctactagcactggcctcaccggatcgttggtccttgtccagttgggtagaagacaccccggtcaacataccgctggcacatgggcgcatttggtcgccaagcaactcagacaacatcagccacggaaccgtgcgcttgattgatgcattggcacactcttacaaccaagcaacagtgcgcgttggcatgcaggtcggcccagaacgtgtggctcaattgattaacgttctggccggattaaaagccgacgccaacccatcgctgatcctgggcgcaaccgaccaaagcccttatgcaatgacgcagctctatcagttcctggcttctgggggtgaaatccaaccattgcacgcagtgcgtggcgtactcgatccgcaaaacaaactgctcaaacgctatgacaataccccggcacctgcacagcccggtgattcagtcgcagccaacgtcatcagtgttgcgctacaggaagtggtcaacagcggtaccgcgcggcaactcatcattgatggcttgggtcggctgtcccctgccggcaaaaccggaacctccaacgatggacgtgacagctggtacgcgggctataccgggaaccacttggctgtcatttgggtcggcaacgaccaaaacgagcaaactggcctatacggcgccaccggtgccatgcgcgtctggtcgagcatcttctcgcagttaccaagcaccagattacaagtcaacggcaaaggactggattggcaatcagtcgagcctatgggcactggcaccacagacgcaaactgcccaggcgcacgccgctttccgtttgtaaccggcttcgctccgccttatacagcatgctctggtgctggcggagcacccgaagccgggcataatatcggctggcgtaactggttcgggctggataagcagaagggggaccaagcatcgccccccataacgcctcctcccgatcaatcgacacaatga

SEQ ID NO: 50033 - protein, 792 aa, Xylella fastidiosa Temecula1
MPGHSPWWGWLIACGLAGLALAMGFLIPYTLYLNQQVTARFGELRWQIPTRVYARPLMLQPGMALDARTLKIELDAASYREDNHGELPGTYQQQNGRFTVSSRGYVDVDGAIPASRLIITLNNNQVSALRNADTRKPIRRGRLDPARIATLYGQKQEERRLVRLEEVPQLLVTGLQVVEDRDFKHHHGIDITSILRAAWVMVRSGGGVRQGASTLTQQLARSGLLGIGKEQTLQRKCNEILYALILEARYSKRVILESYLNQVYLGQRGSQAVHGVATGAEFWYGRELGSLTTEQVALLIGLVKGPSYYDPRRFPDRALSRRNFVLGKLHENKLIDDAEYMRAQASPLGVPKEPGLVAANRFVAYLDLVRRQLAHDYPENVLRGAGMTVLTGMSPSAQAYAERGVKTTLSALEKVKGLKRPPLQAGLVLTDVHNGDVLAVVGSRDATQSGFNRAIEAQRQVGSLLKPFVYLLALASPDRWSLSSWVEDTPVNIPLAHGRIWSPSNSDNISHGTVRLIDALAHSYNQATVRVGMQVGPERVAQLINVLAGLKADANPSLILGATDQSPYAMTQLYQFLASGGEIQPLHAVRGVLDPQNKLLKRYDNTPAPAQPGDSVAANVISVALQEVVNSGTARQLIIDGLGRLSPAGKTGTSNDGRDSWYAGYTGNHLAVIWVGNDQNEQTGLYGATGAMRVWSSIFSQLPSTRLQVNGKGLDWQSVEPMGTGTTDANCPGARRFPFVTGFAPPYTACSGAGGAPEAGHNIGWRNWFGLDKQKGDQASPPITPPPDQSTQ

SEQ ID NO: 50034 - DNA, 2322 bp, Pseudomonas syringae pv. tomato str. DC3000
  CDS (1)..(2322)
atgactcgatcccgcacctctcgttcccctaaaaaacaacctccccgcagcctgaacaagtggctgggctgggcgttgaagctcggtattgtcggcctggttctgctgggcggcctggccatctaccttgatgcgattgttcaggagaaattctccggcaagcgctggaccattccggccaaggtttatgcgcggccgctggagctgttcgtcgggcagaagctgagccgcgatgacttcctcattgagctcgacgcgctgggttatcgccgcgaaagcgtggccaatggcccaggtgctgcggcggttaatggcaataccgtcgatcttaatacgcgtggcttccagttctacgagggcacggacgcagcacagcaggtgcgcgtacgtttcgctggcgattcggttgccgacctatcttccggcaacggtgccaagcttgccgtggcgcggctcgagccgttgctgatcggtggcttgtacccgaaaaatctggaagaccgaatcctcatcaagcttgatcaggcaccgccgtatctgctcgacgggctggtggcagtagaggaccgggatttttatcaccacttcggtgtgtcacccaagtccattgcccgtgcgatctgggtcaatacctcgcagggccagatgcgccagggcggcagtacgctgactcaacagttggtgaagaacttctacctgaccaacgagcgcagcctgagccgcaagctgactgaggcgatgatggcggtcttgctggaaattcattacagcaagcaggaaatcctcgaggcttatctcaatgaagtgttcgttggccaggatggtcagcgcgcagttcatggctttggtctggccagtcagtatttcttcagtcaaccgctatccgagctgaaaattcaccaggtagcgatgctggtcgggctggtcaaagggccgtccttctacaatccacgtcgcaaccctgaacgtgcgatggagcgccgcaaccttgtactcgatctgtttgagcagcaaggcgttgccacgcccgaagtggtggcggcggccaagaaattgccactgggtgtgaccaaaaccggcacgctggctgacagctcgttcccggccttcctcgatctggtcaagcgccagctacgcgaagactaccgcgacgaagacttgaccgaagaagggctgcggatcttcaccagcttcgatccgattctgcagatgaaatcccaggctgccatggacgatacgttcaaaaagctggccgggcgcaagggtgtcgatgaggtagaagcggggatggtcgtcaccaacccggagaccggcgaagtgcaggcgctgatcggtggtcgcgaggcgggtttctccggtttcaaccgggcgatcgatgcggtgcggccgattggttcgctggtcaagccggctatttacctgacggcgctggagcgtccaagccaatacacgctgaccagctggattgccgacgaactctttcaggtcaagggcgctgatggccagatctggaagccgcagaactacgatcacaagtcccatggcaatatctttctgtatcaggggctggcgcactcttacaacctgtcgactgccaagctgggtcttgagctaggcattccgacggtcttcaagacactggccaaactgggcgtgacccgtgagtggcctgcctacccgtcgatgctgctgggcgcgggcggcttgagcccgatggaagtcgccactatgtatcagaccatcgccagtggcgggttcaatacgccgatgcgtggcatccgcagtgtgctgactgccgaaggtgagccgctcaagcgttatccgttcaagatcgagcagcgtttcgatccgggtgccatttatctggtgcagaacgcgatgcagcgggtcatgcgtgaaggcacgggcaaatctgtttacagcgtattgccgagctcgctgaacctggcgggcaagaccggcaccagtaatgactcgcgcgacagctggttcgcaggtttcagtcaggatctgcttgccgtggtgtggatgggccgtgacgataacggtaagactccgtttaccggcgctaccggtgccttgcaggtctggaccagcttcatgcgcaaggccaacccgctgccgctcgacatggcgatgcccgacaacgtcgttcaggcgtgggtcgatgcacagaccggtcagggttcggacgccagctgcccgaatgcagtgcagatgccgtatattcgcggcagtgaaccccagcccggcgcaacatgcggcggcgctccggcacctgccactgaggtgatggactgggtcaagggttggttgaactag

SEQ ID NO: 50035 - protein, 773 aa, Pseudomonas syringae pv. tomato str. DC3000
MTRSRTSRSPKKQPPRSLNKWLGWALKLGIVGLVLLGGLAIYLDAIVQEKFSGKRWTIPAKVYARPLELFVGQKLSRDDFLIELDALGYRRESVANGPGAAAVNGNTVDLNTRGFQFYEGTDAAQQVRVRFAGDSVADLSSGNGAKLAVARLEPLLIGGLYPKNLEDRILIKLDQAPPYLLDGLVAVEDRDFYHHFGVSPKSIARAIWVNTSQGQMRQGGSTLTQQLVKNFYLTNERSLSRKLTEAMMAVLLEIHYSKQEILEAYLNEVFVGQDGQRAVHGFGLASQYFFSQPLSELKIHQVAMLVGLVKGPSFYNPRRNPERAMERRNLVLDLFEQQGVATPEVVAAAKKLPLGVTKTGTLADSSFPAFLDLVKRQLREDYRDEDLTEEGLRIFTSFDPILQMKSQAAMDDTFKKLAGRKGVDEVEAGMVVTNPETGEVQALIGGREAGFSGFNRAIDAVRPIGSLVKPAIYLTALERPSQYTLTSWIADELFQVKGADGQIWKPQNYDHKSHGNIFLYQGLAHSYNLSTAKLGLELGIPTVFKTLAKLGVTREWPAYPSMLLGAGGLSPMEVATMYQTIASGGFNTPMRGIRSVLTAEGEPLKRYPFKIEQRFDPGAIYLVQNAMQRVMREGTGKSVYSVLPSSLNLAGKTGTSNDSRDSWFAGFSQDLLAVVWMGRDDNGKTPFTGATGALQVWTSFMRKANPLPLDMAMPDNVVQAWVDAQTGQGSDASCPNAVQMPYIRGSEPQPGATCGGAPAPATEVMDWVKGWLN

SEQ ID NO: 50036 - DNA, 2571 bp, Vibrio parahaemolyticus RIMD 2210633
  CDS (1)..(2571)
gtgaagttcataaagcgtttattatttttaacattgatttgcataattcttggagtcaccacaatttttggcttctatcagtacgtgaagcctgaattgccagacgttgcaactctaaaagacgttgaattacaaacacctatgcaggtatttagtcaagacgggaagctgatcgcacagtttggtgaaaagcgtcgtattcctgttacttacgatgaaattcctcaagacctaattcacgcactgatcgccaccgaagacagccgtttttacgagcaccctggtatcgatccaatcggtattactcgtgcagctgtcgtggttgctctttccggctcagcaaagcaaggcgcgagtaccatcactcagcagctagcgcgtaacttcttcttatccaacgagaagaaactaatgcgtaagatcaaagagatcttcattgccattcacattgagcaactgctgagcaaacaagagatcatggagctttacgttaacaagatcttccttggctatcgctcatacggttttggtgcagcagctcaggtgtattttggtaagagcctaaatgagctctcgcttagcgaaattgcgacactggcggggatgccaaaagccccttcaaccatgaacccaatatactcgctagaacgtgcaacaaaacgtcgtaacgttgtgctaatgcgtatgctcgatgaaaagtacattacgcaagaacaattcgatgaagcacgtaacgaaccaatcattgctcgttaccacagtgcagaaattgaagtgtctgcgccttacgttgccgaacttgcacgtgcatgggcagtaaaagagtacggtgaagagaaagcctatacgtcgggtttgaatatctacatgacggttgactctaaactgcaagacgctgccaataaggctgcggtaaacaacctaatggcttatgacgagcgtcatggctaccgtggcgcagaaaaagtgttgtggaaagaaggggaagccgcttgggatgcagaacaaattgagaagcatctaaaaggccagccaacttacggcgatctttaccctgctgtcgtgacaaaagtggaaggcaaaacggcgcaagttgttgtgaaaaataacgacgcacaaaccatcccttggactggcataaactgggcacgcaaattcctcaccgataaccgtcaaggttcaacaccaaaatctgcacaagaggttttagctgcaggtgaacaaatttgggttcgcgagctaacgaccaccgatgaagatggcaacactcaaagcagctggaagctaagccaagtgcctagcgcgaacaccgcatttgtcgcgatgaatcctgaaaatggcggcattttgtcactggtaggtggttttaactttgttcacagcaagtttaaccgcgcaaccatgtccgtgcgtcaggttggttctagtatcaaaccatttatttactcagccgctatcgataaaggcctaacgttagcaactctgatcaacgacgcgccaatcaacaaatgggacgcaggttcaggatcggcatggcgaccaaagaactcacctccaacttacggtggtccaactcgccttcgcattggcttagcgcaatcgaaaaacgtaatggcggttcgtaccttacgtgaagtaggtctggatgaaactcgtcagtacctaactcgctttggattcgatatcaacgaagtgcctcgctcagaaactatcgccttgggtgcgggtagcttaacgccaatgaaagtggcgcaaggttactcggtttttgcaaacggcggttactatgttgagccgttctacgtagaacgtgttgaagatgcatttggcgaagttttgtttaaagccaaccctaagagcgtttgtcatcaagattgcccacaaatgagcccacaaccagaaatggatcgctttgcaagtgagttcggtgagcaagacgttgccgttgatggccaagctccagagaacgcactagaaaatgatgaaccaaaatacgcaccacaagtgatctctgaacaaaacgcattcttgatgcgtgaaatgatgtacagcaacatctggggtggcggcaattggcgtgaaggtactggttggaacggtactggctggcgtgcgcaaaaacttgagcgtcgtgatattggtggtaaaactggtacgactaacgattcaaaagacgcatggtacaacggttatggtccgggcgtagttgcgattgcatgggtgggcttcgatgatcactcacgcgcgttaggccgcacgacggtgaacagcaatttgggtcaaggccaagtatctggtgctgaatcaggagcgaaaacagcagagccagcatggattgactttatgcaagtagcattggaaggcaagccagaacaaggcaagaatattccagatgacatcgtgcgcgttcgcatcgatcgcaacagcggtctgctgactcataaagtggatagcacgtccatgtttgaatactttgagaaaggcacggagccaaccgaatacgttggtaacagcctcgaagacagcatttattcaagcggttctggtggcacaacggaagagttgttctaa

SEQ ID NO: 50037 - protein, 856 aa, Vibrio parahaemolyticus RIMD 2210633
MKFIKRLLFLTLICIILGVTTIFGFYQYVKPELPDVATLKDVELQTPMQVFSQDGKLIAQFGEKRRIPVTYDEIPQDLIHALIATEDSRFYEHPGIDPIGITRAAVVVALSGSAKQGASTITQQLARNFFLSNEKKLMRKIKEIFIAIHIEQLLSKQEIMELYVNKIFLGYRSYGFGAAAQVYFGKSLNELSLSEIATLAGMPKAPSTMNPIYSLERATKRRNVVLMRMLDEKYITQEQFDEARNEPIIARYHSAEIEVSAPYVAELARAWAVKEYGEEKAYTSGLNIYMTVDSKLQDAANKAAVNNLMAYDERHGYRGAEKVLWKEGEAAWDAEQIEKHLKGQPTYGDLYPAVVTKVEGKTAQVVVKNNDAQTIPWTGINWARKFLTDNRQGSTPKSAQEVLAAGEQIWVRELTTTDEDGNTQSSWKLSQVPSANTAFVAMNPENGGILSLVGGFNFVHSKFNRATMSVRQVGSSIKPFIYSAAIDKGLTLATLINDAPINKWDAGSGSAWRPKNSPPTYGGPTRLRIGLAQSKNVMAVRTLREVGLDETRQYLTRFGFDINEVPRSETIALGAGSLTPMKVAQGYSVFANGGYYVEPFYVERVEDAFGEVLFKANPKSVCHQDCPQMSPQPEMDRFASEFGEQDVAVDGQAPENALENDEPKYAPQVISEQNAFLMREMMYSNIWGGGNWREGTGWNGTGWRAQKLERRDIGGKTGTTNDSKDAWYNGYGPGVVAIAWVGFDDHSRALGRTTVNSNLGQGQVSGAESGAKTAEPAWIDFMQVALEGKPEQGKNIPDDIVRVRIDRNSGLLTHKVDSTSMFEYFEKGTEPTEYVGNSLEDSIYSSGSGGTTEELF

SEQ ID NO: 50038 - DNA, 2523 bp, Salmonella enterica subsp. enterica serovar Typhi Ty2
  CDS (1)..(2523)
atggcggggaatgaccgcgagccgattggacgtaaggggaaaccgtcacgtcctgtgaaacaaaaggtgagccgtcgtcggcagcatgacgacgattatgatgatgactatgaggatgaagaaccgatgccgcgtaaaggtaagggcaaagggcgtaagcctcgtggcaagcgcggctggctgtggctattgctaaaactgtttatcgtttttgtggtgctgttcgccatttacggcgtctatctggatcaaaaaatccgcagccgtattgatggcaaggtctggcagcttccggcggcggtatatggccggatggtgaaccttgagccagacatgcctgtcagcaaaaacgagatggtgaaattgctggaagcgacgcagtatcgtctggtgacgaagatgacccgtcccggcgaatttaccgtgcaggccaatagcattgagatgatccgtcgtccgtttgacttcccggacagcaaagaagggcaggtgcgcgcgcggctgacgttcagtgacgggcgtctggaaaccatcgtcaatctggataacaaccgccagtttggcttcttccgcctcgatccgcggcttatcaccatgctttcttcgccaaatggcgagcagcgtttattcgtcccgcgcagcggtttcccggatctgctggtcgatacgctgttggcgacggaagaccgtcgtttctatgagcatgatggcattagtctttactctatcgggcgtgcggtgctggccaacctgacggcgggacgcacggtgcagggggccagtacgctgacccagcagctggtgaagaacctgttcctctccagcgaaagatcatactggcgtaaagcgaatgaagcctacatggcgctgatcatggatgcccgttacagtaaagatcgtattcttgagctgtacatgaacgaggtctacctcggtcaaagcggggataatgaaattcgcggttttccgctggcgagcctgtattactttggtcgtccggtagaggaactgagcctcgatcagcaggcgttactggtggggatggtaaaaggggcgtcgatttataacccgtggcgtaacccgaaactggcgctggagcgtcgtaacctagtgttacgcctgttacagcagcagaaaatcatcgatcaggaactctatgacatgctgagcgcgcgtccgcttggcgtacagccgcgcggcggcgttatttcaccgcagccagcgtttatgcagatggttcgtcaggaactgcaggcgaagctgggggataaaattaaagatctctccggcgtgaagatcttcaccacctttgactccgtggcgcaggatgccgcagaaaaagccgttgtcgaaggcattccggcgttgaagaagcagcgtaaattgagcgatctggaaactgcgatggtggtagtggatcgctttagcggcgaggtacgcgcgatggttggcggggcggagccgcagtatgctggctataaccgtgccatgcaggcacgccgttccatcgggtcgctggcgaaaccggcgacctatctgaccgcgttaagtcagccgaacttataccgtctgaacacctggattgccgatgcgccgatttctctgcgccagccgaatggtcaggtctggtcgccggagaacgacgatcgtcgctacagcgaaagcgggaaagtgatgctggtggatgcgttaactcgttcaatgaacgtaccgacggtcaatctggggatggcgttaggtttaccggcggtaaccgatacctggacgaagctcggcgtgccgaaagatcagctcaatccggttccggcgatgctgttaggggcgctgaacctgacgccgatcgaagtggcgcaagcgttccagactatcgccagcggcggaaatcgcgcgccgttatcagcgctgcgttcggttattgcggaagatggtaaagtgctgtaccaaagttatccgcaagctgaacgcgccgtaccggcacaggcggcttacctgacgctctggacaatgcagcaggtcgtccagcgtggtacggggcgtcagcttggcgcgaaatatccgggtctgcatctggtgggtaaaaccgggacgacaaacaacaatgtcgatacctggtttgccggtatcgacggcagccaggtgactatcacctgggtaggccgtgataacaaccagccaacgaaattgtacggtgccagcggcgcgatggcgatttaccagcgctatctggcgaaccagacgccgacgcctttagttctgacgccgccggaagatgtggtggatatgggcgttgattacgacggtaattttgtctgtaacggcggtatgcgcactctgccggtctggacggacgatccaaatacgctgtgccagcagggcgagatgatgcagcagcaacagcagccgtcaggcaatccgttcgatcagtcgtctcagccgcagcagcctgcgcagcaacagccgccgaaagaagagaagagcgacggcgttgccggctggattaaggagatgtttggcggcaattaa

SEQ ID NO: 50039 - protein, 840 aa, Salmonella enterica subsp. enterica serovar Typhi Ty2
MAGNDREPIGRKGKPSRPVKQKVSRRRQHDDDYDDDYEDEEPMPRKGKGKGRKPRGKRGWLWLLLKLFIVFVVLFAIYGVYLDQKIRSRIDGKVWQLPAAVYGRMVNLEPDMPVSKNEMVKLLEATQYRLVTKMTRPGEFTVQANSIEMIRRPFDFPDSKEGQVRARLTFSDGRLETIVNLDNNRQFGFFRLDPRLITMLSSPNGEQRLFVPRSGFPDLLVDTLLATEDRRFYEHDGISLYSIGRAVLANLTAGRTVQGASTLTQQLVKNLFLSSERSYWRKANEAYMALIMDARYSKDRILELYMNEVYLGQSGDNEIRGFPLASLYYFGRPVEELSLDQQALLVGMVKGASIYNPWRNPKLALERRNLVLRLLQQQKIIDQELYDMLSARPLGVQPRGGVISPQPAFMQMVRQELQAKLGDKIKDLSGVKIFTTFDSVAQDAAEKAVVEGIPALKKQRKLSDLETAMVVVDRFSGEVRAMVGGAEPQYAGYNRAMQARRSIGSLAKPATYLTALSQPNLYRLNTWIADAPISLRQPNGQVWSPENDDRRYSESGKVMLVDALTRSMNVPTVNLGMALGLPAVTDTWTKLGVPKDQLNPVPAMLLGALNLTPIEVAQAFQTIASGGNRAPLSALRSVIAEDGKVLYQSYPQAERAVPAQAAYLTLWTMQQVVQRGTGRQLGAKYPGLHLVGKTGTTNNNVDTWFAGIDGSQVTITWVGRDNNQPTKLYGASGAMAIYQRYLANQTPTPLVLTPPEDVVDMGVDYDGNFVCNGGMRTLPVWTDDPNTLCQQGEMMQQQQQPSGNPFDQSSQPQQPAQQQPPKEEKSDGVAGWIKEMFGGN

SEQ ID NO: 50040 - DNA, 2187 bp, Enterococcus faecalis V583
  CDS (1)..(2187)
atggacaatcttaaacaattttttagtaaagtcggtgtcggattacgtcatttttggacgtggataaagccttatttaatacaattccatcaagccagaaagcggatttggaaaaagtatcaaatcaataaaattttcttgttaattggtttggtagtcgctttaggtgccagtatttatttattttacttagccaagtccgcaaacgttgagaccctaaaatcagggctaagtgaatcaacacgcgtttatgatgaatcaggaaaagaagtcggaaagttattcgggcaaaaagggacttttgtggaactggataatatttctccttatattcaagacgcggttatttcaactgaagatcgcgggttttatcaacataaagggtattccatcaaagggattgcccgtgcggttgttggaaaattgaccttcgggaaaatcggtggcggtggtggcggaagtacaattacgcagcaattagccaaaaatgcttacttaacgcaagaacaaacgttagataggaaagccagagaattattcttagcgattgaaatcgaaaagaaatattcgaaaaaagatatcttggcaatgtatttaaataattcttattttggtaatggtgtctggggcgtgcaagatgcagctcgtaaatactttggcgtggatgcgtcccaagtgacagtgggggaagccgcaacgctagcgggcatgttaaaagggccaggaatttataacccaattgattacattgacaatgccacagcgcgacggaataccgttttacaactaatggtcgacaataaaaaactatctcaagaagaagccaatcaagaagcgagtgttaacttagcgagtctattaaatgacacctatgttggcgacgaaaatagttacaaatatccatattattttgatgcggtaattgatgaagcggtcaatcgttataaatttaaagaagaagatattttaaataaaggatacaagatttacacttctttaaatcaggggtatcaagatgcgatggatgcaacttataaaaatgatgcactatttccacccaatgcagaagacggtgccatggttcaaagtggctctgtagccattgatccgaaaaccggcggcgtgcaagcactggtgggcggtcgaggggaacacgtttatcgaggctttaactttgcaacgcaaacaaaacgttcaccaggctcgtccttaaaaccaatttctgtctatacaccagctttagaggctggctataaaccagactctgttttagaagataaaccacaagattattatccagcgcaaaactatagccgcacgtacagtggagaagttcctatgtatcaagccttaggagaaagcttaaatttaccagcggtatggttattacatcaaattggtttagataaaggctatgaaaaaacagagaaatttggcattccgttatcagaaaaagatcggtactatggtttagcccttggaggattacaaacgggtgtttcgccactaactatggcgggagcttatagtgcctttgccaatgaaggctataaaactgaaacgcatttaattacaaaaatcgtcgactcaactggcgcaattgtagttgataatactaaagtcaagaaagaacaagtcattaccaaagatgttgcagacgggattacaagtatgttactaggggtctttagttctgggagcggggtcaacgcacaaccagcaggctacgtaatggctggtaaaacaggtacgacagaaaccaacttcgatagtagtaaaacgaacgatcagtgggtgattggttatacaccagaagttgtcattgctacttggttaggcttccaagaaaccagtaaaacccattatttggaaggcagtagcgctacgtatgcctcacaggtgttcaacagtcaagccagtggcatcttgccacaagtcaaacaagcacaatttcctgtcgcggatgcttatgccacaggtgggaaagttgttgatagcaacgatagtttaactggtggtgccaattctaattggcgggataacttgaaagactttggaaattctgttcaagacggcgctagcaatttcggagatacattgaatgaagttgggggacaaattaaagacggcgcgaaaaaagtcaaagacaagattgaaggaattttcggaggcttattaggaaattag

SEQ ID NO: 50041 - protein, 728 aa, Enterococcus faecalis V583
MDNLKQFFSKVGVGLRHFWTWIKPYLIQFHQARKRIWKKYQINKIFLLIGLVVALGASIYLFYLAKSANVETLKSGLSESTRVYDESGKEVGKLFGQKGTFVELDNISPYIQDAVISTEDRGFYQHKGYSIKGIARAVVGKLTFGKIGGGGGGSTITQQLAKNAYLTQEQTLDRKARELFLAIEIEKKYSKKDILAMYLNNSYFGNGVWGVQDAARKYFGVDASQVTVGEAATLAGMLKGPGIYNPIDYIDNATARRNTVLQLMVDNKKLSQEEANQEASVNLASLLNDTYVGDENSYKYPYYFDAVIDEAVNRYKFKEEDILNKGYKIYTSLNQGYQDAMDATYKNDALFPPNAEDGAMVQSGSVAIDPKTGGVQALVGGRGEHVYRGFNFATQTKRSPGSSLKPISVYTPALEAGYKPDSVLEDKPQDYYPAQNYSRTYSGEVPMYQALGESLNLPAVWLLHQIGLDKGYEKTEKFGIPLSEKDRYYGLALGGLQTGVSPLTMAGAYSAFANEGYKTETHLITKIVDSTGAIVVDNTKVKKEQVITKDVADGITSMLLGVFSSGSGVNAQPAGYVMAGKTGTTETNFDSSKTNDQWVIGYTPEVVIATWLGFQETSKTHYLEGSSATYASQVFNSQASGILPQVKQAQFPVADAYATGGKVVDSNDSLTGGANSNWRDNLKDFGNSVQDGASNFGDTLNEVGGQIKDGAKKVKDKIEGIFGGLLGN

SEQ ID NO: 50042 - DNA, 2337 bp, Enterococcus faecalis V583
  CDS (1)..(2337)
atgccaaccgcaaattcaggctcgcgagctgctagacatgcatccaacacctcatcgaagtcaagttacaagaaaaagacacaaccgccgaaaaagaaaaaacggcttgttttaaaaatctttcttggcttacttatcgctgggatggtcgcttttttagcaggcgttggtcttttttggttctatgcacgacaagccccaaaattagaagatgacaaactgaatgcgacagtttcatcgaagctttacgatattaataatgaaatttttgaggatttaggcgcagaaaagcgtgaattaattcaaccaaatgatgtgcctcaattattaaaagatgccattgtttctgtcgaagaccgtcgtttctataaacacattggtgtggatccgattcggattatcggttctgccctttcaaatgtcaaaaatggtggattacaaggcggaagtaccttaacccaacaattaattaaattgtcctacttctctacaaaagaatctgaccaaaccttgaaacggaaagcacaagaagcatggatggctgttcgtttagaacgtgaaaaatcaaaagaagaaattttaacttactacattaacaaagtctacatggcgaatggtttttatggaatggaaacagcggctgaaaattattatggtaaacatttatctgaacttgatttaccacaaacggccctactggcaggaatgccacaagcgccaaactcatatgatccctatacaaagccagatactgctaaagaacgccgggatgttgtactttacacaatgtacgacaataaaaaaatctcgaaagccgagtacgaaaaagccaaagctaccccaatcgatgaaggcttagtgccattaaaagccagtgatgacaatcgaaaagtcgtagataattacgtcaaagaagtaatcaatgaagtgaaagcaaaaactggtaaaaatgtttacacagacggactagatatctacacaaacttagatatgaatgcccaaaaacaactttacgatattgtcaacagtgatcaatacgttgcgtttccagatgataaaatgcaagtggcttcaaccgttattgatgttgcctctggacaagtccgagcacaaattggtggtcgtcacattcctgatgatgtgcaattaggaaacaatttagctgttaacacccaacgtgatgttggttcaaccgtgaaaccaatcatggattatggtcccgcaattgagaatttaaattattcgacaggtcgcctcatggtggataaaccaacgaaatatcctggtaccgacattgatgtcttcaactctgatttgacataccaaggcgtcattactatgcgccgtgcgattatgggttctcgtaacacaaccgcggtccagacgtttgatgaagttggtaaagaaaacatcatgcctttcattaaaggactaggaattgactataaaaacttagaagcgtcaaatgccatttcaagtaacacaagcgatgtagatggcgataaatacgggatttcctcattgaagttagcagcagcttatgcggctttcgccaataacgggatttataacaaaccgtattacgtaaacaaagtcgttttcaatgatggaactagcgttgattatcaacctgatggtaaacgtgcgatgaaagactctaccgcctatatgatgacggatatgttaaaagatgttttaaacggcggaacaggatttaacggcgccattccaggcttaatccaagcggccaaaacagggacttctaactatactgatgaagatttagcgcgaatgggcacaacagaaaaaggaattgccccggatagtacctttgttggttatacaacacactatgccgtttctgtttggactggatacaatgatcgaaatacaccaatctatcaagaatactatggaattgcctcggatgtttatcgtgaaataatgagttacttgtctcaaaatgtttcaaacgatgactgggtgcagccagacagtgttgtgcgggtaggtaatgaattatacgtgaaagatgcctatgaggtaccaaatgtacaagttttaccaagtactacctcttcagcaccacagccggaatctagcagtacggtggaatcctcttccacaaaagaagcggaaagttcatcaagttctagttcagaaagtgcgccttcttcctctgaagcgccaccatcaaccgaacaaccggcaagctcttcctcagcagagcaaccggcaacatcagaacaaccacctgaaccttcaagttctagttcacaagaaccgccgcaaccacctgaaagtagttctaaaccagatgaaaataaagcagcataa

SEQ ID NO: 50043 - protein, 778 aa, Enterococcus faecalis V583
MPTANSGSRAARHASNTSSKSSYKKKTQPPKKKKRLVLKIFLGLLIAGMVAFLAGVGLFWFYARQAPKLEDDKLNATVSSKLYDINNEIFEDLGAEKRELIQPNDVPQLLKDAIVSVEDRRFYKHIGVDPIRIIGSALSNVKNGGLQGGSTLTQQLIKLSYFSTKESDQTLKRKAQEAWMAVRLEREKSKEEILTYYINKVYMANGFYGMETAAENYYGKHLSELDLPQTALLAGMPQAPNSYDPYTKPDTAKERRDVVLYTMYDNKKISKAEYEKAKATPIDEGLVPLKASDDNRKVVDNYVKEVINEVKAKTGKNVYTDGLDIYTNLDMNAQKQLYDIVNSDQYVAFPDDKMQVASTVIDVASGQVRAQIGGRHIPDDVQLGNNLAVNTQRDVGSTVKPIMDYGPAIENLNYSTGRLMVDKPTKYPGTDIDVFNSDLTYQGVITMRRAIMGSRNTTAVQTFDEVGKENIMPFIKGLGIDYKNLEASNAISSNTSDVDGDKYGISSLKLAAAYAAFANNGIYNKPYYVNKVVFNDGTSVDYQPDGKRAMKDSTAYMMTDMLKDVLNGGTGFNGAIPGLIQAAKTGTSNYTDEDLARMGTTEKGIAPDSTFVGYTTHYAVSVWTGYNDRNTPIYQEYYGIASDVYREIMSYLSQNVSNDDWVQPDSVVRVGNELYVKDAYEVPNVQVLPSTTSSAPQPESSSTVESSSTKEAESSSSSSSESAPSSSEAPPSTEQPASSSSAEQPATSEQPPEPSSSSSQEPPQPPESSSKPDENKAA

SEQ ID NO: 50044 - DNA, 2382 bp, Coxiella burnetii RSA 493
  CDS (1)..(2382)
atgagtaaagtccgccattttgccgtccataccatttgggcgttgttcagccttgcttttacgatcgtcttggtgatggctgtcatttatgtttacatggaatggcggctgccggacgttaaaaccttacgcgatgtgcatttgcaagtccctttgcgcatttacacggccgatgacaaattaatcactcaatttggcactaaacgacgaattccggtgacgctggatcaagtgccgaaaccccttatccatgccgtgctagctacggaagatgcccgattctatgaacaccccggcgtggatttaatcagtattattcgcgccgccaaagcagtcatactcaccggcaagcgttcgcagggcgcgagcacgatcaccatgcaagtcgcccgtaatttctttttaacccgtaaaaaaacctatacccgaaaaattaacgaaatattgttagctttaaaaatcgataaggaacttagcaaggataaaatcctcgaactttatttaaataaaatttattttggtaatcgcgcttatggcgtagcagcggcagcggaagtttgttatgggaaaccgctcaatcaattaacattacctcagatggccatgatcgccggattgccccaagccccctcccgaaataaccccttagaaaatcctaaagcggcacttctgcggcgcgaccatgtattaaagcgaatgttagaagtcaactttattaccaaagaaaactatttgaaagccataaaagcacccctcaccgcaaaataccatgcggctactacccaagtgaaagcgccttatatggctgagatggtccgggaagctgttgttgaccaatatggcgaagaggcgtatgaccgcggccttaatgtttatacgacgatttcttcgaagcttcagaaagaagccaatcgatcgttgcgagatggtttgattgcgtatgatgagcgtcacgggtaccgaaaggcgcagcaaaatttaggcgcctttgatcgcgatatctggcttgctgctttgaaagaaaaaccgattgtagatggcattactcccgcggccgtcactacgattaatagtcgtagtatagtcgtattgctgccggatggccgcgctattaccgtgccttggtccggtttatcttgggcgcgccccgcgttggaaaatggttatgttgggcttgctccgcgtcaggcgagcgatatcgtgaaagtcggcgatgttgttgaggtcattcaagcacgcaatgaccaatggtggcttacccaaattcctgaagtagaagggggtttggttgcattgaatcctcaagacggcgctgttaatgccttgataggcgggtttgattacgaacacagtaatttcaatcgcatcacccaagctgaacggcaaccgggttccaattttaagccctttctttattccgccgcactgaccaaaggttatactttagctagcatgatcaatgatgcaccggtagttatgcaagattcgggtgaaaatgccctctggcgcccgatgaatgatacgcgaaaattttacggacccacttctattcgcatgggtttaattaaatcgcgtaatttggtttcgatccggttattacaaaaaatcggcatcccttatgcaattgaatatcttacgcgattcggttttgatcctaatgttttgccgcactcgctttcgctagcgcttggcagcgccacgctgcctcctttacaggttgctagcggttatgccatctttgcaaatggcggatatcgggtaacgccttattttatttcgcgaattgaagatcagtcgcaccatgttttatttcaggctaaaccaccgcgtgcttgtagcgcttgcattaccaaccccaatgcgaccgcagaacagttgcctaatcccatggctccccaagtaattacgccgcaaaacgcttatttaattacgcaagcaatgcacgatgtgatccaatacggcacaggccgccgagcaaaggtattaaaccgccccgatttagcggggaaaaccggcacgacgaatgatcaagttgacgcttggttttcgggatttaacgctaacttagaaaccacggtctgggtgggctatgacaatttaagatcacttcatgaatacggtgcccaagctgccttgcccatctggattcaattcatgagggctgctttgcaaggccagcccgaagcctcattaccccaacctcccgggatggtgatggtcagaattgatcctcataccggccttttagcctcgcccaatcaaccagacgcgcgatttgaaattttccgccagcgttacgcgcccacccaattttcaaccgcctcctccgacaacgccggcgctccaaatgatagcgattcggaagaccaacatttgttttag

SEQ ID NO: 50045 - protein, 793 aa, Coxiella burnetii RSA 493
MSKVRHFAVHTIWALFSLAFTIVLVMAVIYVYMEWRLPDVKTLRDVHLQVPLRIYTADDKLITQFGTKRRIPVTLDQVPKPLIHAVLATEDARFYEHPGVDLISIIRAAKAVILTGKRSQGASTITMQVARNFFLTRKKTYTRKINEILLALKIDKELSKDKILELYLNKIYFGNRAYGVAAAAEVCYGKPLNQLTLPQMAMIAGLPQAPSRNNPLENPKAALLRRDHVLKRMLEVNFITKENYLKAIKAPLTAKYHAATTQVKAPYMAEMVREAVVDQYGEEAYDRGLNVYTTISSKLQKEANRSLRDGLIAYDERHGYRKAQQNLGAFDRDIWLAALKEKPIVDGITPAAVTTINSRSIVVLLPDGRAITVPWSGLSWARPALENGYVGLAPRQASDIVKVGDVVEVIQARNDQWWLTQIPEVEGGLVALNPQDGAVNALIGGFDYEHSNFNRITQAERQPGSNFKPFLYSAALTKGYTLASMINDAPVVMQDSGENALWRPMNDTRKFYGPTSIRMGLIKSRNLVSIRLLQKIGIPYAIEYLTRFGFDPNVLPHSLSLALGSATLPPLQVASGYAIFANGGYRVTPYFISRIEDQSHHVLFQAKPPRACSACITNPNATAEQLPNPMAPQVITPQNAYLITQAMHDVIQYGTGRRAKVLNRPDLAGKTGTTNDQVDAWFSGFNANLETTVWVGYDNLRSLHEYGAQAALPIWIQFMRAALQGQPEASLPQPPGMVMVRIDPHTGLLASPNQPDARFEIFRQRYAPTQFSTASSDNAGAPNDSDSEDQHLF

SEQ ID NO: 50046 - DNA, 2334 bp, Streptomyces avermitilis MA-4680
  CDS (1)..(2334)
atgggacgagcggaagagagacgagcgcggcagcgcggtggccgccgcgcggcgccccagggctcgtcgaggacggctgccaagagcgccggcgccggcaagggccggatacgcaggctgttcacctggaagaagatcctcggcacgctgttcggcctgtgcctgctgggcatgggcgccttcatcgtgctctacatgatgatcagcgtccccaagggcaacgcggacgccaagctccagagcaacgtctacgagtacagcgacggctcgcccctcgcccgcaccggcacccgcaaccgtgagatcgtcgacctctccgaggtgcccaagggcgtccagcggaccttcgtcgccgccgagaacaagtccttctacaaggactccggcgtcgacttcaggggcacggcccgcggtctgatcaacaccctctccggcaagggcaagcagggtggttcgacgatcacccagcagtacgtcaagaacttctacctgagccaggaccagaccgtcacgcgcaagctgaaggaactggtcatctcgctgaaggtcgaccgccagaagaccaagagccagatcctcgcgggctacatcaacaccagctactacggccgcggcgcctacggcatccaggccgccgcccaggcgtactaccgcgtggacgccaaggacctctcggtaaggcagggcgcgtatctcgccgcgctgctccaggccccgaaccagtacgactgggccatcgcgacggacaccggcaagaagctggtgaaagaccgctggaactacgtgctggacaacatggtcgaggagcactggctggactccggcaagcgcgagggcatgacgttcccgacgcccaagcccccgagggcggcgcccggcatggaggggcagaccggctatctggtggacgcggccaacgcggcgctgatgaagcagctcgtcgcccagggcgccgcctccgacctgggcaccgccgaggcgatggtcaaggccggcggctggaccctcacgctcaacatcgacaagaagaagcaggaccagctggaggcggccgtcaaggcgaagctgaccagcaagctgaacgcgaagaagcgcccggtggacggcgacgtccaggccggcgccgcgtccgtcgacccgaagacgggcaaggtcctcgcgctctacggcggccagaactacgtcaagcactacctgaacaacgcgacccgccgcgactaccagcccgcctccaccttcaagccgctgatcttcgcggccgccctggacgagggagccagcacgcaggacggcaaggcgatcaacgccaacacgatctacgacggcacgagcaggcgccccgtcctggacaacggcgacaaggtcgggttcgcgccgcccaacgaggacaaccgcagctacggaaaggtcaccgtccagcgggccatgaacgcgtccatcaactccgtcttcgcgcagatgggcgtcgacgtcggcatggacgacgtgctgaaggtggcgggcaagctcggcatggacaccaagggtctcgaggcggtgcccgcgcagaccctcggctcgatgggcgcgagcccgctggagatggcggggatctacgcgaccctcgacaaccacggcaagaaggtcaccccggccgtcgtgaggtcggccgagcacaaggaccgtcaggtcaagttcccggacccgatcggcgaccgggtcatcacccgcgaggccgccgacacggtcacgtccgtgctgaccggcgtggtcgacgacggtacggcccagacctcggtggcccaggcggcggaccggcgcggccagcaggtcgcgggcaagaccggtacgtccgacagcaacaagtcggcctggttcaccggctacacgccgaacctggtcacctcggtcggtatgttcggcgagagcgcgaagaaccagagccaggtcaccctgaagggcgccacgggtctcatcccgggcagcggccgcatcaacggcggcggctatccggcgcagatctgggccgcgtacaccttcggcgcgatgggcaaggtcaccaagttcgacctggagaccacccagggcgcggcgatcgagcccaccgtgacgccgaccctcacccagtcgccgagcgactcgccctcgtcgtcgccgacgacgaagaagccgacgaccacgccgcccagcacgtcgacgaccccggcgagcccgtcgacctcgccgacgaccaaggggccgagcaacacgccgacgggtacgacgacgaccccgacggacggactgccggacgatccggtcaatccgaacgaccggaacggtctgaggaaccagaacgatccgacgagtcagtga

SEQ ID NO: 50047 - protein, 777 aa, Streptomyces avermitilis MA-4680
MGRAEERRARQRGGRRAAPQGSSRTAAKSAGAGKGRIRRLFTWKKILGTLFGLCLLGMGAFIVLYMMISVPKGNADAKLQSNVYEYSDGSPLARTGTRNREIVDLSEVPKGVQRTFVAAENKSFYKDSGVDFRGTARGLINTLSGKGKQGGSTITQQYVKNFYLSQDQTVTRKLKELVISLKVDRQKTKSQILAGYINTSYYGRGAYGIQAAAQAYYRVDAKDLSVRQGAYLAALLQAPNQYDWAIATDTGKKLVKDRWNYVLDNMVEEHWLDSGKREGMTFPTPKPPRAAPGMEGQTGYLVDAANAALMKQLVAQGAASDLGTAEAMVKAGGWTLTLNIDKKKQDQLEAAVKAKLTSKLNAKKRPVDGDVQAGAASVDPKTGKVLALYGGQNYVKHYLNNATRRDYQPASTFKPLIFAAALDEGASTQDGKAINANTIYDGTSRRPVLDNGDKVGFAPPNEDNRSYGKVTVQRAMNASINSVFAQMGVDVGMDDVLKVAGKLGMDTKGLEAVPAQTLGSMGASPLEMAGIYATLDNHGKKVTPAVVRSAEHKDRQVKFPDPIGDRVITREAADTVTSVLTGVVDDGTAQTSVAQAADRRGQQVAGKTGTSDSNKSAWFTGYTPNLVTSVGMFGESAKNQSQVTLKGATGLIPGSGRINGGGYPAQIWAAYTFGAMGKVTKFDLETTQGAAIEPTVTPTLTQSPSDSPSSSPTTKKPTTTPPSTSTTPASPSTSPTTKGPSNTPTGTTTTPTDGLPDDPVNPNDRNGLRNQNDPTSQ

SEQ ID NO: 50048 - DNA, 2226 bp, Streptomyces avermitilis MA-4680
  CDS (1)..(2226)
atgtcatcgcagactggtgcgttccggggacggcgcaagcccggggagtgcggcgtgaccgagccggaggccggagccggtccgcgccgccgtcgcgctgccccgaagcagccctggcaccgccgtgtcctcagctccttcacgacctcggcggacgcggaggcgggggccgcggagcgcccctcggcccggccggccgacggggcggccagtgcgcaccgccgcggcgcccgccgcaaggcggcggagcccacggcgatcgcgcgtgtcaccgtccgtctcacgccctacgcccgacggctcaagccggagtacccgcggccgggcctcgacggctggcggcgctggatgccctccgtgcgccagtggctggggatctgcctcgtctccctgggcctgagcggcacgttcctggccgtcgcctacgcggcgaccgacataccggacaacctgaacacgtacgccacccagcaggacaacgtctacttctgggccgacgggacacccatggcccgcaccggctgggtgcgtcggcaggcgatgccgctgaaggacatacccgaggatgtgcgctgggcggtcctggcggcggagaacgcgagcttctactccgaccccggcatctccgtcagcggcatcggccgcgcgctgtggcgcaccgtgggcgagggggacacgcagggcgggtccaccatcacccagcagtacgtgaagaacgtctatctgacccagaaccgctccgtgacccgcaagttcaccgaggcgatgatcgccgtcaagctggaccagcggatgagcaaggaccagattctggagggctacctcaacaccagctggttcggccgcggcacctacggcatccagcgcgcctcgcaggcctactacggcaaggacgtcggggaactcaacgccagcgaggccgccctcctcgcctccctgctcaagggagccggcctctacgaccccaccctgagccaggccaaccaccagcgggccgtggagcggtggaagtggatcctcgaccgcatggtggagctcggcaagctgtcgcccaccgagcgggccaagtacacgcacttccccgagccgaccaagcaggcgcagacgtacgacaccggcaaccagagcgactacctggtggagctggcggcccagtacgccaagaaggccggacacatctcggacaagcagttcgacctcggtggctaccagatctacaccaccttcgacaagaagcgggaggaggcgctcaccgccgccgtgaagaaggcccgcaagaaggcgcagaaggacgacaagggcaaggccgaaaccgcccactacgggggctcttcggtggctgccgacggccggatcctcgccgtctacggcggacccgatcaccgcaaacagggcttcaacgagtccaacgcctccaccgtcccggccggttcggcgttcctgccgttcgtctacgccgccgcgctggagcacggcgtgcacaaggaccgcggatccacgacgactcccgtcaccccggattccgtatacaacggtgacgacggcgtccccgtcaccacgcccgagggtccctactgggaccgcagcggcaagaaggtcgccgcccacaacgacggcggcacgtcctgggggcagatcacgctgcgcaaggcgctcgccgagtccgtgaacacccccttcatgcaactgggcatggacgccggcctggccacggtccgcgagaccgccgaggcgacgggcatgctgtcgtccagcatggggccgcaggtgcccaccctgtccctgggcacctcgacgcccagcgcgatccggatggccagttcctacgccaccttcgcggccggcggcacccacaccgcgccctactcggtgcgccgcgtcacccgcaacggctccaaggtcgacctcgacaccccgcgcccccgtcgcgcggtcggcgccgatgtcgcccgtcaggtcaccgacgcgctcacggactccttccgcacccaacaccccaccgcggcacccgcgtcggcgcaggtcgccgggaaggccggcacgacggacaaggacaccgccgcctggtacgtcggcacgaaccgctcggtctccaccgcggtggtcgtctaccggatggacctgaccaagagcctcgaacccctgccactgaaggggatcgccggtactcccgcaaccggcgtcccctacgacatctggtcgagtgccatgagtcccctcggctga

SEQ ID NO: 50049 - protein, 741 aa, Streptomyces avermitilis MA-4680
MSSQTGAFRGRRKPGECGVTEPEAGAGPRRRRAAPKQPWHRRVLSSFTTSADAEAGAAERPSARPADGAASAHRRGARRKAAEPTAIARVTVRLTPYARRLKPEYPRPGLDGWRRWMPSVRQWLGICLVSLGLSGTFLAVAYAATDIPDNLNTYATQQDNVYFWADGTPMARTGWVRRQAMPLKDIPEDVRWAVLAAENASFYSDPGISVSGIGRALWRTVGEGDTQGGSTITQQYVKNVYLTQNRSVTRKFTEAMIAVKLDQRMSKDQILEGYLNTSWFGRGTYGIQRASQAYYGKDVGELNASEAALLASLLKGAGLYDPTLSQANHQRAVERWKWILDRMVELGKLSPTERAKYTHFPEPTKQAQTYDTGNQSDYLVELAAQYAKKAGHISDKQFDLGGYQIYTTFDKKREEALTAAVKKARKKAQKDDKGKAETAHYGGSSVAADGRILAVYGGPDHRKQGFNESNASTVPAGSAFLPFVYAAALEHGVHKDRGSTTTPVTPDSVYNGDDGVPVTTPEGPYWDRSGKKVAAHNDGGTSWGQITLRKALAESVNTPFMQLGMDAGLATVRETAEATGMLSSSMGPQVPTLSLGTSTPSAIRMASSYATFAAGGTHTAPYSVRRVTRNGSKVDLDTPRPRRAVGADVARQVTDALTDSFRTQHPTAAPASAQVAGKAGTTDKDTAAWYVGTNRSVSTAVVVYRMDLTKSLEPLPLKGIAGTPATGVPYDIWSSAMSPLG

SEQ ID NO: 50050 - DNA, 2043 bp, Bacillus cereus ATCC 14579
  CDS (1)..(2043)
atgaaattgaagaacactcattttaaaaaaatgcttgagtggttcaataagaggaagaaacttcgtaattcattagttgtattgggaagtgtattcgttactctatttattgctgtaaatataataatttccattcaagacatatctgaattaaaacaagctgttccacaaccgactttaatttatgatgcaaataatgaggtcgcaactaaattagcttcttcgaaaacagaaggtgttaaaagaaaagatattcctgatattatggttcaggcaattgttgcagtagaagataaggaattttttaaccatcatggtatttattatagtggaattataagtgcggtttttaaaaatattacagcaggagaagttgtagcagggggaagtacaataactcaacaacttgcgaaaaatgtatttctgacacaagaccgcacatactcccgaaaaataaaggaatattttttaacgaaaaaaatagagcgcacgtatacgaaagatgaaatcattgaaatgtatatgaaccaaatttattttggtgaaggtgcttggggtataaaaagggcagctaaatcttattttgataaagatgtaaaagatttaacaatttcagaagctgcaacgattgcgggcttgattaaagcaccatctgcgtattcaccttataaaaactttaacaagtcaattgaaagacgtaatgtcgtattaagtttaatgaaagagcaagggtatatttctgacgaacagtataataaagaaaaagagagcggacttgtgttaaaacgtggcgttgatgataaatacaagggaaaatactctcaatatgtagactatattgttagagaggcgatggaaaagtacgaattaacacaaaatgaaattttagcgggtggttatcgtatttatacagagcttgacccgaaaaaacaacaggctgtagaagacgttgtgaataatgatagttatttcaaagatagtggctcagaccaacttatgcaaacgggtgtagttcttatgaacccaaaaacaggtggtgtaccagctctagttggaggcagagggccgtatcagtttttacagtttaaccatgcaacccaattaaaaagacaacctggctccacgttaaagcctttggctgtatatgtaccagcgttagaacaaggatatgaagtatacgatatattaaaagatgaaccatttaacattaaagaatataaaccacaaaatagcgatcatacttttcacggtgatgtgacaatgtatgaagctgtggcaaagtcgtacaatgtttcagctgtgtggctattagaacaaattggattagataaaggattgaaatctttagagcgatttggtatcccattagtgccagaagatcgtacgtatccgattgctttaggcggtatgcatgtggggacatctccatttgtaatggctcaagcatacagtacatttgcaaatgatggagtccaagtggaagctcatgcaattagggaggtacaaaatgctgaaggtgaaacgcttggaaagtggtataagaaagagacacgagtgacgagcgagaaaatttctcaaaagatgacatatttattaaaaggtgttgtcgaaaagggaacgggtgaaaaggcgaaagttaataatgttgatacggcaggtaagacaggaactactcaaattgtaaatggcccgagcaccggtgcaaaggattcatggtttgttggatacacgccagatttggtaggtgcgatttgggtaggatatgataaaacagatagcgatcattatgttccgggtggtagtcaaattacgacgacaatgttccgggatattatgaaaaaagcaaacgcaaatccagctcaaaaagcattccagttatcgctcatatctgaggctgattataaaaaacaattgactacaatagaagaggaaaaacgaagaaaagaagaagagaagagaaggaaagaagaggaacaacaacgaaaacaagagcaacaagagtggcttgataaagtgaaagaatggattccttcattttggtaa

SEQ ID NO: 50051 - protein, 680 aa, Bacillus cereus ATCC 14579
MKLKNTHFKKMLEWFNKRKKLRNSLVVLGSVFVTLFIAVNIIISIQDISELKQAVPQPTLIYDANNEVATKLASSKTEGVKRKDIPDIMVQAIVAVEDKEFFNHHGIYYSGIISAVFKNITAGEVVAGGSTITQQLAKNVFLTQDRTYSRKIKEYFLTKKIERTYTKDEIIEMYMNQIYFGEGAWGIKRAAKSYFDKDVKDLTISEAATIAGLIKAPSAYSPYKNFNKSIERRNVVLSLMKEQGYISDEQYNKEKESGLVLKRGVDDKYKGKYSQYVDYIVREAMEKYELTQNEILAGGYRIYTELDPKKQQAVEDVVNNDSYFKDSGSDQLMQTGVVLMNPKTGGVPALVGGRGPYQFLQFNHATQLKRQPGSTLKPLAVYVPALEQGYEVYDILKDEPFNIKEYKPQNSDHTFHGDVTMYEAVAKSYNVSAVWLLEQIGLDKGLKSLERFGIPLVPEDRTYPIALGGMHVGTSPFVMAQAYSTFANDGVQVEAHAIREVQNAEGETLGKWYKKETRVTSEKISQKMTYLLKGVVEKGTGEKAKVNNVDTAGKTGTTQIVNGPSTGAKDSWFVGYTPDLVGAIWVGYDKTDSDHYVPGGSQITTTMFRDIMKKANANPAQKAFQLSLISEADYKKQLTTIEEEKRRKEEEKRRKEEEQQRKQEQQEWLDKVKEWIPSFW

SEQ ID NO: 50052 - DNA, 2493 bp, Bacillus cereus ATCC 14579
  CDS (1)..(2493)
atgtcagaaaattatcgttctcgagaggaacgacgacaagttaaaaagaaaaaacaaccagcttctaaaacacaaaagccaaaaggtaaaacatcattctttcgcaagtttttaattacttgtttattacttggtattgttggtttagtggcgggggttgctacctttttcgtaatgattaaggatgcaccaaaacttgagaaagcaaaacttgttaatccgttatcctcaaaaatttatgataaaaacggggatttggtatatgaatatggaaaagaaaaaaggacgaatgttacgtatgagcaaatacctaaattagtagaaaatgcatttttagcgacagaagattcacgtttttatgagcatagcggagtagattttaaaggtactgcccgtgctgttctagtaagtcttaaaggggattatggttctcaaggtggaagtacgataacacagcaagttataaaaaactacttcttatcaatggacaaaacaccaaagcgtaaggcgcaagaaatatatttagcttataagctagaacaacagtattcaaaacatgaaatattagagatgtacttaaataaaattaacttaagaaaccgttcatatgggatcgcaacagcagcacaaaactactatggtaaagaattgaaggacttaacattaccagaagttgcgatgcttgcaggtttaccgaaagcaccgaataactatgatccaacgaaaaaagaaaatgttcaaaaagcaacagaaagaagaaatgttgttctaagtttaatgaaccgacatggatatataacaaaacaggaaatggaagaagcatcaaaagttgacgtagaaaaggggcttaagcctgcagctcaactacaaacaatgccataccctgcatttatggatgcagttgtgaaagaagtagaaaaagaattaccagatgctaatatcggttctgacggtttagaaatttatacaacgttagatccgaaagcacagaaacttgcagataatattttaaataataatatcattgattatccgaacgataaattccaaggtgcattcacatttatggatacgaaaacaggagaagttcgtgctataggtagtggccgtggagaaaataaagctgtatttaaagggcataatatggcaattgaattagatcgtgcagctggttcaacgatgaagccgattttcgactacgctcctgcaattgaatatttaaaatgggctacgtaccatcaaattgatgactctccatttaagtattcaacgggacaagaagtacgaaatgcagatagaagtcatatgggtccaattacaatgcgtgaagcattaaaaatgtcgcgtaatattcctgcaattaaaactgcaaaagaagtagggattagtaaatcgaaagaattctctgagaaactaggtattacatttaatacagcaccgacagaatcgacagcgattggtacaaatgaagtatcgccaactgaaatagcgggtgcttatgcggcatttggtaatgaaggtaaatatacgaaaccgcattttgttaagaaagtcgtttatccagacggtaagtcacaaagttttggacaaaaaccaaaacaagttatgacagattctacagcatacatgattactgatatgcttcgttctgtagttacatcaggtactggtacatcggcaaatgtaggctctttagatgtagctggtaaaacgggtacgacaaactattcatcaaagcaattagctcaatataaaattccagaaagtgcaactcgtgatagttggttcgctggatatacaccgcaatatacgatggcagtatggactgggtatatgaaagatggtaaagacgagtatattagtagtaaaaatacgaaaattgcacagttgatctttaaagaaatgatgagcgaaatggctacagataaatcacgctttaaaatgccaagtagtgttattcaagaaggtagtgagctacgtataaaaggtgaaaaacgtgattcatcgccaaatactagcgtaccggatacaacggagcaaccaaaacaagatcaacagcaaaaaactgaagaagagaaaaagcaagaagaattaaagaaacaagaagaactgaaaaaacaagaagaacaaaagaaacaagaggaacttaagaagcaagaagaacaaaagaaactagaagagcaaaagaaacaagaagaacaaaataatggaaatggccaaggaacgacacctccagcaaataacggaggaggtcaaggaaatacgacacctccagcaaataatggaggaggtcaaggaaatacgacacctccagcaaataatggaggaggtcaaggaaatacgacacctccagcaaataatggaggaggtcaaggaaatacgacacctccagcaaataacggaggaggtcaaggaaatacaactccaccagcgaccacacaaccagagactggcggtaatgcaggagagacccctgctaataatgggcaataa

SEQ ID NO: 50053 - protein, 830 aa, Bacillus cereus ATCC 14579
MSENYRSREERRQVKKKKQPASKTQKPKGKTSFFRKFLITCLLLGIVGLVAGVATFFVMIKDAPKLEKAKLVNPLSSKIYDKNGDLVYEYGKEKRTNVTYEQIPKLVENAFLATEDSRFYEHSGVDFKGTARAVLVSLKGDYGSQGGSTITQQVIKNYFLSMDKTPKRKAQEIYLAYKLEQQYSKHEILEMYLNKINLRNRSYGIATAAQNYYGKELKDLTLPEVAMLAGLPKAPNNYDPTKKENVQKATERRNVVLSLMNRHGYITKQEMEEASKVDVEKGLKPAAQLQTMPYPAFMDAVVKEVEKELPDANIGSDGLEIYTTLDPKAQKLADNILNNNIIDYPNDKFQGAFTFMDTKTGEVRAIGSGRGENKAVFKGHNMAIELDRAAGSTMKPIFDYAPAIEYLKWATYHQIDDSPFKYSTGQEVRNADRSHMGPITMREALKMSRNIPAIKTAKEVGISKSKEFSEKLGITFNTAPTESTAIGTNEVSPTEIAGAYAAFGNEGKYTKPHFVKKVVYPDGKSQSFGQKPKQVMTDSTAYMITDMLRSVVTSGTGTSANVGSLDVAGKTGTTNYSSKQLAQYKIPESATRDSWFAGYTPQYTMAVWTGYMKDGKDEYISSKNTKIAQLIFKEMMSEMATDKSRFKMPSSVIQEGSELRIKGEKRDSSPNTSVPDTTEQPKQDQQQKTEEEKKQEELKKQEELKKQEEQKKQEELKKQEEQKKLEEQKKQEEQNNGNGQGTTPPANNGGGQGNTTPPANNGGGQGNTTPPANNGGGQGNTTPPANNGGGQGNTTPPANNGGGQGNTTPPATTQPETGGNAGETPANNGQ

SEQ ID NO: 50054 - DNA, 2052 bp, Bacillus cereus ATCC 14579
  CDS (1)..(2052)
atggatcaaactatgaatccaaaacttaaaaaatataaacgtcttttcttcaccgcaatgttttcgtgcgtccttttcttcgttttttctttttttgttattattatagttgcaaaaattatgggacctcctcctgttgcggtcccgcaaacaagcgtcttttacgcaaacgatgatactgttattggacaaagtaacgaaattcaaaaacgttacaatgtctctcttaatgaaatttcaccttatgtaaaagaagcgaccctttctattgaagatcaaagattttataaacatcacggcttcgatgtgaaacggattgcaggtgcaattgttgctgatttaaaagcgatggcaaaggtacaaggagctagtacaattacacaacaatacgcgcgtaatctgtatttagatcatgataaaacgtggaaacgaaaattattagaggcaatgtacactatccgccttgaagtaaactataataaaaatcatattttagaaggatatttaaatacaatttattacggacatggcgcttatggcatcgaagctgcgtcccgtctatatttcgataaaacggcaaaagagttaacattagcagaagctagtatgctggcaggtatcccgaaagggccaagtgtctattctccctttttgaaagaggatcgcgctaaaggacgacaagctctcatattagatgaaatggtgaagcaaggatatattacgaagcaacaagcaaccttagcgaagaaagagacactaacttttgcctcattagatacgaaaaaagtagcagaggtcgcaccatatttccaagatgctgtacaagcttcgcttcttcgtgatgttggattagacgaacaagctttacaacgaggtggcttacgaatttatacaacgctagaccctaaactacaagctgtagcagaacaagctgtaaaagatcatatacctgacacaacaaacatacaaactgctctcgtctctatgaatccaacgacaggtgaagtggctgctcttgttggtggaactgattataatatgagtcaatttaacagggctacacaagccgttcgtcagcctggttctacatttaagccatttctatattatgcggcattagaacgaggattcacgcctgctacgcgcttaaaaagcgaatatactgtattcaccctaggtgacggcgtttcaaagtataaaccgaagaactataaagattattatgcagatgatttcgtaacgatggcacaagctctcgcagtctctgataacatttatgctgtgaaaacgaatttgtttttaggagatgacacgctagcaaaaacagcgaaacaatttggaattaaaagtgcattaaaagatgtgccttctctagctctcggtacatcaccagtaaaaccaattgaaatggttaacgcttatagcatgttcgcaaacggtggaaaagaagtaaaacctactttcattcgccgcattatggatcatgaaggaaatatattatacgatgctcatttagagagtaaacaagttctcgacaagagcaaagcatttgtaatggaagaaatgatgactggtatgtttaataagaaactaagcagttatgctgctgtaactggccaatcgatgttatcaaaattatcaagaacatatgccggcaaatctggttctactgaaacggatagttggatgatcggatttactccgcaaatcgtaacaggtgtatgggtcggatatgatcaaccaaaatctatttcaaacgtagcagaacaggggtatgcgaagaaaatatggactgatacgatggagaagggcttagatggacagcctaaaaaagaatttaaacaaccaagtgacgtcgtagcggttaatatcaatccagagaacggtaaaattgctacaaaaaattgtcctatttctgtgaaaatgtatttcgctaaaggtaccgaaccgactgaatattgtatggatcacgtcgatgataaagaagaatttgaaaaaacaactgaagaaaagaaaaaaacaagttggtggaaaaaatatcttccttggtaa

SEQ ID NO: 50055 - protein, 683 aa, Bacillus cereus ATCC 14579
MDQTMNPKLKKYKRLFFTAMFSCVLFFVFSFFVIIIVAKIMGPPPVAVPQTSVFYANDDTVIGQSNEIQKRYNVSLNEISPYVKEATLSIEDQRFYKHHGFDVKRIAGAIVADLKAMAKVQGASTITQQYARNLYLDHDKTWKRKLLEAMYTIRLEVNYNKNHILEGYLNTIYYGHGAYGIEAASRLYFDKTAKELTLAEASMLAGIPKGPSVYSPFLKEDRAKGRQALILDEMVKQGYITKQQATLAKKETLTFASLDTKKVAEVAPYFQDAVQASLLRDVGLDEQALQRGGLRIYTTLDPKLQAVAEQAVKDHIPDTTNIQTALVSMNPTTGEVAALVGGTDYNMSQFNRATQAVRQPGSTFKPFLYYAALERGFTPATRLKSEYTVFTLGDGVSKYKPKNYKDYYADDFVTMAQALAVSDNIYAVKTNLFLGDDTLAKTAKQFGIKSALKDVPSLALGTSPVKPIEMVNAYSMFANGGKEVKPTFIRRIMDHEGNILYDAHLESKQVLDKSKAFVMEEMMTGMFNKKLSSYAAVTGQSMLSKLSRTYAGKSGSTETDSWMIGFTPQIVTGVWVGYDQPKSISNVAEQGYAKKIWTDTMEKGLDGQPKKEFKQPSDVVAVNINPENGKIATKNCPISVKMYFAKGTEPTEYCMDHVDDKEEFEKTTEEKKKTSWWKKYLPW

SEQ ID NO: 50056 - DNA, 2010 bp, Helicobacter hepaticus ATCC 51449
  CDS (1)..(2010)
atgtggcatagaataaagcatagtctttttgtcatagctattattgttggaataggagcaggagcataccttatcaagcttttttatgaggttgagtctgaagtgagtaaaattacaaattaccaatttgctcttgcctcacagatagttgatagaaaagatagacttattgcaaatgtttttactgatgaaaactttagattctatgcaacttttgatgagataccgccacgtgtgattgaagcactgcttgcagtagaagatacgcttttttttgaacacataggcataaatcctgatgcaatttcgcgtgctatgcttaaaaacattaaaagtatgcgttatgtggagggaggcagcacacttacccaacagcttattaaaaatattgcacttagtccagaaaaaacgcttaagcgtaaaatcacagaagcaatgcttgctattcatattgaacgacatttgagcaaagagaaaattttggaactttatttaaatcgtatttcatttgggcatagttatcacggcattaaaacagcggctttggggtatttccataagagtttaaatgagctcacattaaaagagatttgtatgcttgtagggcttcctaaagcaccaagtttttatgaccctacaaaaaataaagaatactcaatggcacgtgctaatgacattattgatagactttatgatattggttggatatctacggaagaatatgaaaatgcaaacaaagaagtgccagaagtctttaaccaaacacttacccaaaatgttgctccgtatgttgttgatgaagtattacgtgagttagctcatattgaagatttaaaaacaggtggatattatattaggcttaagattgacttagattatcagcttgcggcacaagaagcaatggcatatggctatgatgaaattaataaacgtcttcacgagcgttatcctaaaatgtttgaaaatggggatttaaatgatgatacacttaatggcgcaatggttgttacagatacgcacacaggcgatattttagcaatggtaggtggcatagattatgtaaaaacaaaatttaatcgtgccactcaagctaaaagacagctcggcagttctataaaaccttttatttatcaaactgcatttgataggggagattctcctgctacttttgttcctgatgtgcctcgcaaatttgcaacaaaaggtgcagcagaagccgcctctgaagccactcaagaagagacagaatctaaagtatggagtccttcaaactatacaagtaaatttcacggatttatgacgcttaaagatgccttacgcacatcaagcaatcttgctacaattaatcttgtggatcaaaatataggttttaataatgtttatgcttcgcttaagcaagatggttttgaaaatctcccagagaatatgtctattgtgcttggcagttttgagctctcgccgcttgaagttgcgcagcagtattcaatgttttcaaattatggcacaattcttaagcctatgcttatagaatctaccattaataaaagtggcgagaatgtgtataactctcctgagcagacgcgtcatattactactgctgctcaagcatttttaactattgatattttacgtgatgttgttaatcgtggcacaggttcaagggcgcgcattgttggtttggaggtcgcagggaaaacaggaacatcaaatcgcaatgttgatgcgtggttttgtggattcactcctgatgtccaagcgattgtttggtatggacgcgatgataatacgcctataggtcctcacgaatctggtggtatagtcgctcctccagcatttgcatattttttctctaaagttttaacctttgacccgggtatttcaagacgttttaaagtgccagaaggtgtggggctaaagactcttgattatggagatttttattttacagaaaattcaccattgccaactaaaagacctgtggttgatattgatgaggaacttttattttag

SEQ ID NO: 50057 - protein, 669 aa, Helicobacter hepaticus ATCC 51449
MWHRIKHSLFVIAIIVGIGAGAYLIKLFYEVESEVSKITNYQFALASQIVDRKDRLIANVFTDENFRFYATFDEIPPRVIEALLAVEDTLFFEHIGINPDAISRAMLKNIKSMRYVEGGSTLTQQLIKNIALSPEKTLKRKITEAMLAIHIERHLSKEKILELYLNRISFGHSYHGIKTAALGYFHKSLNELTLKEICMLVGLPKAPSFYDPTKNKEYSMARANDIIDRLYDIGWISTEEYENANKEVPEVFNQTLTQNVAPYVVDEVLRELAHIEDLKTGGYYIRLKIDLDYQLAAQEAMAYGYDEINKRLHERYPKMFENGDLNDDTLNGAMVVTDTHTGDILAMVGGIDYVKTKFNRATQAKRQLGSSIKPFIYQTAFDRGDSPATFVPDVPRKFATKGAAEAASEATQEETESKVWSPSNYTSKFHGFMTLKDALRTSSNLATINLVDQNIGFNNVYASLKQDGFENLPENMSIVLGSFELSPLEVAQQYSMFSNYGTILKPMLIESTINKSGENVYNSPEQTRHITTAAQAFLTIDILRDVVNRGTGSRARIVGLEVAGKTGTSNRNVDAWFCGFTPDVQAIVWYGRDDNTPIGPHESGGIVAPPAFAYFFSKVLTFDPGISRRFKVPEGVGLKTLDYGDFYFTENSPLPTKRPVVDIDEELLF

SEQ ID NO: 50058 - DNA, 1818 bp, Prochlorococcus marinus subsp. marinus str. CCMP1375
  CDS (1)..(1818)
gtgaatgttgaatttcgaaattggctgttcataacaacaggcacactagccataggttcactcacagcaatatctgaagggttcataagtaaatccattgattcttttctaccaccttcaaataaagtaaatgtctttagtcgtcctagaactattgagttcttttcatcaaaaggagaaataattcagaagagagggccagttactcgtgagaaaatgacctcaggagcaatgccacaaattgtcaaagacgcatttatttcagcagaagataggcgtttctacaaacatgaaggtgttgatttttggagtattagtagagcattaatggcaaatatcaatgagaagtcattagttgaaggaggcagcacaattacacagcaattggcaagaataatcttcctcaatcaagatagaactataactcgaaaacttaaagaaattgctctggcattcaagctagaaagaaatttaactaaagaagaaataatcgagcaatatttaaataatgtctacttagggtctagtgcatatggaatctcagatgcagcgtgggtgtactttcaaaaagaccctagcgagttaacccttgaagaagccgctctaatagcaggattagctcctgcaccctcattatattcacctctagtgaacaccaatttagccctaaagcgtagagatattgtccttaaaaaaatgaggcttgaaaatttcatctcggattcagaattattaacagctttaagtagtccactaaatctaaaacctgctgctccaaaatttataaagagtaaagctccttttttcacaagctacgtagagcaaaagctccctcatctgttgtcaaaagagcaaatggagattggtggtcttaagatttacactagtattattcttgattggcaatcaaaagctcgagaaataactaaaactcaaagcccagataacgcggaaggtgcaatcgtctctattgaaccaagcactggactaattagagttcttataggaggaaaaaattataacaagaatcaatttaatagagcgactcaagcacttaggtcccctggctccacttttaaagtattcccatattcagctgctatcagcgagggctacaagccagaagacattctttttgacaccccaagatgctggtatgggtattgtccaaagaactttggtaataagtactttggggagatatcgctagtcaattcattctcaaattctttgaacactatagctgtcgatctactatcaaaagtagggtttaagaaagtaatatctattgctaatagactaggtgtaggaaatgaaagaaaacttggtcattattaccctttagcaataggggcatatgaagagacagtgcttaacatgactgcagcttatgcgggcattacaaacagaggtgtttatcataagccatcccctattaaagagataagaggacctgacaataaagttatatggagtcagagagctaataacaataaggggactagagcattagatgtcgacgtagctgacacaatgaactggatgttaaaaaaagttgtttcggaaggctcagggtttgctgcctcgatggaaggtcgagaagttgcaggaaaaactggaacttctgaaggggctcgagacctttggtttattggctcagttccacaactcacaactggcatttggtttggcaaagatgacaacgaagaaataaaaggtagtagtggggatgcagcactcgcttggaagaaattcatgaaaggaatagataaagacttattattgtcagattttcctgaaaggccatcttccccctaa

SEQ ID NO: 50059 - protein, 605 aa, Prochlorococcus marinus subsp. marinus str. CCMP1375
MNVEFRNWLFITTGTLAIGSLTAISEGFISKSIDSFLPPSNKVNVFSRPRTIEFFSSKGEIIQKRGPVTREKMTSGAMPQIVKDAFISAEDRRFYKHEGVDFWSISRALMANINEKSLVEGGSTITQQLARIIFLNQDRTITRKLKEIALAFKLERNLTKEEIIEQYLNNVYLGSSAYGISDAAWVYFQKDPSELTLEEAALIAGLAPAPSLYSPLVNTNLALKRRDIVLKKMRLENFISDSELLTALSSPLNLKPAAPKFIKSKAPFFTSYVEQKLPHLLSKEQMEIGGLKIYTSIILDWQSKAREITKTQSPDNAEGAIVSIEPSTGLIRVLIGGKNYNKNQFNRATQALRSPGSTFKVFPYSAAISEGYKPEDILFDTPRCWYGYCPKNFGNKYFGEISLVNSFSNSLNTIAVDLLSKVGFKKVISIANRLGVGNERKLGHYYPLAIGAYEETVLNMTAAYAGITNRGVYHKPSPIKEIRGPDNKVIWSQRANNNKGTRALDVDVADTMNWMLKKVVSEGSGFAASMEGREVAGKTGTSEGARDLWFIGSVPQLTTGIWFGKDDNEEIKGSSGDAALAWKKFMKGIDKDLLLSDFPERPSSP

SEQ ID NO: 50060 - DNA, 2343 bp, Candidatus Blochmannia floridanus
  CDS (1)..(2343)
atgataattaatcatgtgttgtatattatgcgttatagtatttatgtatttatatttattgtattattgataggtgtatatggggttattttagatacaaaaattcaaaatcgtattaatgggcaagtatggggattaccaactattgtatatagtcgtattgttcatgtagagccaaatatgtactgtagtcaagaagatatgattcgtttgttaaaaacgttgcaatatcgtgaagtatctaagattacgcgatcaggtgagtttattgtatatgataataatattgatttattgcgaagatcttttgattttcctaatatagaagaaaaagaaatttttgtttctttatattttaataaagataaattgatacgtatttataatcaaaatacaaaaaatgattttgggttgcttcgaattgatccaaaaatcatatctgttcaatatgctcctcaaggtcaacagagattatttattcctagatctaaatttccagatatattgatagatatgttgttatcggtggaagatagatatttttatcaacatgatggtattcgaatatctgctattatacgtgcttgtttagcaaatattgtatctggacatactgttcaaggaggtagtactattacacaacaattagtaaaaaatttgtttttaagtaatactcgatcgttgtggcgtaaatttaatgaaatatatatggcattactatttgaatatcgatatagtaaagatcgtattcttgagttatatctgaatgaaatatattttggtcaaaatggaaatgatcaaattcgtggttttcctttagctagtttttattattttggtagaccagtggatgaattaagtttggatcaacaagctatgcttattggtatgataaaaggagcatctttgtataatccttggaaaaatccaaagaaaactttagatcgtcgtaatttggtattaaaattattaaacaatgtacatgtaattgattcgaaattgtatgatgtacttatatctcgtccattagcagtgcagtcaaaagatgaagtattagcgttacatcctgcttttatgcaaatggtatgtgaagaaataaataatattagtaatatgtatagttttcatgatttatctggtttaagaatatttactacattagatcctattgctcaacaattagcggaaaaagcgatgaaaataggtatacgtagattacgacaacgttttgatgcggttgatttagagggggcggtagtgattatagataggtttagtggggtagttcgtgctatggtagggggagctgatccacatttttctggatttaatcgagctttatatgcacgtcgtcctattggatcattaattaaaccagctatttatcttactgcattaaatcaaccaaataaatatcatcttaatacatggattgctgatactcctattcatttacaacagtcaaatgggtttgtatggtcgcctagaaattatgatcgtcaatttcgaggtaaagtaatgttaatagatgcttttgtaaaatcacttaatattccaacagtgcatttaggattagtattaggtttggatactgttgtagattttttgataaagttgggtatttcttcgaatgctatttcttctttcccatctattttattgggggcaattagtttaacacctatggaagttgctcaggaatttcaaactattgctagtggaggccaacattctacgatgtcatgtatagattatattgtaaatacaaaaaatgtgattttatatcaatattttcctaaagttaaacgtgtggtttctcctcaatcagcgtatttagtaatgtatgctatgcaacaagttgtgacaaaaggaacatcttataatttgtctttaaaattttcttctttgaagttagctgctaaaactggtacaactaatgattctcgtgacagttggtttgttggtattgatggaaaagaagtagttgtaatttgggttggtagagataataatggtaaaactaagttaactggtactaacggagcattaaaattatatagtctttatttagatatgcaaagtaatcctattccattaaagttaacattgccaagtaatattgttcatattcctatagattatgctggaaatattcttccatataaggttggtaaaaattcttatgaatatattttaccaatatggagaaataatttttctttgttaccgtattttgataataaatcagaggtggtttcatataatcaagatgtgttagatttttcagaaaaacaggattgtcataatatggaggaatggataaatagtattcttgatgagtaa

SEQ ID NO: 50061 - protein, 780 aa, Candidatus Blochmannia floridanus
MIINHVLYIMRYSIYVFIFIVLLIGVYGVILDTKIQNRINGQVWGLPTIVYSRIVHVEPNMYCSQEDMIRLLKTLQYREVSKITRSGEFIVYDNNIDLLRRSFDFPNIEEKEIFVSLYFNKDKLIRIYNQNTKNDFGLLRIDPKIISVQYAPQGQQRLFIPRSKFPDILIDMLLSVEDRYFYQHDGIRISAIIRACLANIVSGHTVQGGSTITQQLVKNLFLSNTRSLWRKFNEIYMALLFEYRYSKDRILELYLNEIYFGQNGNDQIRGFPLASFYYFGRPVDELSLDQQAMLIGMIKGASLYNPWKNPKKTLDRRNLVLKLLNNVHVIDSKLYDVLISRPLAVQSKDEVLALHPAFMQMVCEEINNISNMYSFHDLSGLRIFTTLDPIAQQLAEKAMKIGIRRLRQRFDAVDLEGAVVIIDRFSGVVRAMVGGADPHFSGFNRALYARRPIGSLIKPAIYLTALNQPNKYHLNTWIADTPIHLQQSNGFVWSPRNYDRQFRGKVMLIDAFVKSLNIPTVHLGLVLGLDTVVDFLIKLGISSNAISSFPSILLGAISLTPMEVAQEFQTIASGGQHSTMSCIDYIVNTKNVILYQYFPKVKRVVSPQSAYLVMYAMQQVVTKGTSYNLSLKFSSLKLAAKTGTTNDSRDSWFVGIDGKEVVVIWVGRDNNGKTKLTGTNGALKLYSLYLDMQSNPIPLKLTLPSNIVHIPIDYAGNILPYKVGKNSYEYILPIWRNNFSLLPYFDNKSEVVSYNQDVLDFSEKQDCHNMEEWINSILDE

SEQ ID NO: 50062 - DNA, 1764 bp, Prochlorococcus marinus subsp. pastoris str. CCMP1986
  CDS (1)..(1764)
gtgaatgaaataaaatataaatattttatttttagctcatcgatatttattttctttgtcatatttttccccatatttaatttaattaggattactttaaattttgacccacttaaaatcaatacttcaaaatcaataccctattcttatgaaatattctcttctgataataaaacattaagaaaattaagtcgaaaattcgatgttcttgataatgcaaattcgataccattttttctaaagtattcttttatctcgggtgaggataaaagattttttaaccataatggaattgacttaataggtttatcaagagcgtttattagtaatattcagagcggatactttaaagagggtggaagcactattactcagcaagtagcaagattaattttcttaaataatgatttaagttttcaaagaaaaattaaagaaataataatttccttagttttagacttgaaattcagtaaaaatcaaattttaaaattatatttaaataatatttacttaggatcaggagcttatggtattaatgaagcctcccaagtttattttggaaaacttataactgaattatcattatctgaggttgccttagtagctggattagcacctgctccctcgatttattcgccttatgaaaatatcgatttagctattaaaaaaagaaataaaattttaaaagatatgtatattgatggctacatatctttggacgagagaaatgaagccttaaaggaaaaagttaatttaaattattcaataaataataaagattctaaagataatttattagtaaatttcatactcaaggaaacaaataacaaaatcaaaaatcataaaaagtacaaatttttacggataaaatcgagcatcaataaagattggcaggaaataggacaaaaaatttctaggtctatagggtctaataatattgaaacagcattgttatcaatagaatccaatagcggtttaattcgaacaatgataactagtaagaatccaacaataaacgaatttaatagagttacctcagccataaggcctttaggttcaacttttaaaattattccatatactgcagcattaaaagaaggtataaaattaagagataaattcgaagatttacctaagtgctgggaagactattgtcccaaaaatttttctgaaatttatcgaggtaagatatctttaatagattcttttaaaacctcttcaaatatagttcctctaaaaatttctagtaatataggtcttaaaaaaattataaaccaagctaatttatttggcctagggtatgaacaaccgcttgaagaatttctaccattagctatcggatcttatggagatagcctcctaaatattacaaatgcctatgcaactctgaatagcaatgggaatctatataagacaagcattcttgaaaaaatagaatcaaataataatgaattaatttgggaaaataaatttattcatgagaagatattagattccgaagtaaacaaaagcctaaataatctacttgaaaaatcagtttcggaaggtacttcgatagcagcctcaattaaaggagaaagagtatatggcaagacaggaacttcagacgggaacagggatctttggtttattggttcaattaataatcttactaccggagtttggataggttttgatgaaaacaaagaaactaagttatctagcggtaatgcagcttatttttggaaaaagttcataagtaaaatatatgatttagagatttaa

SEQ ID NO: 50063 - protein, 587 aa, Prochlorococcus marinus subsp. pastoris str. CCMP1986
MNEIKYKYFIFSSSIFIFFVIFFPIFNLIRITLNFDPLKINTSKSIPYSYEIFSSDNKTLRKLSRKFDVLDNANSIPFFLKYSFISGEDKRFFNHNGIDLIGLSRAFISNIQSGYFKEGGSTITQQVARLIFLNNDLSFQRKIKEIIISLVLDLKFSKNQILKLYLNNIYLGSGAYGINEASQVYFGKLITELSLSEVALVAGLAPAPSIYSPYENIDLAIKKRNKILKDMYIDGYISLDERNEALKEKVNLNYSINNKDSKDNLLVNFILKETNNKIKNHKKYKFLRIKSSINKDWQEIGQKISRSIGSNNIETALLSIESNSGLIRTMITSKNPTINEFNRVTSAIRPLGSTFKIIPYTAALKEGIKLRDKFEDLPKCWEDYCPKNFSEIYRGKISLIDSFKTSSNIVPLKISSNIGLKKIINQANLFGLGYEQPLEEFLPLAIGSYGDSLLNITNAYATLNSNGNLYKTSILEKIESNNNELIWENKFIHEKILDSEVNKSLNNLLEKSVSEGTSIAASIKGERVYGKTGTSDGNRDLWFIGSINNLTTGVWIGFDENKETKLSSGNAAYFWKKFISKIYDLEI

SEQ ID NO: 50064 - DNA, 1977 bp, Prochlorococcus marinus str. MIT 9313
  CDS (1)..(1977)
gtgactcgcaagcgccgtcactggattgttatttcagttagtgctgtcgccatcgggtgtgtcgcagccttggctgaaaggactctcactcatggcttggattcggttctgcccgatgcccggcggatagccaacttcaaccggccaggcaccatcacgctgctctccactgatgggcaggtgatccaaaagcttggtcccgcgacccgcgagaaggttgcgcaagacaagatgcctctgcttgtggagcaagccttcgtcgcggcagaagaccgacgcttttactaccacaatggcttggatatctggggtatcagccgagccctggtgacaaacctccgccagggttccgtgagggaaggtgccagcaccatcactcagcaacttgctcgaaccgtattcctgagtcaggaacgaaccctgccgcgcaaactcaaagaagctgctctggcctacaagctggagcgacagctcagcaaacagcaaatccttgagcagtatctgaattatgtctacttgggctcaggtgcttacggcgtagccgatgcagcctgggtgtacttctctaaatcccccaatcaactcacactgccggaagccgctctaatcgctggcatgccccctgctccctcagtttattcaccactggtcaaccagaaaattgccctagaacgccgcgcaattgtccttaaacgaatgcagcaggccggatttatctctgccagagaagccgatgcagctcgcgacagccccctcactctcaagccagcgataccgaagtacttcaacagcagcgcaccatttttcaccagctgggtagcccagcaactccccaatctgctcaccccagagcaactagaagtgggtggactcaagattcacaccagcctcaatctggcttggcaaaagcaagcccaagatgtgatcagcaaatacgcccccgggaacacagagggttccatggtgtctatcgaaccaagcaccggtgaagtgcgggtgatggtaggaggcaaaaactttaataccagccaattcaatagagcaacacaggctctgcgttcacctggctccaccttcaagctttttccctatgcagcagccatcaacgccggcatcaagccagaggacaaggttgtggacgcgaaacgctgctggagaggatattgcccaaagaacttcggcaacaaatacctgggatcagtggcactcgctgatgccctgagatactccctaaacactgttgcagtccaactactagacaaagtgggctttgatgccgtgatcagcatggccaataatcttggcatcggcaccactcgcccattaggcaagtactatccgctcgctattggggcctacgagcaaacagtactcgacatgacggcagcctatgccgcagtagccaaccggggcatttacatgaagcccacgccatttgaagagatccgaggcccagacgacgaggtgatctggaaccaccagttagaaggctacaaaggtcgtcgagccctcgatagcgacgtagcagacaccatgaactggatgctccagcgcgttgtcagcggtggcactggagctgcggcatccctcggtgaccggccagtagcgggcaaaaccggcacatcggaaggtgcccgtgacctctggttcattggctcaataccacaactaacaaccgccgtatggtttggctacgacaacaaccgaaagacatctggcggcagtggtgatgctgcatgggcctggaagcagttcatgaccaagatccaagacaattttgaggtacaacccttcccaccaaaaccagttatgaaccgcacctttaggccaccaggcaaaacgaggagcaaaccaaagaacggcagcgaggatgctgccaaagaccaagatcaaacccagggccctccacccagatacatcgcacctccagggggaccgccgctcaatgaaaacttcgagccaatgcctattccctga

SEQ ID NO: 50065 - protein, 658 aa, Prochlorococcus marinus str. MIT 9313
MTRKRRHWIVISVSAVAIGCVAALAERTLTHGLDSVLPDARRIANFNRPGTITLLSTDGQVIQKLGPATREKVAQDKMPLLVEQAFVAAEDRRFYYHNGLDIWGISRALVTNLRQGSVREGASTITQQLARTVFLSQERTLPRKLKEAALAYKLERQLSKQQILEQYLNYVYLGSGAYGVADAAWVYFSKSPNQLTLPEAALIAGMPPAPSVYSPLVNQKIALERRAIVLKRMQQAGFISAREADAARDSPLTLKPAIPKYFNSSAPFFTSWVAQQLPNLLTPEQLEVGGLKIHTSLNLAWQKQAQDVISKYAPGNTEGSMVSIEPSTGEVRVMVGGKNFNTSQFNRATQALRSPGSTFKLFPYAAAINAGIKPEDKVVDAKRCWRGYCPKNFGNKYLGSVALADALRYSLNTVAVQLLDKVGFDAVISMANNLGIGTTRPLGKYYPLAIGAYEQTVLDMTAAYAAVANRGIYMKPTPFEEIRGPDDEVIWNHQLEGYKGRRALDSDVADTMNWMLQRVVSGGTGAAASLGDRPVAGKTGTSEGARDLWFIGSIPQLTTAVWFGYDNNRKTSGGSGDAAWAWKQFMTKIQDNFEVQPFPPKPVMNRTFRPPGKTRSKPKNGSEDAAKDQDQTQGPPPRYIAPPGGPPLNENFEPMPIP

SEQ ID NO: 50066 - DNA, 2100 bp, Synechococcus sp. WH 8102
  CDS (1)..(2100)
gtgaaccgctcccgtctgcattgggccctcatcgccgcagctgcagcgggtgttggcgtcggtgctgctctcggaacacgggcgctgaccaagctgattgacgcggctctgccggatgcccgcggcatcgccaacttcaaccgcccgggaaccatcacgctgctctccacgcgggggcgcatcattcagaaactggggccagccacgcgcgacaagcttgagccgggctccatgcccctgctggttcaacaggcttttatcgccgcagaagaccggcgcttcttcgaccacgacggcgtcgatggctggggaattgcccgcgcggtggtcaccaacgtccggcagggatcggtgcgggaaggcgccagcaccatcacccagcagctggctcgcacggtctttctcagccaagaccgcaccatcgttcgaaaactcaaggaagcagccctggctctgaagctggaacgtcagctgagcaaacagcagatccttgagcagtacctcaactttgtgtatctcggatctggggcctatggcgtagcggatgccgcctggaactacttctctaaaacacccgatcagctcacgctgccggaagccgctctcatcgctggtcttcccccggcaccatcggtgtactcacccctggtgaatccagagctggcccggcagcaacggtccatcgtgctggagcggatgcgtcaggagggcttcatcaccagtgcttcggcctcagcggccaggaactcaccgctcaatctgaagccggccataccgaagtacttcaacagcgcagcaccgttcttcaccagctgggtggcccaggagctccccaaaatcgtcacccaggaacagctggaagtgggcggactcaaggtgcgcaccagcctcaacctcgattggcagacgaaggcccagcaggtcattcgtgagcatgccccattcgacaccgaaggtgccctcgtcagcatccaaccgggcaccggcctcgttcgcgccttggtgggagggaagagcttcggcaagagccagttcaaccgcgccacccaggcacttcggtctccgggttcgaccttcaaactctttccctacgcggcagctatcgatcgaggcatcaaacccgatgacatcttgctcgacgcgccccgctgctggcggggctactgccctaagaatttcggcggcaaatacttcggacccatttccctcgcagatgccctgaagaattcactgaacaccgtggccgttcagctgcaggacaaggtgggcttcgacgccatcatcgagatcgccaacggctttgacatcgggaccaaacgtccgctcgggaagtattacccgatggcaatcggggcctacgagcaaacggtgctggagatggccgcggcctatgccggtgtgacgaaccgcggggtattcgtgcaaccgacaccgttcgaagaaatccgcggtccgaaggatgaactgatctggagccgtcgcattgatggcgatcgcggccgtcgcgctctggatagcgaggtggctgatgccatgaactggatgcttcaacgggttgtgaccggtggaacaggcatcgccgccaaattggacaaccgccccgtagcgggcaaaacaggcacctcagagggaacccgcgatctctggttcatcggctcgatcccgcagctcacaacagctgtgtggttcggctacgacaacaacaaggaaaccaagagcaatagcggtgaagccgcctgggcctggaagcagttcatggtgcaaatcgaggacgagtttcctcagcagccattcccggcgaaacccattttgaaacgcccattccagcccccaggcaaggccaaacccaagaaaacagacaaaaaagtcccctaccgcggctacgactacgagaccaagcccgtctacacggccccacgctggaagcccgacccatcgatggctcctgcgcctgtccctctccctgacccggtccctgtcacccagccactttttgaccaaagtccaggcccttcagcttcaccggaagcaccaggtgagcctccggcggaggtgaacggccgccgcaactggctcaaaccgcagattcaacggcgctga

SEQ ID NO: 50067 - protein, 699 aa, Synechococcus sp. WH 8102
MNRSRLHWALIAAAAAGVGVGAALGTRALTKLIDAALPDARGIANFNRPGTITLLSTRGRIIQKLGPATRDKLEPGSMPLLVQQAFIAAEDRRFFDHDGVDGWGIARAVVTNVRQGSVREGASTITQQLARTVFLSQDRTIVRKLKEAALALKLERQLSKQQILEQYLNFVYLGSGAYGVADAAWNYFSKTPDQLTLPEAALIAGLPPAPSVYSPLVNPELARQQRSIVLERMRQEGFITSASASAARNSPLNLKPAIPKYFNSAAPFFTSWVAQELPKIVTQEQLEVGGLKVRTSLNLDWQTKAQQVIREHAPFDTEGALVSIQPGTGLVRALVGGKSFGKSQFNRATQALRSPGSTFKLFPYAAAIDRGIKPDDILLDAPRCWRGYCPKNFGGKYFGPISLADALKNSLNTVAVQLQDKVGFDAIIEIANGFDIGTKRPLGKYYPMAIGAYEQTVLEMAAAYAGVTNRGVFVQPTPFEEIRGPKDELIWSRRIDGDRGRRALDSEVADAMNWMLQRVVTGGTGIAAKLDNRPVAGKTGTSEGTRDLWFIGSIPQLTTAVWFGYDNNKETKSNSGEAAWAWKQFMVQIEDEFPQQPFPAKPILKRPFQPPGKAKPKKTDKKVPYRGYDYETKPVYTAPRWKPDPSMAPAPVPLPDPVPVTQPLFDQSPGPSASPEAPGEPPAEVNGRRNWLKPQIQRR

SEQ ID NO: 50068 - DNA, 2364 bp, Chromobacterium violaceum ATCC 12472
  CDS (1)..(2364)
atgctcagacgatttcttgctatcttggcaggcgtattcctaggtggcgtggtgttgcttgcgggtgccgccgcgattgcaatcatcataacctacccgcgcctgcaaagccttgatgtaatcacggattaccgtccgaaaattccgctccgcgtctactccgccgacaaccagctgttgggcgagttcggcgaagagcggcgttcgttttcccgcatccatgaagtgccgcagttgatgaagcaggcggtgctcgccgccgaggatgaacgcttctaccagcacagcggcatcgactatctcggcatcatgcgcgccgccgtcggcaacctggtgtccggacacgcgcgttccggcgccagcaccatcaccatgcaggtggcgaagaacttcttcctgtccagcgagaaaaccttcacccgcaagttcaacgaggcgctgctggcgttcaagatcgagcacacgctgagcaaggaccagatcctggagctgtatttcaaccagatctacctgggtcagcgcgcctatggcttcgccgccgccgcgcagacctactatggcaagtcgcttaacgatctgagtcccgcccagatggcgatgctggccggcctgcccaaggcgccatcggcgtacaaccccatcgtcaatcccgaccgcgccaagctgcgccagcaatacgtgctgcgccgcatgcgcgagctgaacttcatcacccaggaccagtacgagcaagcgctgaacgagccgctgcacctggccggccaggcggccgaaaccagccaacccggccagtatgttgcggaaatggtacgccaggcgatgtacgagcgttacaaggaagccgcttacaccgagggcttcaaggtctacaccacggtggacagccgccaccagaaatgggcgtacgacgcgctgcgcgccggcctgatcgactacgaccgcaagaccggctaccgcggcccggaaagcttcctcgacctgcccggcggtgacggcgaggacgccaccgaggcattggacgaggcgatgggcgatctgcgcgacagcggcgacatgctgccggccatcgtgctgtcggccagcccatccgaggtgcgcgcctatatgcgcggcggcaagatcgcgtccatcaagggcgcgggcctcgatttcgcgcgccgcgcgctgagcagcaaggcctcggcccagctgcagatccgccgcggcgcggtgatccgcgtgcaggccaatcccaagggctactgggagatcgtggagatgccggaagtggagggcgccttcgtgtcgctggacacccgcaccggcgcgatcaagtcgctgatcggcggcttcgacttcaaccgccgcagcttcaaccacgtgacccaggcctggcgccagccgggctcctcgttcaagcccttcatctattcgtcgggcatcgagcgcggcatcacgccgtccacgctgatcaacgacgcgccgctgtcggtgcccggcgtcaacggccagctgtggacgccgaagaacgacgacggcaagttctccggcatgatcaccctgcgccagggcctgacccggtccaagaacctggtgtcggtgcgcgtgctgatggcggtgggcaccgattacgcccagcagtacatccagcgttttggcttctccgccaagcagcaccccgcctatctgccgatggcgctgggcgcgggctcggtcacgccgctgcagatggtggagggctactcggtgttcgccaacggcggctaccgcaccaaggccttcttcattgaccgcatcgaggaccagtccggccgcgtgctggccaagaccgtgcccaccgtggccggccagaacgcccagcaggcgatcgacccgcgcaacgccttcatcatgcgttcgatgttgggcgacgtggtccgctacggcaccggcttccgcgcgatgagcctgggccgcaccgacctggccggcaagaccggcaccacctcggactggaaggatgcctggttcgtcggcttcaaccccaacctggtggccgccacctgggtgggcttcgaccagccgcgctcgttgggccgctacggctacggcggcaccgcggcgctgccgatctggatcaactacatgggcaacgccttgaaggggcagccagaagtggagctgccggtgccgcagggcatcgtggtgaaaccgggcgccggccagcgcggcggcgacgagtactactacgaagaattccagaagaccaatccggaactgcgcatcgacaaccagggcacggtgccgggcggcgagggcgacgccagcgcgccgcaggcggataccgacagcggcaagcccgccgcccaggacgcggtggagaacgtcaaggatcagctgttctga

SEQ ID NO: 50069 - protein, 787 aa, Chromobacterium violaceum ATCC 12472
MLRRFLAILAGVFLGGVVLLAGAAAIAIIITYPRLQSLDVITDYRPKIPLRVYSADNQLLGEFGEERRSFSRIHEVPQLMKQAVLAAEDERFYQHSGIDYLGIMRAAVGNLVSGHARSGASTITMQVAKNFFLSSEKTFTRKFNEALLAFKIEHTLSKDQILELYFNQIYLGQRAYGFAAAAQTYYGKSLNDLSPAQMAMLAGLPKAPSAYNPIVNPDRAKLRQQYVLRRMRELNFITQDQYEQALNEPLHLAGQAAETSQPGQYVAEMVRQAMYERYKEAAYTEGFKVYTTVDSRHQKWAYDALRAGLIDYDRKTGYRGPESFLDLPGGDGEDATEALDEAMGDLRDSGDMLPAIVLSASPSEVRAYMRGGKIASIKGAGLDFARRALSSKASAQLQIRRGAVIRVQANPKGYWEIVEMPEVEGAFVSLDTRTGAIKSLIGGFDFNRRSFNHVTQAWRQPGSSFKPFIYSSGIERGITPSTLINDAPLSVPGVNGQLWTPKNDDGKFSGMITLRQGLTRSKNLVSVRVLMAVGTDYAQQYIQRFGFSAKQHPAYLPMALGAGSVTPLQMVEGYSVFANGGYRTKAFFIDRIEDQSGRVLAKTVPTVAGQNAQQAIDPRNAFIMRSMLGDVVRYGTGFRAMSLGRTDLAGKTGTTSDWKDAWFVGFNPNLVAATWVGFDQPRSLGRYGYGGTAALPIWINYMGNALKGQPEVELPVPQGIVVKPGAGQRGGDEYYYEEFQKTNPELRIDNQGTVPGGEGDASAPQADTDSGKPAAQDAVENVKDQLF

SEQ ID NO: 50070 - DNA, 1920 bp, Wolinella succinogenes DSM 1740
  CDS (1)..(1920)
atgaaatatcttttcgcgctccttgtcgcgctcttccttggcgccgctttcatgcttgcccgtttttacaacgatattcgctttgaggtggacaagatcgtccactacgaatcacccatgacgactcaaattcttgaccgaaaagggcgattagtcgccaatctttttgaacatgagtttcgattctattcaccctttgaggagattccccctagaatcatcgaagccctagccgccgtggaggacaccctcttttttgaacatggaggaatcaaccttgatgcgatctctcgcgccatgatcaaaaacatcaaaagcggtcgctacaccgaaggggggagcactatcactcaacagctcatcaaaaatgtcgccctctcgcgcgaaaaaagcctagagcgaaagctcaaagaggcgctattggccattcgccttgagaccgttctctccaaagaggagattttggagcgctatctcaatcacacctattttggtcacggctactatggaatcaaagccgccgctagaggctatttcaaaaaagatatggatcgcctaagccttaaagaggttgcgattcttgtcggactcccccgtgcacccagcttctatgatcccaccaaaaatctcgaattctccctaggtcgcgccaacaatatcctccaaaggatgcactcgctaggctggatcaccgatgaggagctagacctatctattggcgaggtgcccatcgtctataacgaaacactcacccaaaatatcgccccctatgtcgtggatgaggtgctcaaggagcttcgctacatcgaagaccttaaaagcggcggctacacgattcgcctcaacatcgacctagactatcaagagatcgccaaagaggcgctcacctttggctatgagcagatcaaggcgcgccgcaaaaaggatgactccgatacgctcaatggtgctatcgtggtgctagaaaatcgaacaggcaagattctcgcgatggtcgggggcgtggactaccgtaaaagcaccttcaatcgcgccactcaatccaaacgccagcctggaagtagcttcaagcctttcatctaccaaaccgcactcgatttaggctatgcgaccaattcgcctctagcggatatcgctcgcacctacgaatacaccgccaatgatgaggccaaagtatggcaacccaaaaactacggcaacacctttagcggaatcgtccccctcaaagaggcactcgtcaagtcgctcaacctcgccaccatcaacctcgtggaggaggtaggctttgagcgaatctatcgcaaaagcctcacctatggcttcaacaacattcccaagaacctctccatcgccctaggaagctttggtgtctctcccttggagatgagtcgtgcttacaccctcttctccaattatggcacgatgatgtcgccccgcctcatcgagagtatcaccgactatcgcggcaaaaccctctcctttgatctagaatccaaagtgatcactccacccgaacagagcttcttgatgattgatgtcatgagggaggcggtcaacaaggggacgggtcgaagagctcgcgtgaatggaatcgagattgcaggaaaaacaggctcgactaacgaaaatgtggacgcgtggttttgcggattcaccccaacaatccaaaccgtcatctggtatggcagagacgacaacacacctattggccacaacgaaacaggaggggttgccgcagcgcccgccttctcctacttttttgagaaactgctaaagatcgaaccgggaatcaagcgagagtttgatgtgccacgcaatgtccatcgcatcattaaagatggagagctctactactacaccgacacctccaagcccaaagaggaggcgccgagtatgaaagaggagaatctaatcttttag

SEQ ID NO: 50071 - protein, 639 aa, Wolinella succinogenes DSM 1740
MKYLFALLVALFLGAAFMLARFYNDIRFEVDKIVHYESPMTTQILDRKGRLVANLFEHEFRFYSPFEEIPPRIIEALAAVEDTLFFEHGGINLDAISRAMIKNIKSGRYTEGGSTITQQLIKNVALSREKSLERKLKEALLAIRLETVLSKEEILERYLNHTYFGHGYYGIKAAARGYFKKDMDRLSLKEVAILVGLPRAPSFYDPTKNLEFSLGRANNILQRMHSLGWITDEELDLSIGEVPIVYNETLTQNIAPYVVDEVLKELRYIEDLKSGGYTIRLNIDLDYQEIAKEALTFGYEQIKARRKKDDSDTLNGAIVVLENRTGKILAMVGGVDYRKSTFNRATQSKRQPGSSFKPFIYQTALDLGYATNSPLADIARTYEYTANDEAKVWQPKNYGNTFSGIVPLKEALVKSLNLATINLVEEVGFERIYRKSLTYGFNNIPKNLSIALGSFGVSPLEMSRAYTLFSNYGTMMSPRLIESITDYRGKTLSFDLESKVITPPEQSFLMIDVMREAVNKGTGRRARVNGIEIAGKTGSTNENVDAWFCGFTPTIQTVIWYGRDDNTPIGHNETGGVAAAPAFSYFFEKLLKIEPGIKREFDVPRNVHRIIKDGELYYYTDTSKPKEEAPSMKEENLIF

SEQ ID NO: 50072 - DNA, 2121 bp, Gloeobacter violaceus PCC 7421
  CDS (1)..(2121)
atgaccgccaagttttttgcgtccatggccgatacctggcgccgccatcgccgagcgtggtttatcggcattgtcgtcacgctcgccggggcgctgctgggcctgtggtttgccctgctgtgggatctgcccaccgcccagcaggtacgccgctttacccccgaaaaccggctcatcgtcaaggcgatggacggatcgcgcctctacagcgccgcccggggtccggccaagcaggtcaagtaccggcaaatacccgaatacctggtccaggcggtcgtcgccaccgaggaccggcgcttctacaaccatcccggcatcgatctgatcggcatcggccgggcgctgtggcgcgacgcggaggcgggggaggtgcgcgagggcggctcgaccatcacccagcaattggcgcgcaatttgtttttgacccaggagcgcaccctctggcgcaagttcaaagagatcctgatcgccgcgcgcatcgagcaggagttgtccaaagcagaaattctcaccctctacctcaaccagatctatttcggctccggcgcctacggtgtcgcggacgcggcacgtctatatttcagcaagaacatcgagaagctcaccctcaccgaagcggcgctgctcgccggtttgccccaggcccccagccgctactcgccgctaatcgacaagaccctggcgcgcaagcgccgcgatgtggtgctcaagaacatggtcgaggtgggatatctaaatgcacagcagtacgcctcggcccgcaaaaagtcggtggtgctcagacccggcccccgctccgaaaaaacccaggccgcctacttcgtcgattacgtgcgctcgcagctggcgagcctgcttggcaccgagagcgttccgggggggctgaccatcgagacgaccctcgacccacagatgcaggcgcaggcccaaaaagcgctcggcggtgcgctggccgattaccgctcccggcgcgtcggccagggggcgatcatcaccctcgacccggccacgggcgaaattcgggcgatggcaggcggcggcgactatcaaaaaagccagttcaaccgcaccgtgcaggccctgcgccaaccgggttcgacgttcaaaacctttgtctacaccgccgctatcgaatccggcagccgcccggaggacatactaagcgaccggccggtccgcttcggcgcctatcaggtcaaaaatgccgatcgccgctactacggcgagatgacgctggtgaacgcccttaaagaatcgcgcaacactgtcgcggtacaactgtttacgcgcgtgggcgaggacaaagttgtcgatgtcgcccgccgcatgggggtgcgcagccgcctgcgcacgggggcggcgatggccctcggggcctcggagctgacgctgctggaactcaccagcgcccacggcaccctcgccaacggcggagtccatgtggcacccaccgccgtgcgccgcattgtcgattcgcaaggcaaagtactctacgcggcggtaccgcgcacccgggtggctctttcttcggcggtcgccgccaccgtcacccgcatgctggagcaggtcatcgccaacggcaccggccgcaaagccgccatcgatcgcccggcggcgggcaagaccggcaccagcgaaaactaccgcgacttactttttgtgggctacacgccccaactggtgacgggcgtctggctgggcaacgacgacaatcgcccgacgcgcggcagcagcgccctggcagccgttctctggggccggtacatgggccgggtgatggcgacttttccggtcaaggcatttcctgccctggagcagagcgaaccgctcgaagtctcgccgccgatgggtgaggagtacccggccgaattgcctgagggtctggaggagccttcccccgagcccgagccgaccggcgaatgctacgagagcgatcaaggtcaactcgtctgcccgaacgaaaccgacagcgcggcctcccccgcaacggccgaaccgccccccgaggtgccggatattcccgagtcacccgcatcgccgcaaaatccggaagagcccgccgaaacgaacccttcgcggccctcggccgaactggatcgtccgccggcaccgacgccttag

SEQ ID NO: 50073 - protein, 706 aa, Gloeobacter violaceus PCC 7421
MTAKFFASMADTWRRHRRAWFIGIVVTLAGALLGLWFALLWDLPTAQQVRRFTPENRLIVKAMDGSRLYSAARGPAKQVKYRQIPEYLVQAVVATEDRRFYNHPGIDLIGIGRALWRDAEAGEVREGGSTITQQLARNLFLTQERTLWRKFKEILIAARIEQELSKAEILTLYLNQIYFGSGAYGVADAARLYFSKNIEKLTLTEAALLAGLPQAPSRYSPLIDKTLARKRRDVVLKNMVEVGYLNAQQYASARKKSVVLRPGPRSEKTQAAYFVDYVRSQLASLLGTESVPGGLTIETTLDPQMQAQAQKALGGALADYRSRRVGQGAIITLDPATGEIRAMAGGGDYQKSQFNRTVQALRQPGSTFKTFVYTAAIESGSRPEDILSDRPVRFGAYQVKNADRRYYGEMTLVNALKESRNTVAVQLFTRVGEDKVVDVARRMGVRSRLRTGAAMALGASELTLLELTSAHGTLANGGVHVAPTAVRRIVDSQGKVLYAAVPRTRVALSSAVAATVTRMLEQVIANGTGRKAAIDRPAAGKTGTSENYRDLLFVGYTPQLVTGVWLGNDDNRPTRGSSALAAVLWGRYMGRVMATFPVKAFPALEQSEPLEVSPPMGEEYPAELPEGLEEPSPEPEPTGECYESDQGQLVCPNETDSAASPATAEPPPEVPDIPESPASPQNPEEPAETNPSRPSAELDRPPAPTP

SEQ ID NO: 50074 - DNA, 2193 bp, Gloeobacter violaceus PCC 7421
  CDS (1)..(2193)
gtgtcgatagtacgccctggcggtgcgggccacagaagcgatcccgcttccccgaagcggtgcaggcgcgccccaggctgcagaagtataatcaataggcttttgcatcacgaccgggcattgactacggaaacgaatccttccgccaatgtgcagcacccacgcaagtcgcctgtgaactggcgcctggtgggttggatattgatggccctggcactgtcggtcggagcgctcgccaccggcgcgctggtgggtctggctttgagcttccgcaacctgcccgaggtgcagcagttgaaggcgtacgtgcccaccggcgccacccgcatcaccgacatcaacggccaaccgatcgcgattatccgcagcgagtacaaccgcaaggtggtccccctgggacagatttccaagcacctgcagcgggcggtgctcgccatcgaggacgaccgcttctacgaacaccccggcatccgcatcgacactctggcgcgcgccgccctcgccaactttcaggagggccgcaccgtccagggcggttcgaccatcacccagcagctcatcaagaatttgtttttgacccccgagcgctcgttggagcgcaaagtggccgaggcggtcctcgcgctgcgcatcgagcaggccttcggcaaagaccagatcctggagatgtacctcaatcaggtctactggggcaacaaccgctacggcatcgagaccgcgagccgcgcctacttcaacaaacccgccaagagcctcaaccttgccgaatcggcgatgctcgccggtatgctgcgcgcccccgaaatctattcgccccagcgcaaccgcgcaaagaccgtcgagcgccagcgggtggtgatcgcccggatgctggagttgggctggatcacccaggcggaagccgaccaagcccgctcgagcgctctggtcttcaaaggtggcgacgccgattttatgatcacccgggcgccctacttctccagttacgtcgtgcgcgaattgatccgcaagtacgggcgcgacgccgtgctcaagggcggcctgcgggtgcagaccagcatcgacctgaagatccagaagctggcggaacagaccgtcgcccgggcggccaaaaacatccgctaccgccgggcggagcagctggccctggtggcgatggacccgcgcaccggctatatcaaggcgatggtggggggcgtcgattaccaaaaaagccagtacaaccgcgcttcccaggcttcgcgccaaccgggttcgaccttcaaacccttcgtctactacgccgcgcttgccaccggccgctatacccccgaaacacccatcaccgactcgcccgcctgcttcggcggctactgccccaaaaactacgacctgcgctactccggcgggatgtctttgcggcaggccatggccgtctcgcgcaacgttccggtcgtcaagctcgccaacaccatcggcatgaatcaggtgatcctggcggcccgccgcgccgggatcaccgcccccctgcagcccaacctcgccacctcaatcggcgccggcggcatctcgccgctggaattggcgcgcggcttctcggccttcgccaacggcggttaccgcgtcgatgccaccgccatcctccaggtcaccgaccaacagggcaacatcctggagcagaacctgcccgtgcgcgagcgcaccctcaaatccgcaccggtcaagatgatcaattcgatgatgatgagcgtggtgagcggcggcaccggtacgcgggcgcaactgcccgacggcaggccggtggcgggcaagaccggcaccacccaggattttcgcgacgcctggttcgtgggctacgtgccccaactggtgtcggtcgtctggatcggcaacgacgactaccgccgaccgatggcccgctcgaccgcgggcggcacctacgtggcccccatctggcgctcgtttatggcctcggcgctgcgcggccagccggtgctgcccttcccgggcttcgagcccagcgagaaacccgccgacgccaagggcaaaggcgcccaacttgacgaagcggcggcagaggcgaagcccaaaccgcgccgccgccgtcgccgccgccccgcccccgaaacggacgctccccagccacgggaagcagcccttcccctcaaagccgccgagccggccccggcggagcccgctccagccgatccctaa

SEQ ID NO: 50075 - protein, 730 aa, Gloeobacter violaceus PCC 7421
MSIVRPGGAGHRSDPASPKRCRRAPGCRSIINRLLHHDRALTTETNPSANVQHPRKSPVNWRLVGWILMALALSVGALATGALVGLALSFRNLPEVQQLKAYVPTGATRITDINGQPIAIIRSEYNRKVVPLGQISKHLQRAVLAIEDDRFYEHPGIRIDTLARAALANFQEGRTVQGGSTITQQLIKNLFLTPERSLERKVAEAVLALRIEQAFGKDQILEMYLNQVYWGNNRYGIETASRAYFNKPAKSLNLAESAMLAGMLRAPEIYSPQRNRAKTVERQRVVIARMLELGWITQAEADQARSSALVFKGGDADFMITRAPYFSSYVVRELIRKYGRDAVLKGGLRVQTSIDLKIQKLAEQTVARAAKNIRYRRAEQLALVAMDPRTGYIKAMVGGVDYQKSQYNRASQASRQPGSTFKPFVYYAALATGRYTPETPITDSPACFGGYCPKNYDLRYSGGMSLRQAMAVSRNVPVVKLANTIGMNQVILAARRAGITAPLQPNLATSIGAGGISPLELARGFSAFANGGYRVDATAILQVTDQQGNILEQNLPVRERTLKSAPVKMINSMMMSVVSGGTGTRAQLPDGRPVAGKTGTTQDFRDAWFVGYVPQLVSVVWIGNDDYRRPMARSTAGGTYVAPIWRSFMASALRGQPVLPFPGFEPSEKPADAKGKGAQLDEAAAEAKPKPRRRRRRRPAPETDAPQPREAALPLKAAEPAPAEPAPADP

SEQ ID NO: 50076 - DNA, 2457 bp, Photorhabdus luminescens subsp. laumondii TTO1
  CDS (1)..(2457)
atgtctggtgaagatcgtcaaccaatcggacgtaaaggcaaaaaatgggtatcccgccgtaaacggtcaataaaaagacggtatctgttggatgatgataatggctatgaagatgaggactacgatgatgaagaggatcaactcatgacaaagaaaggaatgtattcccgtccacctaagaaaaagtggcgttggttctggttgttattcaagatattcattatttttgccgtattattggcggcttatggtgtctatctggatgccaaaatccgcgatcgcattgatgggagagtctgggaattacctgcggcggtctatggccgcatggtcaatcttgaaccgggcatgaactacagtaagaaagagatggtacatctgctggaagggatgcagtatcgccaggtgacgaaaattacccgtcccggagagttttctgtcagaggtgaaaccattgaaatgttgcgtcgtccgtttgatttcccagacagcaaagaggggcagatccacgctctgctaactttcagtgataaccgtttggcggggatcgaaaatctggaaaatcagcgtcagtttgggttcttccgccttgatccgaagctgattaccatgttgcagtctcccaatggggagcagcggctatttgtgccgcgttctggtttccctgatttactggttaacaccttgctggcgacggaagatcgccatttctatcaacatgatggcatccgtattctttccattgggcgtgcagcactggctaacttgactgccgggcgcacggttcaggggggaagtaccctgacgcaacaattggtgagaaacctgttcctgaccaatgaacgcactttggtacgtaaagctaatgaagcctatatggctgtgctgatggattatcgttacagcaaagatcggattctcgaactgtatctgaacgaagtttttttaggccaaagtggtgatggggagatccgaggatttccgctggcgagcctctactattttggtcgtcccgtggatgaattgagtttggatcaacaggcgttgctggttggtatggtgaaaggcgcttcactctataatccgtggcgcaatcctaaactcactctccagcgtcgtaatgtggtgctcaagctgttacaaaaccagcaaattattgatgaagatctttataaattattaagtgctcgtccactgggggtaaaaccgaaaggtggtgttattaccccgcaaccggcgtttatgcagctcgttcgtaaggagttgcaggacaaactgggggatagagtgaatgatctgtccggcgtgaaaatcttcactactttggacccagtatctcaagatgcggctgaaaacgcagtagaagaggggattgccagtctgagaaaaactcgcaaaattgctgaccttgaaggagcaatggtaattgtcgatcgcatcagtggtgaaatcagggcgatggttggtggttctcaaccgcagtatgctggatttaaccgagcaatgatggcgcgtcgttcaattggttcactggcaaaaccttcgacttatttggcggcattgagtgagcctgatcaatttcgactgaatacttggctgtcggatgaacctcttgcggtaaaacagccgaacagcaaggtttgggaaccgagaaattatgaccgtcgtttccgtggacgtgtcctgttgatagatgggctggcgaattcattgaatattcctacggtgaatcttggattggcagttggtcttgatcatgtcagcaacacattgatccggcttggcgtaccggaggaagtgattcaacaggttccagccatgttactgggttctcttagcttgacacctttagaagtggcgcaggaataccagacgatgacgagtggcggcaatcgtgcgacgctttccgcgttacgttctgtcatcgcggaggatggcaccgtgatatatcagagttacccacaggctgaacgggctgtaccggctcaggcggcttatctgacgctatatggtatgcagcaggtggtggcgaatggaacttctcgttctctgaatgctaagtttggtcgttataatctggcgggtaaaacgggcactaccaatgatctgcgtgatagctggtttgccggaatcgatggtaaagaagtggtgatcgcatgggttggtcgcgataacaacggaccgaccaatctgacaggcgctacaggggcgttgaatgtatatcgccgttatctggaaaatcagacgccgctgatgttgaataacattccaccggaaggcattgtcgatatggcggttaatcaggatggcagctttagctgtagtggcagtggttggcgaacattaccggtttggacttatgatccacagagtttgtgccaacaaacagcggtatcagcaccggttcaacagcaagaagaagcaccgggctggttgcgagagatgtttggccaataa

SEQ ID NO: 50077 - protein, 818 aa, Photorhabdus luminescens subsp. laumondii TTO1
MSGEDRQPIGRKGKKWVSRRKRSIKRRYLLDDDNGYEDEDYDDEEDQLMTKKGMYSRPPKKKWRWFWLLFKIFIIFAVLLAAYGVYLDAKIRDRIDGRVWELPAAVYGRMVNLEPGMNYSKKEMVHLLEGMQYRQVTKITRPGEFSVRGETIEMLRRPFDFPDSKEGQIHALLTFSDNRLAGIENLENQRQFGFFRLDPKLITMLQSPNGEQRLFVPRSGFPDLLVNTLLATEDRHFYQHDGIRILSIGRAALANLTAGRTVQGGSTLTQQLVRNLFLTNERTLVRKANEAYMAVLMDYRYSKDRILELYLNEVFLGQSGDGEIRGFPLASLYYFGRPVDELSLDQQALLVGMVKGASLYNPWRNPKLTLQRRNVVLKLLQNQQIIDEDLYKLLSARPLGVKPKGGVITPQPAFMQLVRKELQDKLGDRVNDLSGVKIFTTLDPVSQDAAENAVEEGIASLRKTRKIADLEGAMVIVDRISGEIRAMVGGSQPQYAGFNRAMMARRSIGSLAKPSTYLAALSEPDQFRLNTWLSDEPLAVKQPNSKVWEPRNYDRRFRGRVLLIDGLANSLNIPTVNLGLAVGLDHVSNTLIRLGVPEEVIQQVPAMLLGSLSLTPLEVAQEYQTMTSGGNRATLSALRSVIAEDGTVIYQSYPQAERAVPAQAAYLTLYGMQQVVANGTSRSLNAKFGRYNLAGKTGTTNDLRDSWFAGIDGKEVVIAWVGRDNNGPTNLTGATGALNVYRRYLENQTPLMLNNIPPEGIVDMAVNQDGSFSCSGSGWRTLPVWTYDPQSLCQQTAVSAPVQQQEEAPGWLREMFGQ

SEQ ID NO: 50078 - DNA, 2181 bp, Corynebacterium diphtheriae NCTC 13129
  CDS (1)..(2181)
ttggcagattcaggtaaaggcaagccatctcccaagcggaagaaggccagtgccaaaagtagcgcgaaaagtcgtccggcacgggcaccgcaggcgcgtcgcccgaaaaagaagtgggttaagccagttattggcggcagtattgctgctgtactgctggcccccttccttgcgttcatggtcgcatatattgtgaccgatgttcccgagcctagcgagctggtgaccaaacaggtttcacagatttttgcctccgacggtaaaacgcagctggcgcgtatcgtgccaccggacggaaaccgcaccgaggtgcctatcgacaagatccccgaggttacccgcaacgcagtcctcgcagccgaagaccgtgagttctacaccaactccggtttctcctttactggctttggtcgtgctatcttgggccagctcaccggtgacgcttccgccggtggtggttcgacaattacccagcagtatgtgaagaacatggtggtgggcaatgactactcctacatgcgtaaagcaaaggaactggtgtactccgtcaagatggccaatgaatggtccaaagacgaagttctcggtgcatatctcaataccatttacttcggccgcaatgcctacggtatcgacgctgccgcccatgcctactttggtgttccagcttccgaactcaacgtaggacagtccgctatgttggccgccacaattcagcgccccagccagctggatccatggagcaaccgcgtcgaagcagagcaacgttggaactatgtgcttgacggcatggtgggcgaaggctggctcgatcccaatgaccgcgctggtgttgtattccccgaggtcactgaccctgctcagaaccagacttacaccgaagccacaggtgcaaacggcctgattaaaaaccaggtcatgaacgagctgaccaccctaggtatcactgagtccgatgtgcagacccttggcctgcgcatcaccaccactatcgacgacgccacccagaagtccatggtggaggccgtcgaccgcaacatggccgacgagcaatccaacacccgtgtcgccgccgtcagtgtggaccctaagaccggtgccgtacgtgcctactacggcggcgacgatgccaccggctacgactttgccaatgcaccgctgcaaaccggttcgactttcaagatctttggtcttgctgcagctgttcaacagggcattccaacttctactaactacagctctgatccttaccaacttcgtggcggtatcactgttactaacgttgataaaggttgtggcgtctgctctcttaaagaagctttgaaaaattcctacaacaccagtttcctgcgactgcaagatgatctgaaacatggcagccaagacacagctgacatggcgcactcccttggtgttgctcgttccttgcccggaattgaaaaaaccctgaccgaaaatggtcagcagccctatgaaggcgtcatccttggccagtacctttctcgtccgctggatatggctcatgctatggccactttggctaattatggtgtttggcaccaagagtactttgtagaaaagattgaaactgccgaaggtaaactgctctaccagcatgaaggtacccaaggtgaacggcgtgtttccgagaaggtagccactaacgttcttgatgcgatggctcctattgcagcatggtccggtggaaacggtcttgcaggtgggcgtccatcggcaagcaaaaccggaacgactcagcttggcgataccggcgctaataaagatgcttggatgatcggtgccaccccgcaacttgcaaccgcggtctgggcgggtaccgccgataactcgccattgctgaattcgtggggtgggcctatgtacggctccaacctccctgcacagttatggaaggatatcagtgactctgctctttcaggtaaagattgggagcaattcaaacccgcacaaaatattggctgggcgaaatatggctacggaactgctcctcgtgcgaccactgaaaagattcaaactgagacctcgaccagctcggcggaggctaccagccctgcagcatctggaacaccgggtgcaccgccagtaccaagtgccccagagccggcgccagctccgggaggcattgagattctgccaggcgtagtcctgccggtcccataa

SEQ ID NO: 50079 - protein, 726 aa, Corynebacterium diphtheriae NCTC 13129
MADSGKGKPSPKRKKASAKSSAKSRPARAPQARRPKKKWVKPVIGGSIAAVLLAPFLAFMVAYIVTDVPEPSELVTKQVSQIFASDGKTQLARIVPPDGNRTEVPIDKIPEVTRNAVLAAEDREFYTNSGFSFTGFGRAILGQLTGDASAGGGSTITQQYVKNMVVGNDYSYMRKAKELVYSVKMANEWSKDEVLGAYLNTIYFGRNAYGIDAAAHAYFGVPASELNVGQSAMLAATIQRPSQLDPWSNRVEAEQRWNYVLDGMVGEGWLDPNDRAGVVFPEVTDPAQNQTYTEATGANGLIKNQVMNELTTLGITESDVQTLGLRITTTIDDATQKSMVEAVDRNMADEQSNTRVAAVSVDPKTGAVRAYYGGDDATGYDFANAPLQTGSTFKIFGLAAAVQQGIPTSTNYSSDPYQLRGGITVTNVDKGCGVCSLKEALKNSYNTSFLRLQDDLKHGSQDTADMAHSLGVARSLPGIEKTLTENGQQPYEGVILGQYLSRPLDMAHAMATLANYGVWHQEYFVEKIETAEGKLLYQHEGTQGERRVSEKVATNVLDAMAPIAAWSGGNGLAGGRPSASKTGTTQLGDTGANKDAWMIGATPQLATAVWAGTADNSPLLNSWGGPMYGSNLPAQLWKDISDSALSGKDWEQFKPAQNIGWAKYGYGTAPRATTEKIQTETSTSSAEATSPAASGTPGAPPVPSAPEPAPAPGGIEILPGVVLPVP

SEQ ID NO: 50080 - DNA, 1947 bp, Rhodopseudomonas palustris CGA009
  CDS (1)..(1947)
atggtctgggtcggcgcgcacctgccgccgatccagtcgctcgagattccgaagcggccgccgacaatcaccatcgtggccgacgacggctcgaccatggcggtgcgcggcgagcaggccggcaccaacgtggcgctcaaggagctgccgccgtacctgccgaaagcgttcatcgcgatcgaagaccggcggttctatcagcacttcggcgtcgatccgctcggcatcgcccgcgccgcggtggccaacgtgctgcaccggggcgtgtcgcagggcggctcgacgctgacccagcagctcgccaagaacctgttcctgacgcaggaccgcacgctgacccgcaagctgcaggaggtcgagctggcgctgtggctggagcgcaagcactccaaggccgagatcctcgaactgtatctgaaccgggtctatttcggctccggcgcctacggcatcgaggctgcggcgcagaagtatttcggcaagtcggccaaggacgtcacgctggtcgaggcggcgatgctggccggtctcgtcaaatcgccttcgcgcctcgcgccgaaccgcaatcccgaaggcgccgaaaagcgcgcccagatcgtgttggctgccatggccgacgctggcttcgtcaccgacaagcaggcccaggccgcgatcgccaacccggtctacaccgtcaagccgaccggcgccggcaccatcaactacgtcgccgactggatcaccgaggtgctggacgatctggtcggccagatcgaccagtcgatcatcgtcgaaacctcgatcgatccgaggctgcagtcggtcgccgaggccgcgatcatcgacgagctggcggccaagagcgtcaaatacaaggtgacgcagggggcgctggtggcgatgacgccggacggcacggtacgggcgatgatcggcgggcgcaattacgccgacagccagttcaaccgcgccgtcactgccaagcggcagccgggctcggcgttcaagccgttcgtctatctgaccgcggtcgaggcggggttgacgccggacaccatccgccaggacgcgccgctcgacctcaaaggctggaagccggagaactacacccacgaatatttcggctcggtgacgctgacccaggcgctggcgatgtcgctgaacacggtggcggtgcggctcgggctcgaggtcgggccgaagaacgtggtacggaccgcgcaccggctcggcatcgcctccaagctcgacgccaacccgtcgatcgcgctcggcacttcggaagtcacgctgaccgagctggtcggcgcctactccaccttcgccaatggcgggctattggtgtcaccgcatgtggtgaagcggatccgcaccttgcagggcaacaaggtgctgtacgtccgcagcgacgagccggcgagccgggtggtcgatccgcgcgcggtggcgatgatgaacaccatgatgcaggagacgctgcgctccggcaccgcccacaaggccgacctgccgggctgggtcgcggccggcaagaccggcaccagccaggatttccgcgacgcctggttcctcggctacacctccacgctggtcaccggcgtctggctcggcaacgacgacaactcgccgaccaagaaggcgaccggcggcggattgccggtcgaagtgtggacgcggttcatgcgcgaagcgctcaagggtgagacaccgcagccgctcccgggcgactggagcggcggcccgatcgtcagcagcacgccctccacgctcggcgggagcctaagcggcgccccgacgggcggcggcaccatcgcgcaagccggaccgcgcggcgaaacccaggtgatcaacgctccgccgcccccagggtcaggccggatgcctccgccgacccgcgccaatgtgcgaccggaggccgacgccggcctggatggatggctgatggatcggctgttcgggcggtga

SEQ ID NO: 50081 - protein, 648 aa, Rhodopseudomonas palustris CGA009
MVWVGAHLPPIQSLEIPKRPPTITIVADDGSTMAVRGEQAGTNVALKELPPYLPKAFIAIEDRRFYQHFGVDPLGIARAAVANVLHRGVSQGGSTLTQQLAKNLFLTQDRTLTRKLQEVELALWLERKHSKAEILELYLNRVYFGSGAYGIEAAAQKYFGKSAKDVTLVEAAMLAGLVKSPSRLAPNRNPEGAEKRAQIVLAAMADAGFVTDKQAQAAIANPVYTVKPTGAGTINYVADWITEVLDDLVGQIDQSIIVETSIDPRLQSVAEAAIIDELAAKSVKYKVTQGALVAMTPDGTVRAMIGGRNYADSQFNRAVTAKRQPGSAFKPFVYLTAVEAGLTPDTIRQDAPLDLKGWKPENYTHEYFGSVTLTQALAMSLNTVAVRLGLEVGPKNVVRTAHRLGIASKLDANPSIALGTSEVTLTELVGAYSTFANGGLLVSPHVVKRIRTLQGNKVLYVRSDEPASRVVDPRAVAMMNTMMQETLRSGTAHKADLPGWVAAGKTGTSQDFRDAWFLGYTSTLVTGVWLGNDDNSPTKKATGGGLPVEVWTRFMREALKGETPQPLPGDWSGGPIVSSTPSTLGGSLSGAPTGGGTIAQAGPRGETQVINAPPPPGSGRMPPPTRANVRPEADAGLDGWLMDRLFGR

SEQ ID NO: 50082 - DNA, 2274 bp, Rhodopseudomonas palustris CGA009
  CDS (1)..(2274)
gtgccgaagattctgccagacaattggaagcagcggatccggaattggtttctggacctcgacgcccggctcgactcgacgctgttctcatcggcggtcggtatcagagagctgtgggagcggttctcgacctatatggaccgcttctatgtcggcggctggaagcgctgggtgtttatcgagccgttgtcggatgccgcctcgatcgggctgctcggcctcgtcgcgctgctggcgctggcgcagccggcattccgcgagacctcggacgaggactggctgaagaagtcggacctcgccgtcaccttcctcgaccgctacggtaatccgatcggcagccgcggcatcaaacacaacgacgcgatcccgctcgaggacttcccggacaacctgatcaaggcgacgctcgcgaccgaggaccgccggttctacgaccatttcggcatcgacgtcgcgggcacgttgcgcgcgctggtcaccaacgcccaggccggcggcgtgcgccagggcggctcctcgatcagccagcagctcgccaagaacctgttcctatccaacgagcgcacgctcgaacgcaagatcaacgaagcgttcctggcgatctggctggaaacccggctgaccaagaacgagatcctgaagctgtatctcgaccgcgcctatatgggcggcggcaccttcggcgccgacggcgcagcccacttctatttcaacaagtcggtgcgcgacgtgaacctcgccgaggcggcgatgctcgctggcctgttcaaggccccgaccaaatacgccccacacatcaacctgccggccgcccgcgcccgcgccaaccaagtgctcgacaatctggtcgacgccggcttcatgaccgagggccaggtgttcggcgcccgccgcaacccggcctcggtggtcgaccgccgcgacgagaactcgccgaactactatctcgattgggcgttcgacgaagtccgcaagatcgtcgacaccttcccgaagtcgtacaccgaacgcgtgttcatggtccgcaccgcgatcgacatgaacgtacagcgcgccgccgagagcgcgatcgagaaccagctccggcagttcggccgcgattatcacgcgacccaggccgccaccgtggtgtccgatctcgatggcggcgtccgcgccatggtcggcggccgcgactacggctccagccagttcaaccgcgcggtcgacgcctatcgccagccggggtcgtcgttcaagccttacgtctacaccacggcgctgctgaacggcttcaagccgacctcgatcgtggtcgatggcccggtctgcctcggcaattggtgcccgcaaaactacggtcactcttattccggctcggtgacgctgacccaggcgatcacccgctcgatcaacgtggtgccggtcaagctgtcgatcgcgatcggcggcaatccgaagaaccagtgggactcggccaagaagggccgcgccaagatcgtcgaggtcgcgcgccggttcggcctcaccgcgccgctgctcgatactccgtcgctaccgatcggttcgaccgaagtcaccgtcgtcgaacacgcggtcgcctatgtgaccttccccaacaaaggcatggcggtgaagccgcatgcggtactggagatccgcaccggcgccggcgacctggtgtggcgctgggaccgcgacggcccgcagccgcggcgcgcgatcccggccaacatcgcctcggatatggccgggatgatgagccacgtcgtcaccgagggcaccgcgcggcgtgcgcggcttgacggcattccggcggctggcaagaccggtaccaccaacgcctatcgcgacgcctggttcgtcggctacaccggcaacttcgcttgcgctgtgtggtacggcaacgacgactactcgccgactaaccggatgaccggcggctcgctgcctgcgcaaacctggcacgacatcatggtggcggcgcatcagggcgtcgaggtcaaggagctcgccggcgtcggcatgggcgagaagctgccggcgactccgggcgaacgcgcggcgggcgccgagagcgccgaaatgaaagcggccccgccgccggtgctgacgcggcgcggcgccgagatcctggtacgggtggagaagatgctcgacgagaccagccgtgcactcgattccgccccagcaccggcgaccggccgcaaggtgtcgaccgggacagtcagcttgaccgacagcatggctgcggcatcgcccggctccgccccggcggcggcccagaaaaattga

SEQ ID NO: 50083 - protein, 757 aa, Rhodopseudomonas palustris CGA009
MPKILPDNWKQRIRNWFLDLDARLDSTLFSSAVGIRELWERFSTYMDRFYVGGWKRWVFIEPLSDAASIGLLGLVALLALAQPAFRETSDEDWLKKSDLAVTFLDRYGNPIGSRGIKHNDAIPLEDFPDNLIKATLATEDRRFYDHFGIDVAGTLRALVTNAQAGGVRQGGSSISQQLAKNLFLSNERTLERKINEAFLAIWLETRLTKNEILKLYLDRAYMGGGTFGADGAAHFYFNKSVRDVNLAEAAMLAGLFKAPTKYAPHINLPAARARANQVLDNLVDAGFMTEGQVFGARRNPASVVDRRDENSPNYYLDWAFDEVRKIVDTFPKSYTERVFMVRTAIDMNVQRAAESAIENQLRQFGRDYHATQAATVVSDLDGGVRAMVGGRDYGSSQFNRAVDAYRQPGSSFKPYVYTTALLNGFKPTSIVVDGPVCLGNWCPQNYGHSYSGSVTLTQAITRSINVVPVKLSIAIGGNPKNQWDSAKKGRAKIVEVARRFGLTAPLLDTPSLPIGSTEVTVVEHAVAYVTFPNKGMAVKPHAVLEIRTGAGDLVWRWDRDGPQPRRAIPANIASDMAGMMSHVVTEGTARRARLDGIPAAGKTGTTNAYRDAWFVGYTGNFACAVWYGNDDYSPTNRMTGGSLPAQTWHDIMVAAHQGVEVKELAGVGMGEKLPATPGERAAGAESAEMKAAPPPVLTRRGAEILVRVEKMLDETSRALDSAPAPATGRKVSTGTVSLTDSMAAASPGSAPAAAQKN

SEQ ID NO: 50084 - DNA, 2499 bp, Rhodopseudomonas palustris CGA009
  CDS (1)..(2499)
atgcgctttctgctgcgtttcttcggcttcctgttcgcggccggaacaatcgtgttcctggtcggcgttgcagctgccgccgggctgatctggcatttctccaaggacctgccggactactcgcagctgcaggactacgaaccgccggtgatgacgcgaatccatgcgtccgacggatcgctgctcgccgaatacgccaaggaacgccggctgtacctgccgatccaggcggtgccgaagctggtgatcaacgcgtttctcgccgccgaagacaagaatttctacgagcacggcggcatcgactatcagggcatggcgcgcgccgcgctgctctacgcgcagaacatcggcaccaaccgccggccgcagggcgcctccaccatcacccagcaggtcgccaagaacttccttctgaccaacgaggtgtcgttcacccgcaagatcaaggaagccttgctggcgatgcggatcgagcgcgcctattccaaggacaagatcctcgagctgtatctcaacgagatctatctgggcctcggcgcctacggcatcgccgcggcgtcgctggtctacttcgacaagtcggtcaacgaactgacggtcgcggaagcgtcgtatctggcggcgctgccgaaggcgcccgccgcgctgcacccgatccgcaaccacgaccgcgccgtcgagcgccgcaattacgtgatcgaccgcctggtcgagaacggctggatcaaccaggccgacgccgacaaggcgcgcaagtcgccgctcaccgtaaccaaccgtggcaacgccgcgcacaccttcgcgggcgaatacttcgccgaagaagtccgccgcgacatcttcgagcgctacggcgagaagaagctgtacgagggcggcctgtcggtgcgcaccacgctcgatccgaagctgcagatcgaagcgcgcaagaccatggtcgcgggcctcgtccggttcgacgaagcgcgcggctggcgcgggccggtcaccaagctggaaatcgccggcgactggggcgtcaagctcgccgacgtgaaagcgctcgccgacatcacgccgtggcggatggcggtggtgctggagacctccgaccaatcggcgcggatcggacttcagcccggccgcgagctcggcggcgcgatctccaagcagcgcgagaccggtctggtcacgcttgaaggcgtcaaatgggccaagccggccgccggcccgtcgcgcggcaagaccccgcgcacggtgtcggaagtgctgtcgccgggcgaggtgatctatgtcgacccgctgctcgacaaggacggcaaggcaatcgagggccagtaccgcctgcggcagctgccggaagtgtccggcgcgatggtggtgatggacccgctgaccggccgcgtgctggcgatggttggcggcttctcgttcgaccagagccagttcaaccgcgccactcaggcgtatcggcagccgggttcgtcgttcaagccgctggtgtattcggcggcgatggacaacggctacaccccgtcgacggtggtgatcgacgccccgatcgaaatcgaccaggggcagggcgtcggcgtgtggcgtcctgagaactactcgaccggcaagtattacggcccgaccacgttgcgcaatgcgctgcagcgctcgctcaacaccgtgacggtgcggctggcgcaggacatcggcatgccgttgatcggcgaatacgccaagcggttcggcgtctatgacgacctgccgaactatctgtcgtatgcgctcggcgcgggtgaaaccacggtgatgcggatggtcaccgcctattcgatgttcgccaatggcggacggcgggtgaaggcgacgctgatcgaccgcatccaggaccgctacggccacaccatcttcaagcacgatcagcgggagtgccgcggctgcgaagcacccaacggctggaagaaccagccggagcctcagctcgtcgaccgccgcgagcaggtgctcgatccgatgaccgcttaccagatcacgtcgatgatggaaggcgtggttcaggccggcaccgcgacggtgctgcgcgaggtcggcaagccgatcgccggcaagaccggcaccaccaacgacgagaaggacgcctggttcatcggcttctcgccggacctcgtgtgcggcgtctatatcggctacgacaagccgcgcaatctcggccgtggcgcgaccggcggccatctcgcggcgccgatcgccaaggacttcttcaagctcgcgctcgccgagaagcccgcggtgccgttccgcgtgccggccggcatcaagctggtccgggtcgacgccaagagcggcatgcgtgccggcccgggggatggccgcaccatcctcgaagcgttcaagccgggcaccgcgccgccggacaattacgcggtgatcggcgtcgccgacgccgacgcgcgccagcagcagcaacagcagatggcgccgccggacgatcgcggcttcatgcggccgggcactggcgggctttactag

SEQ ID NO: 50085 - protein, 832 aa, Rhodopseudomonas palustris CGA009
MRFLLRFFGFLFAAGTIVFLVGVAAAAGLIWHFSKDLPDYSQLQDYEPPVMTRIHASDGSLLAEYAKERRLYLPIQAVPKLVINAFLAAEDKNFYEHGGIDYQGMARAALLYAQNIGTNRRPQGASTITQQVAKNFLLTNEVSFTRKIKEALLAMRIERAYSKDKILELYLNEIYLGLGAYGIAAASLVYFDKSVNELTVAEASYLAALPKAPAALHPIRNHDRAVERRNYVIDRLVENGWINQADADKARKSPLTVTNRGNAAHTFAGEYFAEEVRRDIFERYGEKKLYEGGLSVRTTLDPKLQIEARKTMVAGLVRFDEARGWRGPVTKLEIAGDWGVKLADVKALADITPWRMAVVLETSDQSARIGLQPGRELGGAISKQRETGLVTLEGVKWAKPAAGPSRGKTPRTVSEVLSPGEVIYVDPLLDKDGKAIEGQYRLRQLPEVSGAMVVMDPLTGRVLAMVGGFSFDQSQFNRATQAYRQPGSSFKPLVYSAAMDNGYTPSTVVIDAPIEIDQGQGVGVWRPENYSTGKYYGPTTLRNALQRSLNTVTVRLAQDIGMPLIGEYAKRFGVYDDLPNYLSYALGAGETTVMRMVTAYSMFANGGRRVKATLIDRIQDRYGHTIFKHDQRECRGCEAPNGWKNQPEPQLVDRREQVLDPMTAYQITSMMEGVVQAGTATVLREVGKPIAGKTGTTNDEKDAWFIGFSPDLVCGVYIGYDKPRNLGRGATGGHLAAPIAKDFFKLALAEKPAVPFRVPAGIKLVRVDAKSGMRAGPGDGRTILEAFKPGTAPPDNYAVIGVADADARQQQQQQMAPPDDRGFMRPGTGGLY

SEQ ID NO: 50086 - DNA, 1989 bp, Geobacter sulfurreducens PCA
  CDS (1)..(1989)
atgtcaaacctgctgtatggcctgaccctgttcatcgtcgttgccctgaccctggcatccccggccggggcccaggatgccatcgccactcatccaatccagcccgccggctattcttccataaaggttttcgaccgtaacggccggtttgcgggccggattcttcccgaaaagcgctactgggttcccatcgaccgcatccctgccttcctgcagaaggcggttgtggcggtggaggatgcccgcttctacgagcatagcggcatcgatgtgcggggtatcgcccgtgccctggtgaaggacgtggtcaaggggcggctggccgagggtggctcgaccattacccagcagctgatcaagaacaagtatctctccggcgagaagagcatcgagcgcaaactggaagaagcccggctggcaatggactacgagaagaaatacagcaagaagcagatccttgagatgtatttcaatgaaatttactacggccggggagcctgggggatcgcccaggcggcccgcgtctacttcgacaagaaccctgaggaactgaccgaggccgaatgcgccctgctggcgggcgtgcccaaaaatccgggccgctacaatccgttgggcaaggcggctgacgtggggcggcgcagggacgtggtcctcaagcggatgacggacctcaatatgatttccgcccggcagaagcagaagctgcgcagccagcgggtggccgttaccccgccggaccaggcatcgtggtatctggcccatatccggaacctgctggtggagcggtacggcccccaggtcatcgaggcggggggactggaagtgacagcggccatggatctgaacctgcagaaactagccgaaaagaccctgcgggaaggggtgaagcgggtttcgcccgaccttcagggagcgctgatgtccctggatcccgccactggcgatgtactggcggccgtggggggcgtggacttcgccaagagctcctatgaccgggcattcctggcgcggcgccagcccggctcggcaataaagcccctgatctatgcggctgccctggaaaaggggatcactgccgcgagcgtctgggatgattccccggttgcctacgtccgcggcgccaaccaaacctggaagcccaggaactacggcggcgagcagtacggggaactttccctgaggaaggccctggcctactcgaacaacgtcatcacagtcaaggtgctggagacgatcggcgttccctacttcgtggagattgccaggaatctgggactgtcgctccgatcgcccaacgacctctcgctggccctgggcaccgacgaggtgaccctgcgtgatctcgtttcggcgtacacccccctggccaacggaggactccgggccgaagccaggaccgtgctccggatctacgacaagcgccgtcgcgcctggaccgacaatccgccggccgtcactcaggccatctcgcccgccgcggcctatgtcacgacccagatgctcaaggacgtgatggtgtacggcacggccaagtcgctcaggaagttcagccaggcccggccggccgccggcaagaccggcaccaccgacgattaccgggacgcttggttcatcggctatactccgggtgtcgttaccggcatctgggtcggccacgacaagcccaggccgggagggaaagggttcacggggggtaccgtggccgcgcccatctgggagcggttcatgggaccggccctgtccggtcggccggccgccgacttcgcccggccggaaacggtcgttgccgtgaccgtggaccctgccacgggataccgggcagcgccggagtgcccggaacagcgggaagaattatttattgccggcactgagccggtcgcatactgccctgcccacggcggggagctcctgatgcccgaatcgcccgatctgccggtgccggaaggggaaacccgggagcctgcggccaccgacaatccgatgtga

SEQ ID NO: 50087 - protein, 662 aa, Geobacter sulfurreducens PCA
MSNLLYGLTLFIVVALTLASPAGAQDAIATHPIQPAGYSSIKVFDRNGRFAGRILPEKRYWVPIDRIPAFLQKAVVAVEDARFYEHSGIDVRGIARALVKDVVKGRLAEGGSTITQQLIKNKYLSGEKSIERKLEEARLAMDYEKKYSKKQILEMYFNEIYYGRGAWGIAQAARVYFDKNPEELTEAECALLAGVPKNPGRYNPLGKAADVGRRRDVVLKRMTDLNMISARQKQKLRSQRVAVTPPDQASWYLAHIRNLLVERYGPQVIEAGGLEVTAAMDLNLQKLAEKTLREGVKRVSPDLQGALMSLDPATGDVLAAVGGVDFAKSSYDRAFLARRQPGSAIKPLIYAAALEKGITAASVWDDSPVAYVRGANQTWKPRNYGGEQYGELSLRKALAYSNNVITVKVLETIGVPYFVEIARNLGLSLRSPNDLSLALGTDEVTLRDLVSAYTPLANGGLRAEARTVLRIYDKRRRAWTDNPPAVTQAISPAAAYVTTQMLKDVMVYGTAKSLRKFSQARPAAGKTGTTDDYRDAWFIGYTPGVVTGIWVGHDKPRPGGKGFTGGTVAAPIWERFMGPALSGRPAADFARPETVVAVTVDPATGYRAAPECPEQREELFIAGTEPVAYCPAHGGELLMPESPDLPVPEGETREPAATDNPM

SEQ ID NO: 50088 - DNA, 2391 bp, Geobacter sulfurreducens PCA
  CDS (1)..(2391)
ttgaaaattgttgctataacatcgatatgtcttgcggtggcagccctgctcgcgctggggggatatctgttctacctcatggcgaccctcccgaaagtggaccggttggccgattacaagcctcccatcgtttcccaggttttcggcgacgatgggagcctggtgggagagttctatctggaacggcggacggtggtgccggtggagaagctgcctcgccggctcgtccaggcttttgtctcggccgaggattccaacttctaccagcacaagggtctggattacgtgggcattgtccgggccgcggttaaaaacctcatctccctgcgcaaaaaagagggggcatcgaccattacccagcaagtggccaagtcaatgctccttacccccgagaagagctacacccgcaaactcaaggaggcggttctcgccaaacggatggaggagcggctttccaaggacgatatcctctatatatatctgaaccagatttatcttggcgccggttcgtacggcgtccaggtggcggcggagacctacttcggcaagaacgtcgagcaactgaacctggccgaaatggcaatgctcgcaggcttgcccaaggcccccaacgcctattctcccatcaagcatcttgaccgggcgcgggaacgccaggcctatgtccttgaacggatggtaaaggaaggctacgtcacccaggccgaggcggatcatgcccgggccactcccatcgtcatccagtccatgaagaaggtcaacagcgaacagtccgcctatttcctggagcatatccggatcgccttggaagaccgctacggtgaggagcagctttacaaggaagggttgcggatttacaccaccatgaacgccgagatgcagaaggcggcctatgaggcggtggtgaacggtctcaagaacgtggacaagcggcagggattccgcggcgcaacggcctatctggccgaggctgcggtggctgcagtctgcgataaggtggaagacggcatcgatactgtttctctcaagcagggagccacctaccagggggtggtcaccgccgtggaccccgtccggggggacgtgaccgtacgggtcggtgaccgcaccggcactctctcgcgcaagaatatggcctgggccggcaaggtgcagttggtgaacgcctggggcaagcaggaggtgaagggtaaattcctgtcgctcggcagcgtgatcctcgtatcggtcgttacccccgacgcggacaagaaaggggctgtctttgcccttgatcaggaacccgaggcccaggcggcagtggtggcgctggatcccctctccggcgcggtcaaggcgatggtcggggggtacgacttccgcaaaagccagttcaaccgggcattgcaggcaaagcgtaatcccggctccgcgttcaagccgcttatctatgccgccgccctggacaaggggattacccctgccaccatcttcgacgactcgccggtggagtatgaaagcggcaaggaaaaggcctggaaacccaaaaactacgacaacatctaccggggcaacgtgaccatgcgggaggccctcaccaactccatcaacgtggtgagcgtcaagatcctggagcagatcggcgtggactatgccatcgagtacgccaagaagctgggcataacgtctcccctttcggccaacctgaccctggccctgggctcttccagtcttacccctcttgagctgacctctgcctacgcggtgttcgcttcgggcgggtatcggaccaccccctacttcgtcaccagggtcgaggatgcggaagggcggactcttgaggaaacagcaccgccggtcattcccagattctccgtcatgacgtcggccgaatcgtctcccctcgaggcgtcgcccgcccctccggccacggccggggactcggcgtcaacggcggtgccggtgattgcgcctgaaaccgcctacatcatgaccaatctcatggaaagcgttgtccagagcggtaccggacagcgcgccagggccgtcggccggccggtggccggcaagaccggaaccaccaacgatatgaaagatgcatggttcgtggggtacatcccccaactggtggccggagtctgggtcggctacgatcaggagcgctccctgggggccggcggatcgggcggacaggctgcggctcccatctggaccgaattcatgcggcgggcggtggccgggattccttcccgcgacttcgagacgcctcccaacgttacttttgccaccatcaatccccgcaccggtcggctggcccgggagggaagcgacggcgccgtgcaggagtgcttcattgcgggcaccgaaccgaccgcttacgatggtgaatcctccgaggatggtgtgccataa

SEQ ID NO: 50089 - protein, 796 aa, Geobacter sulfurreducens PCA
MKIVAITSICLAVAALLALGGYLFYLMATLPKVDRLADYKPPIVSQVFGDDGSLVGEFYLERRTVVPVEKLPRRLVQAFVSAEDSNFYQHKGLDYVGIVRAAVKNLISLRKKEGASTITQQVAKSMLLTPEKSYTRKLKEAVLAKRMEERLSKDDILYIYLNQIYLGAGSYGVQVAAETYFGKNVEQLNLAEMAMLAGLPKAPNAYSPIKHLDRARERQAYVLERMVKEGYVTQAEADHARATPIVIQSMKKVNSEQSAYFLEHIRIALEDRYGEEQLYKEGLRIYTTMNAEMQKAAYEAVVNGLKNVDKRQGFRGATAYLAEAAVAAVCDKVEDGIDTVSLKQGATYQGVVTAVDPVRGDVTVRVGDRTGTLSRKNMAWAGKVQLVNAWGKQEVKGKFLSLGSVILVSVVTPDADKKGAVFALDQEPEAQAAVVALDPLSGAVKAMVGGYDFRKSQFNRALQAKRNPGSAFKPLIYAAALDKGITPATIFDDSPVEYESGKEKAWKPKNYDNIYRGNVTMREALTNSINVVSVKILEQIGVDYAIEYAKKLGITSPLSANLTLALGSSSLTPLELTSAYAVFASGGYRTTPYFVTRVEDAEGRTLEETAPPVIPRFSVMTSAESSPLEASPAPPATAGDSASTAVPVIAPETAYIMTNLMESVVQSGTGQRARAVGRPVAGKTGTTNDMKDAWFVGYIPQLVAGVWVGYDQERSLGAGGSGGQAAAPIWTEFMRRAVAGIPSRDFETPPNVTFATINPRTGRLAREGSDGAVQECFIAGTEPTAYDGESSEDGVP

SEQ ID NO: 50090 - DNA, 2388 bp, Lactobacillus johnsonii NCC 533
  CDS (1)..(2388)
atggcagataataatcaaaggccaagtaattctagaatggctaagcttcacccaaaaggtaagcctcgtaaacgaatttggctacaaataatcaagtggttctttatcgtagcaatgttagtagttgtttctggagtaggtttatttgcatactatgctaaagacgctccaagcatctcacaggctcaacttcaaagtggtgggacaagtagtctgtatactcgtgatggaaaatttcttctttctctagggtcagaaaaaagaacctatgttgataataatgaaatccctaaagaacttaaaaatgccattgtctctgttgaagataggcgtttttataaagaaggcattggactcgatccaattagaattattgggtctgtcttagttaatgctaaaagtaaaggcgtagctgcaggtggatcaactattactcagcaattagttaagttatcggtcttctccactgctgcttctcaaagaacccttcgtagaaaagctcaagaagcatggctttcaatgaaggtagaacgagaatttagcaaagaacaaatcttggaattttatattaataaagtttatatgaactatggtaattacgggatgggtacagcagccgactattactatgggaaagatctaaaagatcttgatttagctcagactgctctacttgctgggatgcctaatgccccggttacatatgatccatatgtttatccagaaaaagcaaaatatagacgtgacattgtattaaaagcaatgctcagaaatgataaaatttcaagagctcaatataaacaagcagttaatgagcccattactcaaggcttgcagcctaagaagaataattctacttctgaattacgaaaagtagatgatccatacatcaaagaagtaattaatgaagttaagagtaaaggctttaatccatacaacgataacttaaagattacagttaatattgatcaagatgctcaacaaaagctttatgacttagtaaatgatggttcggttccatttactaatgataagatgcaagttggagctacaattattgatcctcgaactggccatgttattgccattattggtggacgtaaacttcctgcagttcaattaggtttaaatcgtgctgttcaaactggtcgttcaactggttctactgttaagcctgtattagattatggtcctgcaattgagtatcttaactggccaacttctcatatgttagatgactctaaatatgtttaccctggtactaacattcaactttatgactgggacaataaatatgagggtaaaatgactatgcgtcacgctcttgaacaatctagaaatgttccagctgttaaaactttaagcaaggttggagtggcaagagcttctctttttgcaagaaaactcggagttaatgttccttctgattctggtctatcagttgcaattggtgctaatgcatcctctcttcaaatggcaggcgcatttggtgcatttgctaatgacggtatttaccacaaaccacaatttgtttcaaaaattgaaactccagacggcttgactagaaattatgatagtagtggtacaagagtaatgaaggaatcaaccgcctatattatgaccgacatgcttaaaggggttatgactaaaggttcgggtacacaggcacgtattaaaaacttatacgaagctggtaaaacaggaacggttaaatattctgatgaagagttagtaagatatcctcaatacaaaaattcaccaaaagattcttggtttgttggttataccaaactctattcaatgggaatttggacaggatatgataatctgaaagatggtactccttcaggtgttggctcatcgtctgctcaacttctatataagcaaatgatgtcatatttaatgagtgataaagctaataaagactggtcaaaaccaagcacagttgttagacgcagaattgctaatggtacccaagataaagtcgtttctccgaatgcaagtaattctagctggcaattatttgttaaaggtcatgcaccaagtaatccgtatagtgatgtgactgttgatagacgaaaagaggaagacgacgatattgatacacgagttgatacagaagatgatacttcttctaagggccaatctcgttcccaaagcagtagttcttcatcatcgagtcgtgctgaacaatcttcaagtcaaagacaatcttcttctacttctaacaacaactccaatactcaaacgcaaaataataatcgccagactgaaaaacaaccagaaaataataacaataattcacaacagaatcagaatacaaataatcagggtaacaatcaaaatcaacaacaaaatcagggaaataactccaataataatcaataa

SEQ ID NO: 50091 - protein, 795 aa, Lactobacillus johnsonii NCC 533
MADNNQRPSNSRMAKLHPKGKPRKRIWLQIIKWFFIVAMLVVVSGVGLFAYYAKDAPSISQAQLQSGGTSSLYTRDGKFLLSLGSEKRTYVDNNEIPKELKNAIVSVEDRRFYKEGIGLDPIRIIGSVLVNAKSKGVAAGGSTITQQLVKLSVFSTAASQRTLRRKAQEAWLSMKVEREFSKEQILEFYINKVYMNYGNYGMGTAADYYYGKDLKDLDLAQTALLAGMPNAPVTYDPYVYPEKAKYRRDIVLKAMLRNDKISRAQYKQAVNEPITQGLQPKKNNSTSELRKVDDPYIKEVINEVKSKGFNPYNDNLKITVNIDQDAQQKLYDLVNDGSVPFTNDKMQVGATIIDPRTGHVIAIIGGRKLPAVQLGLNRAVQTGRSTGSTVKPVLDYGPAIEYLNWPTSHMLDDSKYVYPGTNIQLYDWDNKYEGKMTMRHALEQSRNVPAVKTLSKVGVARASLFARKLGVNVPSDSGLSVAIGANASSLQMAGAFGAFANDGIYHKPQFVSKIETPDGLTRNYDSSGTRVMKESTAYIMTDMLKGVMTKGSGTQARIKNLYEAGKTGTVKYSDEELVRYPQYKNSPKDSWFVGYTKLYSMGIWTGYDNLKDGTPSGVGSSSAQLLYKQMMSYLMSDKANKDWSKPSTVVRRRIANGTQDKVVSPNASNSSWQLFVKGHAPSNPYSDVTVDRRKEEDDDIDTRVDTEDDTSSKGQSRSQSSSSSSSSRAEQSSSQRQSSSTSNNNSNTQTQNNNRQTEKQPENNNNNSQQNQNTNNQGNNQNQQQNQGNNSNNNQ

SEQ ID NO: 50092 - DNA, 2058 bp, Lactobacillus johnsonii NCC 533
  CDS (1)..(2058)
atgcattcccaaaatcatgagttttggcatcgcgttcatttagcgattaaaaacttcaaccatcgttttcaaatttggcgttggttaattttaatattactgtcctgttgtttgttcgtttgtacatattataccgttaaggtaaaaacttcgaacatctctaatatgaaggcagcactttctactacaaccacaatttatgataataaaaatcagaaggccggatccctatactcacaaaagggatcttttgtggaactgaaccagatatcgccttatattcaagatgctgtcatcgctacagaagacaggactttttataaaaatccaggttttagtgtaaaagggatggcaagagcagccatcagtagtttaatccaccgaggtattgttggtggtggatctaccttaacacagcaattagccaagaatgcattattgacgcaaaagcagactttttctagaaaactagaagaactcttttttgcgatcgaaattaatcgtgtctattctaaaaaagacatcttaacaatgtatctgaataatgcttattttggtaacggtgtttggggagttcaagatgcagcaagacgctactttggaaaaaatgctagtgatgtaacggtaggagaagcggctacaattgcaggtatgcttcgtagtccaagctactataatccaattgatcacatggataatgcaatcgcaaggcgaaatgttgttttaggattgatggctgatacaggaaaaatttctaagacacaagctgataatgctaagaagactacgcttactcttgatgatacattttctcaagaagatggctatcgctacccttacttctttgatgccgtggttgatgaagcaatagatcgttatggcttaaaagaagaagacgtaatgaacaaaggattgaagatctatactacgctagacactggctatcaaactgccttgcaagatagttttgaagaaagctggaatttcccaccaaatgccagtgatggtactaaggtgcaaggagctagtgttgcaatggatccaaagactggagctgttcgagcaatggttggtggtagaggacaacatgtctttcgcggctataaccgtgctacccagatgaaacgtcagccgggttcgactatgaagccactagctgtctattcaccagctttgcagaatggatatcattatgattctgaactttctaataaactgcaaaaatttggaaaaaacggctatgagccaaagaatgttgataatcaatactcaaataagattccaatgtatgaagcgctagctcaaagtaaaaatgtaccagcagtatggcttttagataagattggtgtcagcaagggtgttcaatcagtggaaaactttggcattcacgttaataagagtgatcaaaacttggcattagctttaggtggactttcaactggtgtttcaccattgcagatggcaagagcttatagtgcttttgctaacgaaggtaatttaccaaatcaatcctactgtattactaaaatcactgatgctagcggaaatgttattgctcaaaacaataatcctggtagtcacagaattatttcaactaatactgctaaagaaatgacatcaatgcttttaggcgtatttacttcaggaactgggagatcagctcaaccatcaggttttagagtagcaggtaagactggttcaactgaggtaccagatagttatggatttggtacaaaagatcaatggatcgttggctatactccggatgttgttttatcaacttgggtaggttttgataagactgatcaggaacattatatggagggtatttcagaaactggaattactcacttgtataaatctgaattagaacggctacttccatatacttctcagacacaatttaaggaaaagagtgcccaacagatagcaaaagatacaggtgcaaattcagactggcttggtaatttaggtcaacaagtacaaaaaggaatcaatgatactgggtctaagttcaacgaatggtataataatcttaaaggacttttaggtcgttaa

SEQ ID NO: 50093 - protein, 685 aa, Lactobacillus johnsonii NCC 533
MHSQNHEFWHRVHLAIKNFNHRFQIWRWLILILLSCCLFVCTYYTVKVKTSNISNMKAALSTTTTIYDNKNQKAGSLYSQKGSFVELNQISPYIQDAVIATEDRTFYKNPGFSVKGMARAAISSLIHRGIVGGGSTLTQQLAKNALLTQKQTFSRKLEELFFAIEINRVYSKKDILTMYLNNAYFGNGVWGVQDAARRYFGKNASDVTVGEAATIAGMLRSPSYYNPIDHMDNAIARRNVVLGLMADTGKISKTQADNAKKTTLTLDDTFSQEDGYRYPYFFDAVVDEAIDRYGLKEEDVMNKGLKIYTTLDTGYQTALQDSFEESWNFPPNASDGTKVQGASVAMDPKTGAVRAMVGGRGQHVFRGYNRATQMKRQPGSTMKPLAVYSPALQNGYHYDSELSNKLQKFGKNGYEPKNVDNQYSNKIPMYEALAQSKNVPAVWLLDKIGVSKGVQSVENFGIHVNKSDQNLALALGGLSTGVSPLQMARAYSAFANEGNLPNQSYCITKITDASGNVIAQNNNPGSHRIISTNTAKEMTSMLLGVFTSGTGRSAQPSGFRVAGKTGSTEVPDSYGFGTKDQWIVGYTPDVVLSTWVGFDKTDQEHYMEGISETGITHLYKSELERLLPYTSQTQFKEKSAQQIAKDTGANSDWLGNLGQQVQKGINDTGSKFNEWYNNLKGLLGR

SEQ ID NO: 50094 - DNA, 2697 bp, Bdellovibrio bacteriovorus HD100
  CDS (1)..(2697)
ttgttaaaggagccccccacagtgttaaaaaagatcctgctattttgcgtcgccctcggtcttgtcggcatcctcggtgtatatctcatcgttcagtctgtcaaatccggactgcctcaattgatcaccgtaaaagactaccagcccctgctggtcagtcaggtctatgatcgcaacaacaaaaaaatcggcgagttcttccgcgaacgccgcaccttggttccatacgacaagattccaaaaaatcttatcaatgcgttcctggcagccgaagatgatcagttcttctctcacaaagggatcaacccgcaagccatcttccgtgcggctttagccaacttgcgtgccggtcgttccgttcaagggggctcgacgatcactcagcaggtggcaaaaacgctgctgctatcctctgaaaaaactctaacccgtaaattgcgcgatatccttctggcgattgaaatggaaaagaatctgagcaaagaggacatccttttcctttacttgaatcagatttacttcggccaaggggcgtatggtgtcgagcaggcggctcagacttactatcgcaagccggtttccaagctgacactgtctgaaatggcgatcctggcgggtcttccccaggctccttcccgctacagcccggtttcaaatccgctgcgtgccaaagaacgtcagatctatgttctgcgccgcatggccgatgttggctatgtcagcaaagaagaatccgaagcggccatccaagagccggtgaaggtttacgttcgtgaaaactacgaagaatatgcacctttctatctggaaaccgttcgtcagctgctggtcaaccaactgggtgaagacatggttttggacaaaggccttaaaatctacacaagccttgatctaaccaaacagatggccgctcaggattccgtaaaagaaggcctgaagtccttggataagcgccagggttaccgtggtccatccaaaaatctttctgatgaagacgccattgaagagttcctgaaagaaaatcagaaaaaactgatctcagacttcactccggaaagaaccattctgcctgacggaaagttcgccgacatcgtgccagtgaagtcggcgcaggatgaaaagctgcatccgttgctgcctccgtacatcaagctgaaagacactgtgaatggtgtggtggaaaaagtcgacgacacgctgggactggtttacgtgaaactgcctgaaacccgcggtgtgatcgacattgaaaccatgacttgggcccgcaagcccgactctgaagcccgctatgatctggcggcgatcaaaaagccttctgaagccctcaaaaaaggcgatgtgattctggtgaaggtggtggcagatcaattcagctccacccgccttgccagcaaaaagaagggccttccaacggcggcagccccggacttgagcaaatttgtgggtctggaactggatcaggaacctttggttgaaggcgcactgatttcctttgatcaggacagtcaggatgtcctggcaatggtcggtggatccaacttcgcaaagagcgaattcaaccgcgccattcaagctccccgtcagacaggttctgcttttaaagccattgtctatgcttccgcactggaaaagggctacactccggcaactccgatcatggacgcgccgattgtctatgaagaaggtggtgctgcggatgatgccgaaggccagggtgacatgaaggtttggaagccatcgaatcactccaaaagcttcggtggcgacatcctgttccgcaatgccttggtgaaatctttgaatatcccaaccgtgaaaatcatcgaagatgtgggtgtgccatggtccatggaatacgctcgtcgcctgggaatctacagccctttgaatcctgactttacgctggccctgggctccagcagcgtgactttgtacgagatgaccaaagcttttgctgaatttggtcgtcttggcaaacgactttccccgctgctgatccacaaggtggatgatgccaacggcaagaatattctcaaaaccgtttctttggatgcccgttttgacaaagagatcaaaactatcaatgacggcttcgaagagcgtcgcaaagccttcctggaagccatgaatgatccagccaaggtcgaagaaatgaaaaagaaggaaggcaagaatgccaaacttgatccaagcatcttcttccaggatgctgatcagctgattcgcccttctacagcctatgtgatgacaacactgttgaaaggtgttgtggaagatgctggtggtactggtggtcgcgcccgcgccgtgggccgtgaggtcgctggtaagactggatccacgaacaactactttgacgcgtggtttatcggttacagcccgcagatttccactggtgtgtgggtgggctttgacaaagaaaagagcctgggtaaaggcgaggtcggcggacgctctgctttgccgatttgggtcgactacatgaaagcggctcacgaaggtcttccgcagatgactttccccgtgccggacggtattgtgtttgctaatatcgacagcgaaaccggaaaactggcttcggcctcaaccaagaagatcattcgccaggctttcgttgaagggactgaacctacagccgcctcgaacaaagccgaagaggcaactgacttctacaaacaggatttatcggaatga

SEQ ID NO: 50095 - protein, 898 aa, Bdellovibrio bacteriovorus HD100
MLKEPPTVLKKILLFCVALGLVGILGVYLIVQSVKSGLPQLITVKDYQPLLVSQVYDRNNKKIGEFFRERRTLVPYDKIPKNLINAFLAAEDDQFFSHKGINPQAIFRAALANLRAGRSVQGGSTITQQVAKTLLLSSEKTLTRKLRDILLAIEMEKNLSKEDILFLYLNQIYFGQGAYGVEQAAQTYYRKPVSKLTLSEMAILAGLPQAPSRYSPVSNPLRAKERQIYVLRRMADVGYVSKEESEAAIQEPVKVYVRENYEEYAPFYLETVRQLLVNQLGEDMVLDKGLKIYTSLDLTKQMAAQDSVKEGLKSLDKRQGYRGPSKNLSDEDAIEEFLKENQKKLISDFTPERTILPDGKFADIVPVKSAQDEKLHPLLPPYIKLKDTVNGVVEKVDDTLGLVYVKLPETRGVIDIETMTWARKPDSEARYDLAAIKKPSEALKKGDVILVKVVADQFSSTRLASKKKGLPTAAAPDLSKFVGLELDQEPLVEGALISFDQDSQDVLAMVGGSNFAKSEFNRAIQAPRQTGSAFKAIVYASALEKGYTPATPIMDAPIVYEEGGAADDAEGQGDMKVWKPSNHSKSFGGDILFRNALVKSLNIPTVKIIEDVGVPWSMEYARRLGIYSPLNPDFTLALGSSSVTLYEMTKAFAEFGRLGKRLSPLLIHKVDDANGKNILKTVSLDARFDKEIKTINDGFEERRKAFLEAMNDPAKVEEMKKKEGKNAKLDPSIFFQDADQLIRPSTAYVMTTLLKGVVEDAGGTGGRARAVGREVAGKTGSTNNYFDAWFIGYSPQISTGVWVGFDKEKSLGKGEVGGRSALPIWVDYMKAAHEGLPQMTFPVPDGIVFANIDSETGKLASASTKKIIRQAFVEGTEPTAASNKAEEATDFYKQDLSE

SEQ ID NO: 50096 - DNA, 2373 bp, Bdellovibrio bacteriovorus HD100
  CDS (1)..(2373)
atgaaaaacattttcaaaggttgttcaccgagtgagttttgtactactctgtcatctatgatgcgaccacgattaaagactattttattggcttttacaatccttctgacgcttgtaatcatctgcgggcttggcattggagcttactcctactttgcactagagaaagagctgactgccaaactggagtcgaaaaagttcatcgttccgactgagttttacgcagctccaccaacattccagacgcacagtcagattcagatttcagatatcgaaaaacagcttctgcgtcagaactatcgccgtcgcgagttcgatcaacgactgctctcgggagattactttattgccacacgtgaacagtgcgcggcccgtctgcaggttggtttggacgaaaaccaggacgcctgcatcgggtgggtcactcaagacacccgcacccaggacgtggacagctcgattcaagttctggtggtgcagaaagaccgtttgatttcccgcatcttcaaaggggcaccttttgaggaggtgcaggaagccgtcagcgaagctccccttcttgctcaatatatcggcaacgaacccctcatgcagaaaaccgtcaccctgggtgaggtcccaccgatgtgttccaacgccgtgatgtccatcgaagacgcccagttcctggaacatggcggagtcagcttcaaaggcatcttccgtgctctggtaaaaaacgtcacttccggtcgccgagcccaagggggcagcaccatcactcagcagctggtgaaaaactacttcctgaccagtgaaagaaccctgaaacgaaagtaccaggagttcatcatgtccgtgctactggagtcccgcttcagcaaagaccagattctggaaacttatctgaacgtcatctatctgggacaaaacggagccttccaggtgcgtggttacggcgctgctgcccgttactactttggcaaagagctgaccgatctgaacatcagcgaatgcgcgctgatggcggcgattgtgaacagcccgggcctttacaatccatttaagaaacctgaaaatgccgagcgccgacgcaacttggtactcaccaaaatgaagggcctgaactatatttctcaagcccaattcgacgaagccgaccgccagccccttcctggagccccacgcaccatcgcctcagaaaccgcgccctactatctggatgccgttcgtaaacagctgacagctcaaggactcagccctgatggattaaagatctataccggccttgatctggaagctcaggaaaccgcacaggatgccttgcgcggccatttggaaaatctggaaaaaaacaacaaacacatttcaaacctcaaagccaaaggtcattctttggagggcaccgttcttgtcggcaacaatcagacggggcttgtcagcgtggtggttgggggtcgtaacttccggatgacacagttcaatcgcgctattgacggacaccgccagatcggctcgatcatgaagcccttcgtgttcctgactgccctgctgaacaaaactgaatcgggtgaaccctacactccggtgactttgttgaatgatgaaaagttcacttataaatacgagggccaagcctggtccccggacaactatggcaaaaaatactttggcaccgtgccgatgttttatgcgctgaaaaattcactgaatgccgccaccgcctctttggggcttgcggtgggcctggggaacatcattgatgtgacccacgaaatgggtgtgacctcgcatcttaaatccttcccggcaatgactttgggcgcatttgaaatgtatccaaaagaagttttgcaaagctatatgactctggcagcgatgggacaaagaccatctctgtcgtttatcagacgcgcactgaattcagacaatgtcgaagtcttcgtgcacgatccccgtccagtaccgactgtggatcctgcggcggtggcaagtctggtcagcatgatgaaacaaaccattttatcaggaactgcccgctcgatcactatgaatggcttcttcaacccggcagcaggaaaaaccggcaccaccagcgacaacaaagacgcatggttcgcgggtttcacgccgtatctgaccacggttgtgtgggtgggttacgacaacaatctgccgcacaaactgacgggttccaatggtgctgtaccggtatggactcaagtaatgaaaaagattggcacccgattccccgccgacgatttcccttggccggagaacaccgaaaaagtgatgctggatcagaagactctcgaggccttgaacgcttacaaagagggtgatccaactcaagtggaactcgtatttgacaaggaaaaatcccccgacctttga

SEQ ID NO: 50097 - protein, 790 aa, Bdellovibrio bacteriovorus HD100
MKNIFKGCSPSEFCTTLSSMMRPRLKTILLAFTILLTLVIICGLGIGAYSYFALEKELTAKLESKKFIVPTEFYAAPPTFQTHSQIQISDIEKQLLRQNYRRREFDQRLLSGDYFIATREQCAARLQVGLDENQDACIGWVTQDTRTQDVDSSIQVLVVQKDRLISRIFKGAPFEEVQEAVSEAPLLAQYIGNEPLMQKTVTLGEVPPMCSNAVMSIEDAQFLEHGGVSFKGIFRALVKNVTSGRRAQGGSTITQQLVKNYFLTSERTLKRKYQEFIMSVLLESRFSKDQILETYLNVIYLGQNGAFQVRGYGAAARYYFGKELTDLNISECALMAAIVNSPGLYNPFKKPENAERRRNLVLTKMKGLNYISQAQFDEADRQPLPGAPRTIASETAPYYLDAVRKQLTAQGLSPDGLKIYTGLDLEAQETAQDALRGHLENLEKNNKHISNLKAKGHSLEGTVLVGNNQTGLVSVVVGGRNFRMTQFNRAIDGHRQIGSIMKPFVFLTALLNKTESGEPYTPVTLLNDEKFTYKYEGQAWSPDNYGKKYFGTVPMFYALKNSLNAATASLGLAVGLGNIIDVTHEMGVTSHLKSFPAMTLGAFEMYPKEVLQSYMTLAAMGQRPSLSFIRRALNSDNVEVFVHDPRPVPTVDPAAVASLVSMMKQTILSGTARSITMNGFFNPAAGKTGTTSDNKDAWFAGFTPYLTTVVWVGYDNNLPHKLTGSNGAVPVWTQVMKKIGTRFPADDFPWPENTEKVMLDQKTLEALNAYKEGDPTQVELVFDKEKSPDL

SEQ ID NO: 50098 - DNA, 2514 bp, Bacillus cereus ATCC 10987
  CDS (1)..(2514)
atgtcagaaaattatcgttctcgagaggagcgacgacaagttaaaaagaaaaaacagccagcttctaaaacacaaaaaccaaaaggtaaaacatcattttttcgcaagtttttaattacttgtttattacttggtattgttggtttagtggggggagttgctaccttcttcgtaatgattaaggatgcaccgaaacttgagaaagcaaaacttgttaatccgttatcctcaaaaatttatgataaaaatggcgatttggtatatgaatacgggaaagaaaagcggacgaatgttacgtatgatcaaattcctaaattagtagaaaatgcatttttagcaacagaagattcacgtttttatgagcatagtggagtagactttaaaggtactgcccgtgctgtcttggtgagtcttaaaggagattacggttcacaaggtggaagtacaataacgcaacaggttattaaaaactacttcttatcgatggaaaaaacatcaaaacgtaaggtccaggaaatatatttagcgtataaactagaacaacaatattcaaaacatgaaattttagaaatgtatttaaataaaattaacttaggaaaccgttcatatggtatcgcaacagcagcacaaaactactatggtaaagaattgaaagatttaacattaccagaagttgcgatgcttgcaggtttaccgaaagcaccgaataactatgatccaacgaaaacggagaatattcaaagagcaacagaaagaagaaatgttgtactaggattaatgaatcgacatggctatattacgaaggcagaaatggaagaagcttcaaaagttgaagtgacaaagggacttaagacagcaacggaacttcaaacaatgccgcatactgcatttatggatgccgtagtgaaagaagtagaaaaagaaataccagatgttaatattggatctgatggcttagaaatttatacaacattagacccgaaagcacaagaatttgctgataagattttaaatgacaatattattaattatccaaatgataagttccaaggtgctttcacatttatggatacgaaaacaggagaagttcgtgctataggtagtggacgcggtgaaaataaagcagtatttaaagggcataatatggcaattgaattagatcgtgcagctggttcaactatgaagccaatctttgattacggtcctgcaattgaatacttaaaatgggctacgtatcatcaaattgatgattctccatttaaatattcaactggacaagaacttcgaaatgcggatagaagtcacttaggcccaattactatgcgtgaagcgctaaaaatgtcacgtaacgttccagcagttaaaactgcaaaagaagtaggactgaataaatcaaaggaattctctgagaaattaggtattacatttaataaaccgccggcagaatctacagcgattggtacaaacgaagtatcaccaactgaaatagcaggtgcttatgcgacatttggtaatggtggaaagtatgcaaaaccgcattttgttaagaaagtagtttatccagacggtaagtcacaaagttttgagcaaaaaccaaaacaagttatagctgactctacagcatatatgattactgatatgcttcgttcagtagtaacatctggtactggtacagcggcaaatataagttctttagatgtagctggtaaaacaggtacaacaaactatgattcaaaacaactagcgaaatataacattccagaaagtgcaacccgggatagttggtttgcaggttatacgccgcaatatacgatggcggtatggactggatatatgaaagatggtaaagacgagtatattagtagtaaaaatacgaaaattgcacagttgatctttaaagaaatgatgagtaagtttgctactgacaaatcaagctttaaaatgccaagtagtgttattcaagaaggtagtgagctacgtataaaaggggaaaaacgtgattcttctccaaatacgagcgtacctgatacaacggaacaaccaaaacaagatcaacagcaaaagactgaagaagagaaaaagcaagaagaattaaagaaacaagaagatcttaaaaaacaagaagaacaaaagaaacaagaggaacttaagaagcaagaagaacaaaagaaactagaagagcaaaagaaacaagaagaagaaaagaaacaaaatgaacaaaataatggaaatggccaaggaaatacaacacctccagcaaataacggaggaggccaaggaaatacgacacctccagcgaataacggaggaggtcaaggaaatacgacacctccagcaaataacgggggaggtcaaggaaatacgacacctccagcaaataacggaggaggccaaggaaatacgacacctccagcgaataacggaggaggccaaggaaatacgactccaccagcgaccacagaaccaaatactggcggtaatgcaggagaggcccctgctaataatggacaataa

SEQ ID NO: 50099 - protein, 837 aa, Bacillus cereus ATCC 10987
MSENYRSREERRQVKKKKQPASKTQKPKGKTSFFRKFLITCLLLGIVGLVGGVATFFVMIKDAPKLEKAKLVNPLSSKIYDKNGDLVYEYGKEKRTNVTYDQIPKLVENAFLATEDSRFYEHSGVDFKGTARAVLVSLKGDYGSQGGSTITQQVIKNYFLSMEKTSKRKVQEIYLAYKLEQQYSKHEILEMYLNKINLGNRSYGIATAAQNYYGKELKDLTLPEVAMLAGLPKAPNNYDPTKTENIQRATERRNVVLGLMNRHGYITKAEMEEASKVEVTKGLKTATELQTMPHTAFMDAVVKEVEKEIPDVNIGSDGLEIYTTLDPKAQEFADKILNDNIINYPNDKFQGAFTFMDTKTGEVRAIGSGRGENKAVFKGHNMAIELDRAAGSTMKPIFDYGPAIEYLKWATYHQIDDSPFKYSTGQELRNADRSHLGPITMREALKMSRNVPAVKTAKEVGLNKSKEFSEKLGITFNKPPAESTAIGTNEVSPTEIAGAYATFGNGGKYAKPHFVKKVVYPDGKSQSFEQKPKQVIADSTAYMITDMLRSVVTSGTGTAANISSLDVAGKTGTTNYDSKQLAKYNIPESATRDSWFAGYTPQYTMAVWTGYMKDGKDEYISSKNTKIAQLIFKEMMSKFATDKSSFKMPSSVIQEGSELRIKGEKRDSSPNTSVPDTTEQPKQDQQQKTEEEKKQEELKKQEDLKKQEEQKKQEELKKQEEQKKLEEQKKQEEEKKQNEQNNGNGQGNTTPPANNGGGQGNTTPPANNGGGQGNTTPPANNGGGQGNTTPPANNGGGQGNTTPPANNGGGQGNTTPPATTEPNTGGNAGEAPANNGQ

SEQ ID NO: 50100 - DNA, 2496 bp, Yersinia pestis biovar Medievalis str. 91001
  CDS (1)..(2496)
atgcgcgtggagataggaaacatgtctggggacgatcgtgagccgatagggcgcaagggcaagaaagcccaacccaaagcagcaccaaaacgtccactgcgccgtcggcgtgatgaagatgaatacgaagaagattatgacgaagaacaaaatgattatgatgacgaggaggaaccgatgccaagaaaagtagcatcacgcccacctcgcaagaaacgccgttggctcgggttgttgatcaaactgttcctgattggggccgtggctttggcgatctatggggtttacctcgattcgcaaatccgcagccgtattgatggcaaagtctggcaattaccggctgccgtgtatggccgcatggtcaatcttgagccgggtatgtcctacagcaaaaaagagatgatcgccttgctggaagggatgcaataccgtcaggtcagtcgcatgacccgccctggggagttcacggttcagaacgacagtatcgatatcttgcgccggccgttcgatttccctgatggtaaagaaggccaaattcgcgcccgtttactgttcaaaaatgatcgtctggcccagattcaaaacctggataatcagcgtgatttcgggctattccgcctcgatcccaagttgattaccatgctgcaatcacctaacggtgaacagcgtctgtttgttccgcgcgccgggttccctgatttgctggtggacaccttgctggcgactgaagaccgccatttctatgagcatgatggcgtcagcccgtattccattgctcgagccgtggtcgctaacctgacagccggtaaagcggtgcaggggggcagtacgctgacgcaacagttagtgaaaaacctgttcctgaccaatgaacgttcgctggtacgtaaacttaacgaggcctatatggccctgttgatggattatcgctacagcaaagatcggatcttggaactctatctgaacgaagtctatcttggtcagagtggtggtgaccaaatccgtggcttcccgctgggtagcttgtattactttggccgcccggttgatgaattgagtctcgatcagcaagccatgttggttggcatggtgaaaggggcctcactgtataacccgtggcgtaatcctaagctggcacttgagcggcgtaatttggtcctgcgcttgttgcagaatcaagggattatcgatgctgagctttacaccatgctcagtgcccgtccgctgggggtgcagccgaaaggcggagtcatcacacctcaacctgcttttatgcagatggtgcgccaggagctgcaacagaagttgggtaacaaggtcaatgatctgtctggcgtgaagatcttcaccaccttggatccggtttcacaagatgccgcagaaaaagccatcgaagacggtgttccggcgctgagagccgcccgtaatatgaatgacctggaagcggcgatggtggtggttgaccgtttcagtggcgaagtgcgtgccatggtgggcggttcacagccacaatttgccggttttaaccgtgcgatgcaggcccgccgtttggtggggtcacttgccaaaccaccaacctatctggccgcgttgagtgagccggataagtaccgcctcaatacctggctttcggaccaaccgctgtcgcttaaattgtcgaacggttcattgtggcagccgaaaaactatgatcgccagttccgtggtcaggtcatgttgatggatgcgttggtgaactcactgaacatcccaacagtcaatttggggatgtcagtgggcttagatcagatcagcgccacactgcaacgccttgggatcccgaaatcagtcattaatccggtcccagccatgttattgggggcgattgacctgactccggttgaagttgcgcaggagtatcagacaatcgccagtggtggcaaccgtgcaccgttgtcggctgtgcgttcggttattgctgaggatgggaccgtgctgtatcagagcttcccacaggcagaacgtatggtgcctgcacaagcttcttacctgacgctgtatgcgatgcagcaaggggttgtccgtggtacatcacgctctctctcggcgaagttcggcaaatataatctggcggccaaaaccgggacaaccaacgatctgcgtgacagttggtttgccggtattgatggcaaagaagtgaccattgcctggattgggcgcgacaataacggcccgactaagctgaccggggccagcggcgcgctaaccttgtatcgccgctatctggaaaaccaaacgccgttgccgctgattctgcaaccgccagaaggcattagccaaatgaacattgattcggcggggaacttcgtctgtggtgaagggagcgggatgcgcgtcattcctgtttggaccgaaaatccgcaagctttgtgtcagggatcaacacccactcaagaccccacaaaacctaacgatgatggtgttgccgattggatcaaagagatgtttggccaataa

SEQ ID NO: 50101 - protein, 831 aa, Yersinia pestis biovar Medievalis str. 91001
MRVEIGNMSGDDREPIGRKGKKAQPKAAPKRPLRRRRDEDEYEEDYDEEQNDYDDEEEPMPRKVASRPPRKKRRWLGLLIKLFLIGAVALAIYGVYLDSQIRSRIDGKVWQLPAAVYGRMVNLEPGMSYSKKEMIALLEGMQYRQVSRMTRPGEFTVQNDSIDILRRPFDFPDGKEGQIRARLLFKNDRLAQIQNLDNQRDFGLFRLDPKLITMLQSPNGEQRLFVPRAGFPDLLVDTLLATEDRHFYEHDGVSPYSIARAVVANLTAGKAVQGGSTLTQQLVKNLFLTNERSLVRKLNEAYMALLMDYRYSKDRILELYLNEVYLGQSGGDQIRGFPLGSLYYFGRPVDELSLDQQAMLVGMVKGASLYNPWRNPKLALERRNLVLRLLQNQGIIDAELYTMLSARPLGVQPKGGVITPQPAFMQMVRQELQQKLGNKVNDLSGVKIFTTLDPVSQDAAEKAIEDGVPALRAARNMNDLEAAMVVVDRFSGEVRAMVGGSQPQFAGFNRAMQARRLVGSLAKPPTYLAALSEPDKYRLNTWLSDQPLSLKLSNGSLWQPKNYDRQFRGQVMLMDALVNSLNIPTVNLGMSVGLDQISATLQRLGIPKSVINPVPAMLLGAIDLTPVEVAQEYQTIASGGNRAPLSAVRSVIAEDGTVLYQSFPQAERMVPAQASYLTLYAMQQGVVRGTSRSLSAKFGKYNLAAKTGTTNDLRDSWFAGIDGKEVTIAWIGRDNNGPTKLTGASGALTLYRRYLENQTPLPLILQPPEGISQMNIDSAGNFVCGEGSGMRVIPVWTENPQALCQGSTPTQDPTKPNDDGVADWIKEMFGQ

SEQ ID NO: 50102 - DNA, 2757 bp, Leptospira interrogans serovar Copenhageni str. Fiocruz L1-130
  CDS (1)..(2757)
atgaagatgatggagactgggattcagactctaaaaacgactcgatttttatgtcctgaatgtggaactacttctaggcttccggaaggagttcctaccggttctgtttttagacttacttgctatcaatgtgggcacaaggttttggtgagagcggatattccaaaagttccggctccagttcagccatccgacaaaattttgcgtcatccggaattacctaaaaatgtaggaactcctaaattgcagtctgctccacagtttcagcctgagccgacaattccccaaacatccgggcccggaatttttgaaaaactttccgagattcagaatagactgcgacagaaattgtgggaactcacacaaaaatttagggaaataaaaaagaatcgagttgaatccgataccgttctatcgagttcgcattcacttcttagaaaagaaaagattacattcgaaaaaaaaccgtttttaaccgttagacgagaaattggggcaaatggccaacatacagtcaaaacacttgctgaaagactcagagaacaaataggcaatcgtaatatccgacttccgaatgtgattttactttctttgggagcggttatttctctacttcttttgggaatgatccttttttgggtgggagttattactcgagagtcggaactcaaagagatgatttctttattctataatcatcaaccttctgtgatctacgatcgggatggaaaaaaggtctctgaaatttttgcaaaaaaaacgagtaatctggaatgggacgcttatcctgaaaacctgaaaaagatcgtgctgttggtagaagatcgtaaatttttttcccacggcggaatcaattatatgtctttactccgtgcgatttttgtaaacattacaagttttcgatttaaacaaggggcttccaccatcacacaacagctcgcaaggatcttgttagacgatagggaaaaaagtctcgtccgaaagatcaaagaggcgcagcttgcttttgctttagaatattcatatgaaaaaaagcaaatattcttatattatttaaataatgtatatttaggacacggggcgtttggatttgcgagcgcagcagaattttatttcaaaaaaactccttctgaactcaatacggaagaaatgattgtacttgcttccttggcttctgccccaaatcgtttttcacctttgaaaaatcctgatctttctagacaaagggtcaacgcgatcattcactcttttagggaggatcaaatcctaaaggaaaatcccaaggcaaagctcgatgaaatttatctttcttttcacatgagatctcccggagaaaccgtatttggaaatcgaaaggatcattctccttatgtaaccgaacacgtacgtaaatttttgaattctttatacccagattccaatatctacgaaactggaggattttctatttatactactgtttctgagccagttcaagcggaacttccaaaaatcgtaaagaactatgtagataacgtgcagaaaaacgggttggtccggaaaacaagacttacagataataaaaattctagcgaaaccgctgtttttagaagatatatacaagatctttcgccagcgttagaattatttatcgatacggattcttttggtggtcaaaacgaatctggattgcaagtagcgttagtcgccgttgatccttcaactggagagattctattgatgcacggtggttccgaatttaaagcggataatcaattggacagaactactgctatgaaacgtcaaaccggatcttctatcaaaccgattttatattccgcagcgatagagaccggactgatcaacgcttcttctcgaattttagacgcaccgttaatttatagaaatcaaaccggaaactggatgcctgaaaatattggaaatcaatacgacggagatattagcgttaggcttgctttagcaaaatctaaaaataccgcagcggttcaaattgctgagaagttaggaatatcaaagattcaagatttttttcaaaaatattttttccctgatttgaaagtattatcttctagatttagaggagatctttccttagctttaggttctttagaaatttcgccattggaaatggctcttgcttattctgcgtttgcaaatgacggagtgatcaaacgtccttatctaattcaaaagatcacggatcgatctggaaagattgtatttgaaagaaaatctacggatgagttcggtttaaaagttccggaagaaagaaaggtagtatcttctcaggtcgcagagataatgatcgacctacttcatgggagcgcaaattctgcaggagtaagaagtactggatatagaggagaagttgcaggtaaaactggaaccacaaacgacaacagagataactggtttgtgggagtaaaacccggaatgtcaatggcgatttggttaggatacgatgatcctagttacggactcggctcatccgcgttaggtggaactgtcgcggctcctctttggggaaccgttgctaaaattttcgaagcggcggaaggttcggacgaaagaagaaaatattccattagtgaacatgcaattagcacaaccgtctgtgaagaatcaggtaaacttcccggtccttcttgtaaacatcctagaaaggaactttttaagaacggaactgtaccttctgaagtttgtcccctaaatcacggaacggatgtaaagcgagaagtccttcgtaatgtattttaa

SEQ ID NO: 50103 - protein, 918 aa, Leptospira interrogans serovar Copenhageni str. Fiocruz L1-130
MKMMETGIQTLKTTRFLCPECGTTSRLPEGVPTGSVFRLTCYQCGHKVLVRADIPKVPAPVQPSDKILRHPELPKNVGTPKLQSAPQFQPEPTIPQTSGPGIFEKLSEIQNRLRQKLWELTQKFREIKKNRVESDTVLSSSHSLLRKEKITFEKKPFLTVRREIGANGQHTVKTLAERLREQIGNRNIRLPNVILLSLGAVISLLLLGMILFWVGVITRESELKEMISLFYNHQPSVIYDRDGKKVSEIFAKKTSNLEWDAYPENLKKIVLLVEDRKFFSHGGINYMSLLRAIFVNITSFRFKQGASTITQQLARILLDDREKSLVRKIKEAQLAFALEYSYEKKQIFLYYLNNVYLGHGAFGFASAAEFYFKKTPSELNTEEMIVLASLASAPNRFSPLKNPDLSRQRVNAIIHSFREDQILKENPKAKLDEIYLSFHMRSPGETVFGNRKDHSPYVTEHVRKFLNSLYPDSNIYETGGFSIYTTVSEPVQAELPKIVKNYVDNVQKNGLVRKTRLTDNKNSSETAVFRRYIQDLSPALELFIDTDSFGGQNESGLQVALVAVDPSTGEILLMHGGSEFKADNQLDRTTAMKRQTGSSIKPILYSAAIETGLINASSRILDAPLIYRNQTGNWMPENIGNQYDGDISVRLALAKSKNTAAVQIAEKLGISKIQDFFQKYFFPDLKVLSSRFRGDLSLALGSLEISPLEMALAYSAFANDGVIKRPYLIQKITDRSGKIVFERKSTDEFGLKVPEERKVVSSQVAEIMIDLLHGSANSAGVRSTGYRGEVAGKTGTTNDNRDNWFVGVKPGMSMAIWLGYDDPSYGLGSSALGGTVAAPLWGTVAKIFEAAEGSDERRKYSISEHAISTTVCEESGKLPGPSCKHPRKELFKNGTVPSEVCPLNHGTDVKREVLRNVF

SEQ ID NO: 50104 - DNA, 2088 bp, Thermus thermophilus HB27
  CDS (1)..(2088)
gtggccgtgcggcttgcgcggctactcctctggggcctttggggggcggttttgggcggggcgggggcgttggggtatttggtctacgcctacacccgggacctgcccgacctctccgcctttgagaggctccggctcaccgccaccaccaccctctacgcccgggacggctccaccctcgccctcctcgccagcgtggaggacgggcgggccatcaaccggagcctggtccgcctctctgaggtctcgcccgcggccctcgccgccatcgtcttctccgaggaccggcgcttctacagccactacggcgtggatcccgtgcgccttctcggggccctgtacgcggtgctcaccggggacctccagggggggagcaccatcaccacccaggtcatcaagaacaccctcctcaaggaactcgcccaggcccgcaccctggagcgcaaggtgaaggagtgggtcctggccctggagctggagaggcgctacaccaaggcggagatcctggagatgtacctcaacgtggtcccctggggggggaacgccgtgggcatccgggccgccgccgaggcctacttcggcaaggaccccgcggccttgaccctcgccgaggggctctatttggcgagcctcatccccgcgcccaacgcccgctaccaggacctcgagggggtgcgccgccgcatgcgccgggtcctggacgagatggtccgggagggctggattacggaggccctggcggagcaggcctggaaggagccgcttaagccccggggctgggaggtgcgctacgacgaggagggcaaccttctggaggcccgcctggtggacccggaggcccgcatcctccgctccgtggactaccgcctcgccccccacttcgtcctcgaggtgcggcgcttcctggaggagcgcttcggcaaggagaaggtctacggggagggggggcttagggtctacaccaccctggacccgaggatgcaggaggccgcggagaaggcggcccgggcggcccggcttcccgagggggcggacctcgccatcgtgggcctggacccggagacgggggaggtcttggccatggtgggcggggtgcgccgggagaacgacgagtacaaccgggcgacccgggccctgagaaacccggggagcgcggtcaagcccttcgtctacgccgccgccctggaggcgggctggacccaggtgaccctggtgcccgaccggcccatggagttcaaggacccgagccagcctgggggcgtctggcggcccaagaacttctccggcaccttcctgaaccgggagatcacggtgcgctacgccctggacctttccctcaacctccccgccgtctacaccgcccaggcggtgggcctggaccgggtggcggcgaagctcgcccaggcggggttcgcggtgcgctacgccgtccccgccatcgccatcgggggggcctccattacccctgtggacctggccgcggcctacgccgccttcgtcaacggcggctaccgggtggcccccctcctggtcctgcggatggaggaccaggagggccgggtcctgtaccaggccgctccccacaggacccggctcttcagcccggaggtggcctaccagggctgggacctcctcaaggggtacgtctacgacctgggggagaagggcctcgccaagggggccaggatcccggggcgggtggtgggggggaagacgggcaccaccaacgaggcccgggacctctggttcgccggggtgacccgggggctttccgccgtggtctgggtggggcgggacgacaaccggcccctcaggatgggggggagggagcccagtagctccgtggtcaacccccccatctggcggaacttcgtggccgaggccctaaaggggcgccctgggggcgacttccctcccccttcggggcttgtgcccgtgcgggtggacctggagaccggcctgccgagcgagaagggggtggtggtctacgtgcccgagggcaaggtgccctcggggaggcccccggaggaaagccccgccttgccccttcccctccccctcctcacgcccccggggggcgggctttag

SEQ ID NO: 50105 - protein, 695 aa, Thermus thermophilus HB27
MAVRLARLLLWGLWGAVLGGAGALGYLVYAYTRDLPDLSAFERLRLTATTTLYARDGSTLALLASVEDGRAINRSLVRLSEVSPAALAAIVFSEDRRFYSHYGVDPVRLLGALYAVLTGDLQGGSTITTQVIKNTLLKELAQARTLERKVKEWVLALELERRYTKAEILEMYLNVVPWGGNAVGIRAAAEAYFGKDPAALTLAEGLYLASLIPAPNARYQDLEGVRRRMRRVLDEMVREGWITEALAEQAWKEPLKPRGWEVRYDEEGNLLEARLVDPEARILRSVDYRLAPHFVLEVRRFLEERFGKEKVYGEGGLRVYTTLDPRMQEAAEKAARAARLPEGADLAIVGLDPETGEVLAMVGGVRRENDEYNRATRALRNPGSAVKPFVYAAALEAGWTQVTLVPDRPMEFKDPSQPGGVWRPKNFSGTFLNREITVRYALDLSLNLPAVYTAQAVGLDRVAAKLAQAGFAVRYAVPAIAIGGASITPVDLAAAYAAFVNGGYRVAPLLVLRMEDQEGRVLYQAAPHRTRLFSPEVAYQGWDLLKGYVYDLGEKGLAKGARIPGRVVGGKTGTTNEARDLWFAGVTRGLSAVVWVGRDDNRPLRMGGREPSSSVVNPPIWRNFVAEALKGRPGGDFPPPSGLVPVRVDLETGLPSEKGVVVYVPEGKVPSGRPPEESPALPLPLPLLTPPGGGL

SEQ ID NO: 50106 - DNA, 2151 bp, Bartonella quintana str. Toulouse
  CDS (1)..(2151)
atgtttgacttttttaaaaaaaagaaagcacaacagaataaaccatttcatagtcctgcacttattgaactagatgcactattagacacagcactttatcacattcgatctgctaacagttttttctggaacagggcaaaaattatctcacaatgcttttatatacgaggatggaaacgatttataatcgaaattcttgatgaaacacttacattaggattgattggttttactcttttcaccatcgccggcatttctgttttcgaattaacaaaaaaaaattggtattttcctcagaatttttccattctttttctagatcgatatgcgaatcctatcggtcatcgtggtgcactgccagctacacctgtccctattgaagaaatgcctgattatgtcattaaagcagtcctcgcaacagaagaccgtcgttttttcgatcattggggtattgatttgcaaggtctcacgcgagcaatcttacacaatatgcaagctaaaagtgtggttcaaggtggttcaaccattacacaacaactggctaaaaatttgttcttaacaaatgaaagaaccataacacgcaaaatcaaggaagcttatcttgccctttggttagaagcaaacttcagcaaaaaacagattttgcaactttatcttgaccgcgcatacatgggaggaaacaattttggtatcgcagcagctgcgaaattttattttggtaaaaatatacgcgatgtatcccttagcgaatccgctatgctagcaggactcttcaaggctccaaccaaatacgctcctcataatcacctatttgctgcccaaacacgtgccaatgtggtactttctaaccttgttgatagtggcttcatgactgagagccaaattatcaacgctcatcgccatcctgccagtgctcttacaaaaataaaaagtaaccaacctgattattttcttgattgggtatttgacgaaatcaaaaaaatgcgtgatcaacttccaagccatagtttgatcattcaaactactcttgatccagatatccaaaaagtagccgaggaatcaatcgcatatcatttgcaccaatatggtcaacaatatcgcgcaacacaagctgccactgtcatacttgacaataatggagctgtacgtacaattgttggaggattggattatagcaaaagccaatttaacagagcaacacaaggcggacggcaacctggttcttcattcaaaccttatgtttacgcagctgcaatggaacgtggtctgtctccttcaacaatagtcttagattctcccatcaattggggaggctggtcaccaaaaaataattctggtcgttatctcggtaaaatcgatttagcaactgctttagctttttctatcaatacagtgcctgtctatcttacatatcaataccttaaccgaaacacccaaccaatcataaatctaatcaaaaatatgggtattaatgctcatattttatcacataaaactatgattctgggcacatccaatatgacacctatggatcaggcaaccggtttcaatgtctttgctaatggaggcatggctggtaatcgccatggtttcacacaaatcagaacaacagatgggcatgtagtgtgggattttgagcataacggtgataaaccacatcgagtactcagcgaacaatcagcggcttatatgaaccaaatgatggttggtgtcaccacacgaggatcgggtaaacgtgctgctctccccatgacccttgttgctggaaaaactggaacatcacaatcctatcgcgatgcatggtttgttggctttaccggtaactatactggagctgtatggatgggtaatgatgatttttcaccgatgaatcgggcttttggtggcggcatacccgccatgatatggcatcgcatcatgctgtctgcacaccaaaatatcatgctcaaacagctctatggtgtcaaagattcgcttctcccttatcagctcccccctctttcttcccatgatgattgtgagcttgcatccaaaataccctctactctttcccctgaaacattgaatattgtgcgtctgattaataaagatctaaaaaatccagctgcaatctcctcgaagatgagaaccattggagcttcaacattttaa

SEQ ID NO: 50107 - protein, 716 aa, Bartonella quintana str. Toulouse
MFDFFKKKKAQQNKPFHSPALIELDALLDTALYHIRSANSFFWNRAKIISQCFYIRGWKRFIIEILDETLTLGLIGFTLFTIAGISVFELTKKNWYFPQNFSILFLDRYANPIGHRGALPATPVPIEEMPDYVIKAVLATEDRRFFDHWGIDLQGLTRAILHNMQAKSVVQGGSTITQQLAKNLFLTNERTITRKIKEAYLALWLEANFSKKQILQLYLDRAYMGGNNFGIAAAAKFYFGKNIRDVSLSESAMLAGLFKAPTKYAPHNHLFAAQTRANVVLSNLVDSGFMTESQIINAHRHPASALTKIKSNQPDYFLDWVFDEIKKMRDQLPSHSLIIQTTLDPDIQKVAEESIAYHLHQYGQQYRATQAATVILDNNGAVRTIVGGLDYSKSQFNRATQGGRQPGSSFKPYVYAAAMERGLSPSTIVLDSPINWGGWSPKNNSGRYLGKIDLATALAFSINTVPVYLTYQYLNRNTQPIINLIKNMGINAHILSHKTMILGTSNMTPMDQATGFNVFANGGMAGNRHGFTQIRTTDGHVVWDFEHNGDKPHRVLSEQSAAYMNQMMVGVTTRGSGKRAALPMTLVAGKTGTSQSYRDAWFVGFTGNYTGAVWMGNDDFSPMNRAFGGGIPAMIWHRIMLSAHQNIMLKQLYGVKDSLLPYQLPPLSSHDDCELASKIPSTLSPETLNIVRLINKDLKNPAAISSKMRTIGASTF

SEQ ID NO: 50108 - DNA, 2463 bp, Bartonella quintana str. Toulouse
  CDS (1)..(2463)
atgattttttttagatatcttctgagttttgttgttgcgattgggttttggggagcaatgatgcagagagcgatggcaaagagccaggcgagcgcgcttcctgattatgaagttctttcgctctatgagccccctgtgatgagtcgcgtccatgcttctgatggtagccttatggcagaatttgcaacaaaacatcgcctctatttaccaattcagtcaataccaaagcttcttaaggatgcttttatttcggccgaagacaaaaatttttatcatcattttggtttagatcccgaagggctttctagagccttgatcaataatattcgcaatattggttctggaaagcgtccagaaggagcgtcaactattacacagcaggtcgctaaaaactttcttttaagttcagacgcaacgttgaagcgtaaattaaaggaagctatcttggcgatgcgtatcgagaagacttattcgaaggatcatattctcgaactttatctcaatgaaatttatcttggtcgcagcacttatggtattgcagcagcatctttgacctatttcaataaatctgtcaatgatcttaccttagagcagtgtgcttatttggctgctcttccgaaagggccggcaaattatgacccattcaaaaatacacaacgcgctattaatcggcgcaattgggttatagatcgaatggttgcaaatggatatgtatcgcgtcaacaaggtgaaaaagctaaagcaaaacctttaggagctacaatgcgcggtagcgatagctatgtttttgctgctgactattttactgaagaagtgcggcgtcgtttaatccatcgctatggaactcaaacactttacgaaggtggactttcaattcgcacaacgcttgatccacatttgcaacttattgcccggcgtgctttgcacaatggattaattaaattcgatcattcgcagggatggcgcggagcttacggacatattgataagaaagatgattggggtatagaacttgcaaatattgctaggttaagtgatgttcctgaatggcgtttagcagttgttctttctgctaacggaaataaagtagaaattggtttacaaccaaagcgcgaagctccaggtttattatcaacaaagcgggaaattgctgttttgtctgaagccgattcaaaatgggcattacatattgttaaagaaaatggccatcgaagaactgttcaggatttatctcatgtcctgcaagttggagatgtcatttttgtcgaaaaaacttcaaacacagacaatatttatcgtttacaacaaatcccaaaggttgagggtgcaattgttgctatggaacctcatacagggcgtgttctagcgatggtgggaggattttcttttgcagcgtctgaatttaatcgtgcaacacaagcctatcgtcagcctggttctgctttcaaaccttttgtgtacgcagcagcactcgataatggatatacaccagcatctgttattttagatggtcccattgaaattcgccaatataatggtgaaatttggcaacctaaaaattatcgtggtacctttgctggaccttcaacactgcgttatggcatcgaacattctcgtaatcttatgacggtacgacttgccaatgatatgggaatgcctattgtcgctgaatatgcagagcgttttggtgttgtagataaattgcaaccttatctccccatggctttaggagctggcgaaacaacagttttacggatggttacagcttattcagttattgccaatggggggcgctctattcatccttctctgatagaccgaattcaggatcgttatggaaaaacgatttaccgtcatgatgatcgtctctgtgaaaattgtaatgctcagtcatgggataatcaaagtgaacccacattgattgatgagcgagatcaagttcttgatcctatgacagcttatcaaattacatcaatgatggagggggtcgttcagcgcggtacagcggcacgtttacgtttcctcaatcggcatattgccgcaaaaacaggaacaactaatgactctaaagatgcgtggtttatgggatttacccctgatcttgttgttggtatttttatcggttacgataaaccagcaccgttaggatacaatggaacaggaagttcgctggcagcacctatttttggtgaatttatggcagcggctctaaaagggaagccagatatgccatttaagatgccagaaggtatgattttaatgccgattaatcgtaaaacaggtatgcttgctgaagcaggagatcgtgatgtcattctagaagcatttaaaccaggaactggacctgctaatatataccaggtaattggtagcacgaattcttttcaggaaggtattccttcaggaacgacttctccacaggttaataaggctcttgaaagtggtacaggtgggttgtattaa

SEQ ID NO: 50109 - protein, 820 aa, Bartonella quintana str. Toulouse
MIFFRYLLSFVVAIGFWGAMMQRAMAKSQASALPDYEVLSLYEPPVMSRVHASDGSLMAEFATKHRLYLPIQSIPKLLKDAFISAEDKNFYHHFGLDPEGLSRALINNIRNIGSGKRPEGASTITQQVAKNFLLSSDATLKRKLKEAILAMRIEKTYSKDHILELYLNEIYLGRSTYGIAAASLTYFNKSVNDLTLEQCAYLAALPKGPANYDPFKNTQRAINRRNWVIDRMVANGYVSRQQGEKAKAKPLGATMRGSDSYVFAADYFTEEVRRRLIHRYGTQTLYEGGLSIRTTLDPHLQLIARRALHNGLIKFDHSQGWRGAYGHIDKKDDWGIELANIARLSDVPEWRLAVVLSANGNKVEIGLQPKREAPGLLSTKREIAVLSEADSKWALHIVKENGHRRTVQDLSHVLQVGDVIFVEKTSNTDNIYRLQQIPKVEGAIVAMEPHTGRVLAMVGGFSFAASEFNRATQAYRQPGSAFKPFVYAAALDNGYTPASVILDGPIEIRQYNGEIWQPKNYRGTFAGPSTLRYGIEHSRNLMTVRLANDMGMPIVAEYAERFGVVDKLQPYLPMALGAGETTVLRMVTAYSVIANGGRSIHPSLIDRIQDRYGKTIYRHDDRLCENCNAQSWDNQSEPTLIDERDQVLDPMTAYQITSMMEGVVQRGTAARLRFLNRHIAAKTGTTNDSKDAWFMGFTPDLVVGIFIGYDKPAPLGYNGTGSSLAAPIFGEFMAAALKGKPDMPFKMPEGMILMPINRKTGMLAEAGDRDVILEAFKPGTGPANIYQVIGSTNSFQEGIPSGTTSPQVNKALESGTGGLY

SEQ ID NO: 50110 - DNA, 2151 bp, Bartonella henselae str. Houston-1
  CDS (1)..(2151)
atgtttgacttttttaaaaaaaagaaagcacaacagaatagaacctttcatagtcctgcattcattgaactagatgcacttttcgatacagcactttatcgcctccgctctactaacagtctcttctggaaaaagacaaaaattatctcacagtattttcatatccgcggatggaaacgattgataatcgaaattcttgatgaaacactcacgttaggattgattggttttactctttttactatcgttggcgtttccgtttttgagttaataaaaaaagattggtatttgcctaaaaatttttccattctttttctagatcgttatggaaatcccatcggccaccgtggtgcattaccaactgcattcgtccccgttgaagaaatgcccgattatgttattaaagcggttcttgcgacagaagaccgccgttttttcgatcactggggtattgatctgcaaggactgactcgagcaatttcccaaaatatgcaagctaagagcgtagttcaaggtggctcaacccttacacaacaactagctaaaaatttgttcttaacaaatgagagaactataacacgcaaaatcaaagaagcttatcttgctctttggctagaagcaaatttcagcaaaaaacaaattttgcaactttatcttgaccgtgcctatatgggaggaaacaattttggtattacagcagctgcaaaattttattttgggaaaaacatacgcaatatatctcttagcgaatctgctatgttagcaggacttttcaaggccccaaccaaatatgctcctcatcgtcacctttttgccgcccaaacacgtgccaatgtggtattagctaatcttgttaatagcggttttatgactgagagccaaattatcaacgcccatcgtcatcctgccagggcactttcaaaaataaaaaatactcaacctgattattttcttgattgggtattcgacgaagtcaaaaaaatggcggaccaacttccaagtcatactttaatcattcaaaccactcttgatccaaatattcaaaaagcagcagaagaatcaatcgcatatcatttacagcaatatggtcaacaatatcgtgtcacacaagctgccaccgtcatactcgacaataacggcgctgtatgtgcaattgtcggaggagtggattataacaaaagccaatttaacagagcaacacaaggcggccgacaacctggttcttcattcaaaccttatgtgtatgccgccgcaatggagcatggtctgtctccctcaacaatcgtcctagatgctccaatcaattggggaggctggtcaccgaaaaataattcaggtcgttatctcggtaaaatcgatttagcaactgctttagctttttccattaatacggtacctgtctatcttacctatcaatatcttaaccgcaatacaaaacctattatagatttgatcaaaaatatggggattcatgcgcatattttatcacacaaaactatggttttaggcacatccaatatgacccctatggatcaagcaaccggttttaatgtctttgctaatggaggaatggctgggaatcgccatggttttacgcaaatcaggacaacaaatggacatgtgctgtgggactttgagtataacgggaataaactacatcgagccctcagtagccaatcagcagcttatatgaatcaaatgatggttggtgtcacaacacgaggatccggtaaacgtgccgccctccccatgacccttgttgccggaaaaactggaacatcacaatcctatcgtgatgcatggtttgttggctttactggtaattatactggagctgtatggatgggcaatgatgatttttcaccgatgaatcgagcttttggtggtggtattcctgccatgatatggcacactatcatgctctctgcacacaaaaatatcatgctcaaacagctctatggtgtcaaagattctcttctcccttatcaaccaccaacacgtccttacaataatgattctgaacctgcacttccaataccctatacgctttcccctgaaacattgaatattgtacgtctgattaacaacgatctgaaaaagctatctgtaatctctttaaaaagggaaactatcggagcttcaaaactttga

SEQ ID NO: 50111 - protein, 716 aa, Bartonella henselae str. Houston-1
MFDFFKKKKAQQNRTFHSPAFIELDALFDTALYRLRSTNSLFWKKTKIISQYFHIRGWKRLIIEILDETLTLGLIGFTLFTIVGVSVFELIKKDWYLPKNFSILFLDRYGNPIGHRGALPTAFVPVEEMPDYVIKAVLATEDRRFFDHWGIDLQGLTRAISQNMQAKSVVQGGSTLTQQLAKNLFLTNERTITRKIKEAYLALWLEANFSKKQILQLYLDRAYMGGNNFGITAAAKFYFGKNIRNISLSESAMLAGLFKAPTKYAPHRHLFAAQTRANVVLANLVNSGFMTESQIINAHRHPARALSKIKNTQPDYFLDWVFDEVKKMADQLPSHTLIIQTTLDPNIQKAAEESIAYHLQQYGQQYRVTQAATVILDNNGAVCAIVGGVDYNKSQFNRATQGGRQPGSSFKPYVYAAAMEHGLSPSTIVLDAPINWGGWSPKNNSGRYLGKIDLATALAFSINTVPVYLTYQYLNRNTKPIIDLIKNMGIHAHILSHKTMVLGTSNMTPMDQATGFNVFANGGMAGNRHGFTQIRTTNGHVLWDFEYNGNKLHRALSSQSAAYMNQMMVGVTTRGSGKRAALPMTLVAGKTGTSQSYRDAWFVGFTGNYTGAVWMGNDDFSPMNRAFGGGIPAMIWHTIMLSAHKNIMLKQLYGVKDSLLPYQPPTRPYNNDSEPALPIPYTLSPETLNIVRLINNDLKKLSVISLKRETIGASKL

SEQ ID NO: 50112 - DNA, 2463 bp, Bartonella henselae str. Houston-1
  CDS (1)..(2463)
atgattttttttagatatcttctgagttttgttgttataattgggttttggagagtaatgacgcagggagcgatagcaaaaagtcagacgagtccgcttcctgactatgaagttctttcgctctatgagccacctgtgatgactcgcgttcatgcttctgatggaagccttatggcagaatttgccacaaaacgtcgcctctatttaccaattcagtcaatcccaaaacttcttaaagacgcttttatttcagctgaagacaaaaatttttatcatcattttggtttagatcccgaagggctcgctagagctttaatcaataatatccgcaatattggttctggaaaacgtccggagggggcatcaaccattacacaacaagtcgctaaaaactttcttttaagctcagacgcaacgttggagcgtaaattaaaggaagctatcctggcaatgcgtattgagaagacttactcgaaagatcatattctcgaactttatctcaatgaaatttatcttggtcgtagtacttatggtatcgcagcagcatctttgacctatttcaataaatccgtaaatgatcttaccttagagcagtgcgcttatttggctgctcttcccaaaggtccagcaaattatgatccatttaagaatacacaacgggctattaatcggcgcaattgggttatagataggatggttgcaaatggatatgtaacacatgaacaaggtgaagaagctaaagcaaaaccgttaggggtcacaatacggggaagcgataattacgtttttgctgctgactattttactgaagaagtgcgacgtcgtctaatgcaccgctatggagcaaaaacactttacgaaggtggactttcaattcgtacaacacttgatccgcatttgcaacttattgctaggcgtgctttgcacaatggattaattaaatttgatcattcacaaggatggcgcggagcttatggacatattgataagaaagatgattggggtgtagaacttgcaaatatagctggattaagtgacgttcctgaatggcgtttagctgttgttctttctgctaacgctcataaagtagagattggtttacagccacagcgcgaagcttcaggtttattatcaacaaagcgggaaattgctgttttgtctgaaaccgattcaaaatgggcattacatattattaaagaaaatggctatcgaaaaactgttcgggatttatctcatgttctgcaagttggagatgttgtttttgtcgaaaaaacctcaaatacagacaatatttatcgtttacaacaaatcccaaaggttgagggtgcaattgttgctatggaacctcatacagggcgtgttcttgcgatggtaggagggttttcttttgcagcatctgaatttaatcgtgcaacacaagcctatcgtcagcctggttctgctttcaagccttttgtatatgcagccgcacttgataatggatatacaccagcatccgttgttttagatggtcctattgaaattcgccaatataatggtgaggtttggcaacctaaaaactatggtggcacttttgcaggaccttcgacgttgcgttatggcattgaatattctcgtaatcttatgacgatacggcttgccaatgatatgggaatgcctcttgttgctgaatatgcagagcgttttggtattgtagatgaattacaaccttatcttcccatggctttaggggctgctgaaacaacagttctacggatggttacagcttattcagtgatagccaatgggggacgctctattaatccttctttaatagacagaattcaagatcgttatgggaaaacaatttaccgtcatgatgatcgtttttgtgaaaattgtaatgctcagtcatgggataatcaaagtgaacccacattgattgatgagcgagatcaagttcttgatcctatgacagcttatcagattacatcaatgatggaaggggttattcagcgcggtacagctgggcatttgcgttatctcaatcgacatattgctgctaaaacaggaacaacgaatgactccaaagatgtatggtttatgggatttacccctgatcttgttgttggtatttttgtcggttacgatcaaccagcacctttaggatacaatggaacgggaagttcattggccgcgcctatttttggtgagtttatggcagcggctttgaaaggaaagccagatgtaccatttaaaatgccggaaggtatgattttaatgcctattaatcgtaagacgggtatgcttgcagaaagaggagagcaagatgttattatagaagcctttaaaccaggaactggacctgctgatatatatcaggtcattggaagtacgaactcttttcaagaaggtgttcctgtaataacgacttctccacaagtcaacaaggctcttgaaagtggtacaggtgggttgtattaa

SEQ ID NO: 50113 - protein, 820 aa, Bartonella henselae str. Houston-1
MIFFRYLLSFVVIIGFWRVMTQGAIAKSQTSPLPDYEVLSLYEPPVMTRVHASDGSLMAEFATKRRLYLPIQSIPKLLKDAFISAEDKNFYHHFGLDPEGLARALINNIRNIGSGKRPEGASTITQQVAKNFLLSSDATLERKLKEAILAMRIEKTYSKDHILELYLNEIYLGRSTYGIAAASLTYFNKSVNDLTLEQCAYLAALPKGPANYDPFKNTQRAINRRNWVIDRMVANGYVTHEQGEEAKAKPLGVTIRGSDNYVFAADYFTEEVRRRLMHRYGAKTLYEGGLSIRTTLDPHLQLIARRALHNGLIKFDHSQGWRGAYGHIDKKDDWGVELANIAGLSDVPEWRLAVVLSANAHKVEIGLQPQREASGLLSTKREIAVLSETDSKWALHIIKENGYRKTVRDLSHVLQVGDVVFVEKTSNTDNIYRLQQIPKVEGAIVAMEPHTGRVLAMVGGFSFAASEFNRATQAYRQPGSAFKPFVYAAALDNGYTPASVVLDGPIEIRQYNGEVWQPKNYGGTFAGPSTLRYGIEYSRNLMTIRLANDMGMPLVAEYAERFGIVDELQPYLPMALGAAETTVLRMVTAYSVIANGGRSINPSLIDRIQDRYGKTIYRHDDRFCENCNAQSWDNQSEPTLIDERDQVLDPMTAYQITSMMEGVIQRGTAGHLRYLNRHIAAKTGTTNDSKDVWFMGFTPDLVVGIFVGYDQPAPLGYNGTGSSLAAPIFGEFMAAALKGKPDVPFKMPEGMILMPINRKTGMLAERGEQDVIIEAFKPGTGPADIYQVIGSTNSFQEGVPVITTSPQVNKALESGTGGLY

SEQ ID NO: 50114 - DNA, 2043 bp, Bacillus thuringiensis serovar konkukian str. 97-27
  CDS (1)..(2043)
atgaaattgaagaacactcacttaaaaaaaatgcaggagtggttcaacaagagaaagaagcttcgtaatttattaattatattagtaagtttactcgctactctatttattgctataaatataataatttccattcaagacatatctgaattaaagcaagctgttccgcaaccgactttaatttatgatgcaaataatgaagttgcgactaaattagcttcttctaaaacagaaggtgtgaaaagaaaagatattcctgatattatggttcaagcaattgttgcagtagaagataaggaattttttaaccatcacggtatttattatagtggaattataagtgcgatttttaaaaatattacagcaggagaagttgtagcagggggaagtacaattacacaacaacttgcgaaaaatgtatttctgacacaagaccgcacatactctcgaaaaataaaggaatattttttaacaaaaaaaatagagcgtacgtatacgaaagatgaaatcattgaaatgtatatgaaccaaatttattttggtgaaggtgcttggggtataaaaagggcagctaaatcttattttgataaagatgtaaaagatttaacaatttcagaagctgcaacgattgcaggcttgattaaagcaccatctgcgtattcaccttataaaaactttaacaagtcaattgaaagacgtaatgtcgtattaagtttaatgaaagagcaagggtatatttctgacgaacagtataataaagaaaaagagagcgggcttgtgttaaaacgtggcgttgatgataaatacaagggaaaatactctcaatatgtagactatattgttagagaagcgatggacaagtacgaattaacacaaaatgaaattttagcaggtggttatcgtatttatacagagcttgatccgaaaaaacaacaggctgtagaagacgttgtgaataatgatagttatttcaaagatagtggctcagaccaacttatgcaaacgggtgtagttcttatgaatccaaaaacaggtggtgtaccagctctagtaggaggcagagggccctatcagtttttacagtttaaccatgcaacacaattaaaaagacaacctggttcaacgctaaagcctttggctgtatatgtaccagcgttagaacaaggatatgaagtatacgatatattaaaagatgaaccatttaacattaaagaatataaaccacaaaatagcgatcatacttttcacggtgatgtgacaatgtatgaagctgtggcaaaatcgtataatgtttcggctgtgtggctattagaacaaattggattagataaaggattgaaatctttagagcgatttggtattccattagtaccagaagatcgtacgtatccgattgctttaggcggtatgcatgtggggacatctccatttgtaatggctcaagcatacagtacatttgcaaatgacggtgtccaagtggaagctcatgcaattagagagatacaaaatgctgaaggtgaaacgattggaaagtggtataagaaagagacacgagtgacgagcgagaaaacttctcaaaagatgacatatttattaaaaggtgttgtcgaaaaggggacgggtgaaaaggcaaaagttactaatattgatacagcaggtaagacaggaactactcaaattgtaaatggtccgagcaccggtgcaaaggattcatggtttgttggatacacaccagatttggtaggtgcgatttgggtaggatatgataaaacagatagcgatcattatgttccaggtggtagtcaaattacgacgacaatgttccgggatattatgaaaaaagcgaacgcaaatccagctcaaaaagcattccagttatcactcatatctgaggctgattataaaaaacaattgactacaatagaagaggaaaaacgaagaaaagaagaagagaagagaagaaaagaagaagaacaacaacgaaaacaagagcagcaagagtggcttgataaagtgaaagaatggattccttcattttggtaa

SEQ ID NO: 50115 - protein, 680 aa, Bacillus thuringiensis serovar konkukian str. 97-27
MKLKNTHLKKMQEWFNKRKKLRNLLIILVSLLATLFIAINIIISIQDISELKQAVPQPTLIYDANNEVATKLASSKTEGVKRKDIPDIMVQAIVAVEDKEFFNHHGIYYSGIISAIFKNITAGEVVAGGSTITQQLAKNVFLTQDRTYSRKIKEYFLTKKIERTYTKDEIIEMYMNQIYFGEGAWGIKRAAKSYFDKDVKDLTISEAATIAGLIKAPSAYSPYKNFNKSIERRNVVLSLMKEQGYISDEQYNKEKESGLVLKRGVDDKYKGKYSQYVDYIVREAMDKYELTQNEILAGGYRIYTELDPKKQQAVEDVVNNDSYFKDSGSDQLMQTGVVLMNPKTGGVPALVGGRGPYQFLQFNHATQLKRQPGSTLKPLAVYVPALEQGYEVYDILKDEPFNIKEYKPQNSDHTFHGDVTMYEAVAKSYNVSAVWLLEQIGLDKGLKSLERFGIPLVPEDRTYPIALGGMHVGTSPFVMAQAYSTFANDGVQVEAHAIREIQNAEGETIGKWYKKETRVTSEKTSQKMTYLLKGVVEKGTGEKAKVTNIDTAGKTGTTQIVNGPSTGAKDSWFVGYTPDLVGAIWVGYDKTDSDHYVPGGSQITTTMFRDIMKKANANPAQKAFQLSLISEADYKKQLTTIEEEKRRKEEEKRRKEEEQQRKQEQQEWLDKVKEWIPSFW

SEQ ID NO: 50116 - DNA, 2505 bp, Bacillus thuringiensis serovar konkukian str. 97-27
  CDS (1)..(2505)
atgtcagaaaattatcgttctcgagaggagcgacgacaagttaaaaagaaaaaacagccagcttctaaaacacaaaaaccaaaaggtaaaacatcgttctttcgcaagtttttaattacttgtttattacttggtattgttggtttagtggggggagttgctacctttttcgtaatgattaaggatgcaccaaaacttgagaaagcaaaacttgttaatccgttatcctcaaaaatttatgataaaaatggcgatttggtatatgaatacgggaaagaaaaacggacgaatgttacgtatgatcaaattcctaaattagtagaaaatgcatttttagcaacagaagatgcacgtttttacgagcatagcggagtagactttaaaggtactgcccgtgctgttttggtgagtcttaaaggcgattacggttcacaaggtggaagtacgataacacagcaggttattaaaaattacttcttatcgatggaaaaaacatcaaaacgtaagattcaagaaatatatttagcgtataagctagaacaacaatattcaaaacatgaaattttagaaatgtatttaaataaaattaatttaggtaatcgttcatatggtatcgcaacagcagcacaaaactactacggtaaagaattaaaagagttaactttaccagaagttgcgatgcttgcaggtttaccgaaagcaccgaataactatgatccaacgaagacagaaaatgttcaaagagcaacagaaagaagaaatgttgtcctaaaattaatgaatcgacatggttatattacgaaggcagaaatggaagaagcttcgaaagttgaagtaacagatggacttaagactgcaactgtacaagcaatgccatatcctgcatttatggatgcggttgtgaaagaagttgaaaaagaattgccagatgctaatattggttctgacggtttagaaatttatacaacattagacatagacgcacagaaggctgctgacaggatattagatgctaatattattaattatccaaatgataaattccaaagtgctttcacatttatggatacgaaaacaggagaagttcgtgctataggtagtggacgtggtgaaaataaagcagtatttaaagggcataatatggcaattgaattagatcgtgcagctggttcaactatgaagccaatctttgattacggtcctgcaattgaatacttaaaatgggctacgtatcatcaaattgatgattctccatttaaatattcaactggacaagaagttcgaaatgccgacagaagtcatttaggatcaattacgatgcgtgaagcattaaaaatgtcacgtaacgttccggcagttaaaactgcaaaagaagtaggacttaataaagcgaaggaattctctgagaaattaggtattacacttaagtcagtaccagaatctacagcgattggtacaaacgaagtatcaccaactgaaatagctggtgcttatgcgacatttggtaatggtggtaagtatgcaaaaccgcattttgttaagaaagtagtttatccagacggcaagtcacaaagttttggacaaaaaccaaaacaagttatagctgactctacagcatatatgattactgatatgcttcgttcagtagtgacatcaggtactggtacagcagcaaatataagttctttagatgtagctggaaaaacaggtacaacaaactatgattcaaaacaattagcgaaatttaatattccggaaagtgcaactcgtgatagttggtttgcaggttatacgccgcaatatacgatggcagtatggactgggtatatgaaagatggtaaggacgagtatattagtagtaaaaatacgaaaattgcacagttgatctttaaagaaatgatgagcgagatggctacagataaatcaagatttaaaatgccaagtagtgtaattcaagaaggtagtgagctgcgtataaaaggtgaaaaacgtgattcttctccaaatacgagcgtaccggatacaacagaaaaaccaaaacaagatcaacagcaaaaaactgaagaagagaaaaagcaagaagaattaaaaaaacaagaagaacttaaaaaacaagaagaagaaaagaaacaagaggaactgaagaagcaggaagaacaaaagaaactagaagagcaaaagaaacaagaagaagaaaagaaacaaaatgaacaaaataatggaaatggtcaaggaacgacccctccagcaaataacggaggaggtcaaggaaatacgactcctccagcaaataacggaggaggtcaaggaaatacaacccctccagcaaataacggaggaggtcaaggaaatacgactcctccagcaaataacggaggaggtcaaggaaatacaacccctccagcaaataatggaggaggtcaaggaaatacaactccaccagcgaccacacaaccggagactggcggtaatgcaggagaggcccctgctaataatggtcaataa

SEQ ID NO: 50117 - protein, 834 aa, Bacillus thuringiensis serovar konkukian str. 97-27
MSENYRSREERRQVKKKKQPASKTQKPKGKTSFFRKFLITCLLLGIVGLVGGVATFFVMIKDAPKLEKAKLVNPLSSKIYDKNGDLVYEYGKEKRTNVTYDQIPKLVENAFLATEDARFYEHSGVDFKGTARAVLVSLKGDYGSQGGSTITQQVIKNYFLSMEKTSKRKIQEIYLAYKLEQQYSKHEILEMYLNKINLGNRSYGIATAAQNYYGKELKELTLPEVAMLAGLPKAPNNYDPTKTENVQRATERRNVVLKLMNRHGYITKAEMEEASKVEVTDGLKTATVQAMPYPAFMDAVVKEVEKELPDANIGSDGLEIYTTLDIDAQKAADRILDANIINYPNDKFQSAFTFMDTKTGEVRAIGSGRGENKAVFKGHNMAIELDRAAGSTMKPIFDYGPAIEYLKWATYHQIDDSPFKYSTGQEVRNADRSHLGSITMREALKMSRNVPAVKTAKEVGLNKAKEFSEKLGITLKSVPESTAIGTNEVSPTEIAGAYATFGNGGKYAKPHFVKKVVYPDGKSQSFGQKPKQVIADSTAYMITDMLRSVVTSGTGTAANISSLDVAGKTGTTNYDSKQLAKFNIPESATRDSWFAGYTPQYTMAVWTGYMKDGKDEYISSKNTKIAQLIFKEMMSEMATDKSRFKMPSSVIQEGSELRIKGEKRDSSPNTSVPDTTEKPKQDQQQKTEEEKKQEELKKQEELKKQEEEKKQEELKKQEEQKKLEEQKKQEEEKKQNEQNNGNGQGTTPPANNGGGQGNTTPPANNGGGQGNTTPPANNGGGQGNTTPPANNGGGQGNTTPPANNGGGQGNTTPPATTQPETGGNAGEAPANNGQ

SEQ ID NO: 50118 - DNA, 2052 bp, Bacillus thuringiensis serovar konkukian str. 97-27
  CDS (1)..(2052)
atggatcaaactatgaatccgaaacttaaaaaatataaacgtcttttcttcaccgtaatgttttcttctgttctttttttcgttttctccttttttgttattattatagttgcaaaaattatgggacctcctcctgttgctgtcccgcaaacaagtgtcttttacgctaatgatgacactgttataggacaaagtaatcaggtacaaaaacgctataatgtatctctcaatgaaatttctccttatgtaaaagaggcaacactatctatcgaagatcaacgattctacaaacatcatggctttgatatgaagcgcattgctggtgccattgttgccgatttaaaagcgatggcaaaggtccaaggtgctagtacgattacacaacaatacgcacgtaatctgtatttagatcatgataaaacgtggaaacgtaaactattagaagcaatgtacacaatccgccttgaagtaaactataataaaaatcatattttagaaggatatttaaatacaatttattacgggcatggtgcttacggaatcgaagctgcgtctcgtctatatttcgataaaacagcaaaagaattaacattagcggaggctagtatgctcgcaggtatcccgaaaggacctagtgtctattctccctttttaaaagaagatcgtgcgaaaggacgacaatctctcatattagatgaaatggtagaacaaggttatattacgaagaaacaagcagcttcagcgaagaaggagccactaactttcgcctcattagatacgaaaaaggtagcagagattgcaccttatttccaagatgctgtacaagcttctcttcttcgtgatgtcggattagatgagcaagcgttacaaaaaggtggcttgcgtatttatacaacactagacccgaaattacaatcggttgcagagcaagctgtaaaagaccacatacctgacacaacaaacatacaaactgctcttgtctctatgaatccaaaaacaggtgaagtagctgcccttgttggtggaactgattataatacgagtcaatttaacagggctacacaggccgctcgccagcctggttctacgtttaagccattcctatattacgcggcattagaacgaggattcacccctgctacgcgcttaaaaagcgaatacactgttttcactttaggtgatggtgtttcaaagtataaaccgaaaaactataaggactattatgcagacgattttgtaacaatggcgcaagctcttgcagtctctgataacgtatacgccgtgaagaccaatttatttttaggcgaagacattcttacaaaaacagcgaagcaattcggaattaagagtgcattaaaagatgtaccgtctcttgctctcggcacatctcctgtaaaaccaattgaaatggttaacgcttatagcatgttcgcaaacggtggaaaagaagtaaaacctactttcattcgccgcattatggatcatgaaggcaatatattatacgatgctcatttagagagtaaacaagttcttgataagaacaaagcgtttgtaatggaagaaatgatgacaggcatgtttaataaaaaactaagtagttatgccgctgtaactggtcaatcgatgttatctaaactatccagaacctacgccggaaaatctggttctactgaaacagatagttggatgattggatttaccccgcaaatcgtaacgggtgtatgggttggatatgatcaacctaaatcaatttcaaacgtagcagaacaaggatatgcgaaaagaatatggaccgatacgatggagaaaggcttagatggacaacctaaaaaagaatttaaacagccaagtgacgtcgttgcagtcgatattaatcctgaaaacgggaaaatcgctacaaaaaattgtccaatttcagtgaaaatgtattttgcaaaaggtacagaaccaactgagtattgtatggatcatgtagatgataaagaagaatttgaaaagacaactgaagaaaagaaaaaaacaagttggtggaagaaatatcttccttggtga

SEQ ID NO: 50119 - protein, 683 aa, Bacillus thuringiensis serovar konkukian str. 97-27
MDQTMNPKLKKYKRLFFTVMFSSVLFFVFSFFVIIIVAKIMGPPPVAVPQTSVFYANDDTVIGQSNQVQKRYNVSLNEISPYVKEATLSIEDQRFYKHHGFDMKRIAGAIVADLKAMAKVQGASTITQQYARNLYLDHDKTWKRKLLEAMYTIRLEVNYNKNHILEGYLNTIYYGHGAYGIEAASRLYFDKTAKELTLAEASMLAGIPKGPSVYSPFLKEDRAKGRQSLILDEMVEQGYITKKQAASAKKEPLTFASLDTKKVAEIAPYFQDAVQASLLRDVGLDEQALQKGGLRIYTTLDPKLQSVAEQAVKDHIPDTTNIQTALVSMNPKTGEVAALVGGTDYNTSQFNRATQAARQPGSTFKPFLYYAALERGFTPATRLKSEYTVFTLGDGVSKYKPKNYKDYYADDFVTMAQALAVSDNVYAVKTNLFLGEDILTKTAKQFGIKSALKDVPSLALGTSPVKPIEMVNAYSMFANGGKEVKPTFIRRIMDHEGNILYDAHLESKQVLDKNKAFVMEEMMTGMFNKKLSSYAAVTGQSMLSKLSRTYAGKSGSTETDSWMIGFTPQIVTGVWVGYDQPKSISNVAEQGYAKRIWTDTMEKGLDGQPKKEFKQPSDVVAVDINPENGKIATKNCPISVKMYFAKGTEPTEYCMDHVDDKEEFEKTTEEKKKTSWWKKYLPW

SEQ ID NO: 50120 - DNA, 2559 bp, Acinetobacter sp. ADP1
  CDS (1)..(2559)
atgaaaaagctatccagttcgggccgtgttcacccattttttttgttgatactcatggtacttgtttcagttccaatgggtttctacggcatgtatctttacattgcaccctcacttcctgaaatgagctcgctcaagaaagcgccacttcttaaaccattacaagtatacacctcggataaccagctgattgctgagtatggtggtaagctttctgtgcctgttgaatacaaccagattccaccaacatttattcatgcttttctggcagcagaggattcttctttttttgagcatagcggaattagcttcaaaggtctggggcgtgccttaagcgagacagtgactggttcaaatgtacaaacaggtggttcaaccattaccatgcaggtggctaaaaattattatttatcacctgagcgaacactcaaacgtaaattgaccgaaattttccttgcgcggaaaattgaacagaatttaaccaaacaagaaattctaagcctatatgtcaataaaattttcttaggcaaaaatgcgtatggtatcgctgccgctgcaaaaatttattataacaaaaccctcgatcagcttagtattgctgaaatggccatgatttcaggtttaccgaaagcaccgtcaaaatacaatcctgtggttaatcctgagcgtgcactagagcgccgtaactggattctgggaagaatgctacaactgggctatatcaatcaaacccaataccagcaagccgtggcagaaccgattaacctagacatgccagatcgtggtgtaagtaaccgttatccgtacatcggggaaatggttcgtgccgaactggtcgaaaaatttggtgaacaggctgttgattcaggctataaagtgtataccacaatcaatagccagcgtcaggcatatgccgagcaatcggtacaagatggtctcgaagcctatgatcgacgtcatggctggcgtggtgcagaagcacacgacaaaccattgcgcaattttattccttatgcaaataccttccctgccgaagtaattaaggttggaaacaatagctttgatgccttaatgcaagatggtaaaaccgtgacggtgccttggtcaggtatgtcatgggcacgacgctatcgtaatgcaaatagtgtcggtgagtctccttctcgtgcctctcaaattgtaaaagtgaaagacattgtccgtctacgtccaaatggcgataaaagtgcatggtctctggttcagattcctaaagtacaagggcaattaatcgcacttaatccaaatgatggttcaatcgaagcattggtaggtggatataacttttatcaatctaaatttaaccgtgccctacaaggctggcgtcaacctggttcaactattaagccatttatttatgccctggcactcgaacgcggcatgacaccttataccatggtcaacgatagcccaatcagtattgggcgttggtcgcctaaaaactcagatggtcgttatctgggcatgattcccctgcgccgtgccttatatttatcacgtaatacggtgtctgtacgcttactgcaaagtgttggggtcgaacgtgcacgtcagttactcatggattttggcttacaggaaaatcaaattccacgtaactttaccattgcccttggaacaccacaggttttacctatccagatggcaacaggttatgccacttttgccaatggtggttatcgtattcagccacactttattcgtcggattgaagatgcttatggcaatgtgatttttgaaaccaagccagagtatgcgtgcattccttgtattaatgaaacaaacaataccgaaacagaaatcaagccacaaacgcctgatgatgaagtgattgaggtcaataaccagtctttagatgaagcgaaaactcttgtatctccagcaaaaaccaacccagacaataacaactatcgtcaggcacagcgaatcctgaaatctagctctgcttacgatatggccaatattctgcgtgatgtcattttgcatggtacaggacgtgctgccctaaaaattggacgtgatgatttaggcggtaaaacaggaacaaccaatgatgccaaagatgcatggtttgcaggatttaatggcaaattggttgcggtagcatgggtaggctttgaccagccaacaacactgggccgacgtgaatatgggggagttgcggcacttccaatctggaccaactttatggatcagtctttaaaaggcacgccatcggcttgggttcgttttgataaaaatgcgaaagcaccactttcacgagaaaagccaaccattgaaatccagaatcgtgaagatgatcaggcatccccacctttagcacgtccattatatgttcctgcgccggtcaccccagcacgcacaccagacagtgactttgctgatttaccaggcgaagaaattttggtaccgtctcagggccagccgccgagtatgcagcaacagccatcctcaccaaagaaaaatgagacgcccaaacgaggcgatgcactggaaggattgattaatcaagtgacataa

SEQ ID NO: 50121 - protein, 852 aa, Acinetobacter sp. ADP1
MKKLSSSGRVHPFFLLILMVLVSVPMGFYGMYLYIAPSLPEMSSLKKAPLLKPLQVYTSDNQLIAEYGGKLSVPVEYNQIPPTFIHAFLAAEDSSFFEHSGISFKGLGRALSETVTGSNVQTGGSTITMQVAKNYYLSPERTLKRKLTEIFLARKIEQNLTKQEILSLYVNKIFLGKNAYGIAAAAKIYYNKTLDQLSIAEMAMISGLPKAPSKYNPVVNPERALERRNWILGRMLQLGYINQTQYQQAVAEPINLDMPDRGVSNRYPYIGEMVRAELVEKFGEQAVDSGYKVYTTINSQRQAYAEQSVQDGLEAYDRRHGWRGAEAHDKPLRNFIPYANTFPAEVIKVGNNSFDALMQDGKTVTVPWSGMSWARRYRNANSVGESPSRASQIVKVKDIVRLRPNGDKSAWSLVQIPKVQGQLIALNPNDGSIEALVGGYNFYQSKFNRALQGWRQPGSTIKPFIYALALERGMTPYTMVNDSPISIGRWSPKNSDGRYLGMIPLRRALYLSRNTVSVRLLQSVGVERARQLLMDFGLQENQIPRNFTIALGTPQVLPIQMATGYATFANGGYRIQPHFIRRIEDAYGNVIFETKPEYACIPCINETNNTETEIKPQTPDDEVIEVNNQSLDEAKTLVSPAKTNPDNNNYRQAQRILKSSSAYDMANILRDVILHGTGRAALKIGRDDLGGKTGTTNDAKDAWFAGFNGKLVAVAWVGFDQPTTLGRREYGGVAALPIWTNFMDQSLKGTPSAWVRFDKNAKAPLSREKPTIEIQNREDDQASPPLARPLYVPAPVTPARTPDSDFADLPGEEILVPSQGQPPSMQQQPSSPKKNETPKRGDALEGLINQVT

SEQ ID NO: 50122 - DNA, 2478 bp, Erwinia carotovora subsp. atroseptica SCRI1043
  CDS (1)..(2478)
atgtctcaggatgaccgcgaacctatcggacgtaaagggaaagcgccaaaacgtaagcctgaacgcaaacaggccatacgacgtcgcagggatgacgactatgatgatgactatgacgattatcaggacgactatgacgacgatgatgattacgacggcgatgacaccatgacgcggaaatcgcagagaagacggcgctggctggggctggcgatcaagctgttcctgatctttgctgtggcgatggcgatctatggcgtctatctcgacagccagatccgcagccgtatcgaaggcaaagtctggcagttgcctgccgccgtctatggccgcatggtcaacctcgagcctggcatggcctatagccagaaagagatgattagcctactggaaggtatgcaataccgtcaggtgagccgtattactcgcccgggtgaattcagcgtgcgtggtaacagcatcgatatgctgcgccgtccgtttgatttccctgatgggaaagaagggcaaattcaggcgcgcctgacctttgccaacgatcgcctgtcgcagatccagaatctggacaatcagcgtaacttcggctttttccgtcttgatccgaaactgatcaccatgatgcagtcgccgaatggcgaacagcgtttgttcgtgccacgtgccggtttccccgatctgttagtggataccttagtggcgaccgaagaccgccatttctatgaacacgatggcatcagcctgtactccattggtcgtgcgtttttagcgaacattacggcgggacgtgcagtacagggcggcagtacgctgacgcagcagctggtgaagaacctgttcctgactaatgaacgttcgctgtggcgtaaagccaacgaagcctatatggcgctgatcatggattatcgctacagcaaggatcgtatccttgaactgtatctgaatgaggtgtacctcggtcagagcggtaacgatcagatccgtggtttcccgcttgccagcctgtattactttggccgtccggtgaatgaactgagtctcgatcagcaggcgctgctggtggggatggtgaaaggtgcatcgctgtataacccgtggcgtaacccagatattacgttagagcgacgcaatctggtgctgcgcctgttgcagaatcaacaggttattgatgccgatctgtataacatgctgagtgcgcgtccgctgggcgtgcagccgaaaggcggcgtaatcagccctcaaccggcatttatgcagatggtgcgtcaagaactgcaacagcgacttggcgacaaggttaacgatctctccggcgtgaaggtctttaccacgctcgatcccgtctcgcaggatgcagcggaaagagcggtggaggtcggtataccggcactgcgtgcaggccgtaacgtcagcgatcttgaagcggcaatggtgattgtcgatcgtttcagtggagaagttcgcgcgatggttggcggtgctcaaacacagtacgctgggtttaaccgtgcgctacaggcgcgtcgtcctgtcggatcgctggcgaagccgccgacctacctgacggcgttgagccagccggatacctatcgtctgaataccttgctggcggatgagccactgtcgctcaagcaacctaacggacaagtgtggcagccgaagaactacgatcgtgaattccgtggccgcgtcatgttagtcgatgcgttggcaaactcgctgaacgtcccgaccgtcaatctggggatggctgtggggctggatcaggttacggcaacgttgaagcgtttaggtatccccgaaaacgtgattcagactgtaccggcgatgctattgggggcgatcagtctaacgccgatggaagtggcgcaggaataccagacgatcgccagtggcggcaatcgtgctccactttcctcactgcgttcggtgattgcggaagatggcacggtgctgtatcagagcttcccgcaggctgaacgagcggttccggcacaggcggcctatctgacgctatacggcatgcagcaggtggtcgaacgtggtacgtcgcggtcactggcggtgaaattcccgaattatcatctggcagccaaaacgggtactactaatgacctgcgtgatagctggtttgccgggattgacggcaaagaagtggcgattagctgggtagggcgtgataacaacggcccagccaagctgaccggggcgaacggtgcgctgacgatctatcgtcgctatctggaaaaccaaacgccactgccgttgatgctgacgccgccggaaggcataacgaccatgacggtggatgctagcggcaactttgtctgcaacggcagcagcgccggacgcgtattgccagtctggacggataaccctcaggcattgtgtcaggctagccagccgcagccttcagcgcagcaggaccagcaaaacggtgaaggtgtcgctggctggatcaaagaaatgtttggtcaataa

SEQ ID NO: 50123 - protein, 825 aa, Erwinia carotovora subsp. atroseptica SCRI1043
MSQDDREPIGRKGKAPKRKPERKQAIRRRRDDDYDDDYDDYQDDYDDDDDYDGDDTMTRKSQRRRRWLGLAIKLFLIFAVAMAIYGVYLDSQIRSRIEGKVWQLPAAVYGRMVNLEPGMAYSQKEMISLLEGMQYRQVSRITRPGEFSVRGNSIDMLRRPFDFPDGKEGQIQARLTFANDRLSQIQNLDNQRNFGFFRLDPKLITMMQSPNGEQRLFVPRAGFPDLLVDTLVATEDRHFYEHDGISLYSIGRAFLANITAGRAVQGGSTLTQQLVKNLFLTNERSLWRKANEAYMALIMDYRYSKDRILELYLNEVYLGQSGNDQIRGFPLASLYYFGRPVNELSLDQQALLVGMVKGASLYNPWRNPDITLERRNLVLRLLQNQQVIDADLYNMLSARPLGVQPKGGVISPQPAFMQMVRQELQQRLGDKVNDLSGVKVFTTLDPVSQDAAERAVEVGIPALRAGRNVSDLEAAMVIVDRFSGEVRAMVGGAQTQYAGFNRALQARRPVGSLAKPPTYLTALSQPDTYRLNTLLADEPLSLKQPNGQVWQPKNYDREFRGRVMLVDALANSLNVPTVNLGMAVGLDQVTATLKRLGIPENVIQTVPAMLLGAISLTPMEVAQEYQTIASGGNRAPLSSLRSVIAEDGTVLYQSFPQAERAVPAQAAYLTLYGMQQVVERGTSRSLAVKFPNYHLAAKTGTTNDLRDSWFAGIDGKEVAISWVGRDNNGPAKLTGANGALTIYRRYLENQTPLPLMLTPPEGITTMTVDASGNFVCNGSSAGRVLPVWTDNPQALCQASQPQPSAQQDQQNGEGVAGWIKEMFGQ

SEQ ID NO: 50124 - DNA, 2346 bp, Propionibacterium acnes KPA171202
  CDS (1)..(2346)
atggctgaccacaaacccgccagagcatcgaagcgccacgcccccgcgactgggggcggtgccggaagggctcgtcgggccgccgggaggcctagccgtcatcctaggctgggcaagtttctccggggtttggtgatcgcaatcttgtctttggtgcttatcgccgtcgttggggtctttgtcgcctatgagcgcaccgagcttcccgaccctaaccgcgacttccagacgaacacctcgtttatctactaccgggacggcagtcgcctcgggtctttctcggtacagaaccgtcaatcgatcccttatgagacgatgccgaagactctgcgtgacgccgtcgtctcggcggagaatcgcactttctggtccgatccgggtatctcggtcaagggcatgacgcgcgccgcctgggcgatcgctcgcggtggtgagatgcaaggcggctcgacgatcacccagcagtacatcaaggtgttgtacctgtcccaggaacgcaccatgggtcgcaaattcaaggagctcctcctggccgtgaagacgggcaaggaggtctctaaaaagggcattctcgctggatatctcaataccatctactttggccggggagcttatggtgttcaggctgccgctcgggctttcttctacaccgatgcttcgaagctcaccctgtctcagtcggcggtgttggctgcggtgcttaacagcccgtcaaatttcgatcccagcggtggcgtaggcgctcgcgagaggttactccagcgataccggtacgtcctcgacggaatgctggaggccggcaatatcacccaggctcagcacgacgaggcttatcggcagctgccgaaattcccgaaggtccccgactacaaccgatgggcgggaaccgacggctacctcatgaagttggtttacgacgagctcatcgccagagggttctccgatcaacaaattaagggcggtggcctcaaggtgacgaccaccctggatcgtaaggaccagcaggctgccgtggctgcaggccagaaatataagaaagttgctggccgcaacgctggtcctgagggagccaagaatctacatcctgcgcttgcctcagtcgacgtcagctccggcggtgtcctggccctttacggtggcgatgactatatttccaatacccgcgattgggcgcttactgcgcgcccggcggcatccaccttcaagacctacgcggccatagcagggatgcgccatggattcagcttgcgttcccggttggaaggtaacgctttcacacctgacggggatagcaccgaggttcacaacgagaacgaccggaactacggcaccgtcagtttgcgtcaggctattgcgaagtcgatcaacaccgccttcgtcgacatggtctcacggattaagaatggtccgagggctgttgttcaggccgctactgacgccggtttgtctcagggaactgggtgggatctgaataaccggatcgctttgggcactgctgaggtgagtccactggctcaggcggggggctatgcgacgattgccaatgacggcaaaagggttaccccacacattgtggacaaggttgttgaccagtcaggcaaggtcctctgccaggcacccacgccgtcgaagcagaccattgaggctgatatcagccatgacgtcagctacgccctgcagtcagtggttgaggaaggcactggacggattgtggccggctttgaccatcacgtggccgggaaaacgggtacttcgggagttggtcacggggtgacgtcggcgtggtttgtcgcctacaccaagcagatctcgacggctgtcatgtttgtggcgggggatagcggcaacgaaaaccttaaccgctacgcccgtgaaggggctaccggtttccacggtggtgattacccggctcgcacctggctcgactatatgcagacggcgatgagggggatgcccaacaagtccttcgctgctccagactgggtgaatctgtcaggtaagcattatggctccaccaaccgtccgcaggtgtcggtcgaggatgattccgatcgcgaccggtcgaaccagaatgatccagagtcgctgggtaggccgtctccgacgccgactcgcacgtcggcctccagcccagagccgtcatcggcgccttctcgggagcaatcctctgagccctcagcgacgagaacggcgtcggcccatacacacacctctaaacccacacagacgtcacagcctgcgcacacctctagaccgactcatacctccacccacacctctcgtccgacctcgggcgagacgacgcacggtgggaaccagctgagtggtcgggcacagaatgggtag

SEQ ID NO: 50125 - protein, 781 aa, Propionibacterium acnes KPA171202
MADHKPARASKRHAPATGGGAGRARRAAGRPSRHPRLGKFLRGLVIAILSLVLIAVVGVFVAYERTELPDPNRDFQTNTSFIYYRDGSRLGSFSVQNRQSIPYETMPKTLRDAVVSAENRTFWSDPGISVKGMTRAAWAIARGGEMQGGSTITQQYIKVLYLSQERTMGRKFKELLLAVKTGKEVSKKGILAGYLNTIYFGRGAYGVQAAARAFFYTDASKLTLSQSAVLAAVLNSPSNFDPSGGVGARERLLQRYRYVLDGMLEAGNITQAQHDEAYRQLPKFPKVPDYNRWAGTDGYLMKLVYDELIARGFSDQQIKGGGLKVTTTLDRKDQQAAVAAGQKYKKVAGRNAGPEGAKNLHPALASVDVSSGGVLALYGGDDYISNTRDWALTARPAASTFKTYAAIAGMRHGFSLRSRLEGNAFTPDGDSTEVHNENDRNYGTVSLRQAIAKSINTAFVDMVSRIKNGPRAVVQAATDAGLSQGTGWDLNNRIALGTAEVSPLAQAGGYATIANDGKRVTPHIVDKVVDQSGKVLCQAPTPSKQTIEADISHDVSYALQSVVEEGTGRIVAGFDHHVAGKTGTSGVGHGVTSAWFVAYTKQISTAVMFVAGDSGNENLNRYAREGATGFHGGDYPARTWLDYMQTAMRGMPNKSFAAPDWVNLSGKHYGSTNRPQVSVEDDSDRDRSNQNDPESLGRPSPTPTRTSASSPEPSSAPSREQSSEPSATRTASAHTHTSKPTQTSQPAHTSRPTHTSTHTSRPTSGETTHGGNQLSGRAQNG

SEQ ID NO: 50126 - DNA, 2166 bp, Streptococcus pyogenes MGAS10394
  CDS (1)..(2166)
gtgattacaattaaaaatccaaaaatccttaagtggctaaagtatgtattaagtgcaattcttagccttattatccttgttattattattggtggtcttttgtttaccttctacattagcagtgctccgaaactgtcagaagcccagttaaaatcaacaaactctagcttggtttatgacggtaataacaatctgattgctgatttgggttctgaaaagcgtgaaaatgtaacagctgatagtatccctattaatctagttaatgctattacctcaattgaagataaacgtttctttaaccatcgtggagtagatctttatcgtatttttggtgctgcctttcataatctaacgagtcagaccactcaaggggggtcaacgcttgatcagcaactcattaaactagcctatttttctactaatgaatctgatcaaaccttaaaacgtaaggctcaagaagtttggcttgctcttcaaatggagcgaaaatatactaaacaagaaatcctgactttttacatcaacaaagtatatatgggtaatggcaactatggtatgctgacagccgctaagtcttattatggcaaggatcttaaggatttatcttatgcccaactagccctattggctggaatccctcaagctcctagtcaatatgatccttaccttcatcctgaagctgctaaaaatcgccgtaacgtcgtgttgcaacagatgtacatggaaaaacatctgacgaaagcagaatatgaaactgccatcgcaactcccgtcgctgaaggtctacaatcactccaacagcgctcaacttatccaaaatatatggataattatctaaaacaagttattgaagaagtcaaaaaagaaacgaataaagatatttttaccgctggtttaaaagtttatactaatattatccccgatgcgcagcagactctttataatatttatcattctggtgattatgtttactatccagaccaagatttccaagttgcttcaacgattgttgatgtgacaaatggtcatgttattgctcagcttggcggacgtaatcaagatgaaaatgtttcatttgggactaaccaagctgttttaactgatcgtgactggggttctaccatgaagccaatcacagcctatgctcctgctattgaatctggtgtttatacttctactgctcagtcgactaatgactcagtctattattggcctggaaccactacccaattgtttaactgggaccttagatataacggatggatgacaatccaagctgctattatgctatcgcgaaatgtcccagcagtccgagcactggaagccgcaggacttgactatgctcgatctttcttaagcagtttagggattaactatcccgaaatgcactactcaaacgctatctcaagtaataacagtagctcagataaaaaatatggtgcaagtagtgaaaaaatggccgctgcatacgctgcttttgcaaatggtggtatttatcataaaccaaggtatgtcaataaagtggaatttagtgatggtacaagtaaaacttttgatgaaaaaggaaaacgtgccatgaaagaaaccacggcctatatgatgacagatatgttaaaaactgttctcacttatggtacaggtactgctgctgccattcctggtgttgcgcaagctggtaaaacagggacttctaactacactgatgaggaactagctaaaattggtgaaaaatacggcctttatccagattatgttggtacattagcgccagacgaaaactttgttggctttactaagcgctacgccatggctgtttggacaggttacaaaaaccgcttgaccccagtatacggatcaagtctagagattgcatctgacgtttatcgtagcatgatgacttacttaacaaatggttacagtgaagattggacgatgccaaatggtctttatcgcagtggtggattcctctacttaagcggaacctatgcgagcaacaccgactatactaattcggtttacaacaatctttacagcaataacacgacaacagcttctagccaaacgacttcagatgatactagtagtagcaatgatacaagtaattcaaccaatacagacaacaatggcagtcatccatctaccgatgataaaaagacaactcattaa

SEQ ID NO: 50127 - protein, 721 aa, Streptococcus pyogenes MGAS10394
MITIKNPKILKWLKYVLSAILSLIILVIIIGGLLFTFYISSAPKLSEAQLKSTNSSLVYDGNNNLIADLGSEKRENVTADSIPINLVNAITSIEDKRFFNHRGVDLYRIFGAAFHNLTSQTTQGGSTLDQQLIKLAYFSTNESDQTLKRKAQEVWLALQMERKYTKQEILTFYINKVYMGNGNYGMLTAAKSYYGKDLKDLSYAQLALLAGIPQAPSQYDPYLHPEAAKNRRNVVLQQMYMEKHLTKAEYETAIATPVAEGLQSLQQRSTYPKYMDNYLKQVIEEVKKETNKDIFTAGLKVYTNIIPDAQQTLYNIYHSGDYVYYPDQDFQVASTIVDVTNGHVIAQLGGRNQDENVSFGTNQAVLTDRDWGSTMKPITAYAPAIESGVYTSTAQSTNDSVYYWPGTTTQLFNWDLRYNGWMTIQAAIMLSRNVPAVRALEAAGLDYARSFLSSLGINYPEMHYSNAISSNNSSSDKKYGASSEKMAAAYAAFANGGIYHKPRYVNKVEFSDGTSKTFDEKGKRAMKETTAYMMTDMLKTVLTYGTGTAAAIPGVAQAGKTGTSNYTDEELAKIGEKYGLYPDYVGTLAPDENFVGFTKRYAMAVWTGYKNRLTPVYGSSLEIASDVYRSMMTYLTNGYSEDWTMPNGLYRSGGFLYLSGTYASNTDYTNSVYNNLYSNNTTTASSQTTSDDTSSSNDTSNSTNTDNNGSHPSTDDKKTTH

SEQ ID NO: 50128 - DNA, 2487 bp, Desulfotalea psychrophila LSv54
  CDS (1)..(2487)
atgaataaacaaaaagaatccagcaccaggtcacaaaacaataaagcaccagtaaaaagaaaaacacacagaagaaaatcgcgttcatcacgtcacaaaagcccattttttttatttttgaccctgttaatagcttttgcaggcatatcaaccgctgttttttttatacgccctatagatctttttagccgatatattgcactcactgacacgatagaaatggttttgacagaaaagtataacattctgcaaacaaatggttttttagcaaatacaggagatgatctcaatgcaaaaaactttttacatcgtttacaagaaaggggttataccagggtcaatcatcacccaaaaatggctggcacgtttaacattgagggaaatattctttacctctacacccatgccaaccaaggcctaagctctggaaaacgctataagttcactctgcaaaagtccatacttacatctatctcttcagctgctgacagtacccttcttgaatccctagccttcccccctttaaatttaacatactttatagattcggtgtgggagatcagaaccccagtctcatatgatgaaattccagaagatctgatcaatgcagtcatcgccacagaagatcagagcttcttctctcactatggtgtggacgtaaaaggtattataagagccactctatcaaatctgcaagctggcagagttgttcaaggtgggagcaccattacccagcaactcgtcaaggtgctcagtaaaaatgatgaacgaagcctgtcacgtaagcttcgtgaagccattcttgcccttatggttgattatcaatattctaaacaagaaatcctcactgcatatttaaataatgtctatctggggcatgcctcaccattcgaactccgtggtattgcagcagcttctgactatattcttggtaaggatcttaaaaatctcaacctcaaagaatgtgctatcatagcgggattaatacgttcaccaaattcagcatccccattgcgtaaccacagctttgccgcccaacgaactcagactgtcttaaaccagatggcaaatatgggagacagtcttgctgctgaaacccaagtgaaagacaaacttattcgtattaaacataaaagcattctgcataaaatgagttggtattttgaccagattgctaaagaaataaaattacgaaaacttgataccagcgaccataccagacaccttacaatccagacaccgcttgatccctggatgcagatcagtgccaccaaagtgctcaaacaacaactgaacaagctcgaccccgtttcagcaaacaagcaaaaaccactgcagggggcaacagtcatcctggatccatattccggcggggtcaaggcactggttggcggccgcgattacctcaaaaactcgtttaatagagctgtcgatgcacaaaggccgatgggatcactgataaaaccattcatctatctgacagctcttgggggtatagatgcggcaggattcatcacccaggctgatacggtaaatgattcacctattactgttggacagggaaaatcaaagtggaaaccgcataactacgataaaaaatatttagggaaaattacaatcagaaaggcgttggcagattctagaaatatccccgcagtcaagattggacagcgtattggcgtagaaaaattccttccggttttacgaaagacagggattactgaaatacagcaagcttatccttcaatttttctcggtgctgtagaaacaagtccccttaaaattgcgggcagttacgcaacaattgcaaatggtggaaacttcaccaaaccacaccttataaataaaattttcaaggacgacacactcatatattttcagcaacctgctcaagcactcttttcgccagctacctgttatatcatgacagatatgctgcaaaacgccctcaacaatggcacaggaaagagaagcagaaaatatggtttcacccatcttggagcaggtaaaaccggaacgacaaatgctggacgagattcatggtttgcaggttataccaattctctggttacggtcacgtgggtaggaaaagataacaacagcccaaccaaattaactggttcttctggtgcccttaaaatctggtcttccacaatgcaggatatccttggtcaaggaagagataaggattttacgacacctacaggcattgaaacagccgagattaattcagccaccgggcaaaaagctagcctctttgacaccaacgtggaatcaatggcattcatccttggcactgcccctaccgcaatagacaataatgaatatatccgccaacagttcgtggccattaaaaagacccttcatctagaaaacttaaagaaaacacacaaaaccctgcttaaaggtgggagtgaaaatatttctgattacacatcctggatgtcagagcagtatgaaaaaacgaaaaattggctcacccaatga

SEQ ID NO: 50129 - protein, 828 aa, Desulfotalea psychrophila LSv54
MNKQKESSTRSQNNKAPVKRKTHRRKSRSSRHKSPFFLFLTLLIAFAGISTAVFFIRPIDLFSRYIALTDTIEMVLTEKYNILQTNGFLANTGDDLNAKNFLHRLQERGYTRVNHHPKMAGTFNIEGNILYLYTHANQGLSSGKRYKFTLQKSILTSISSAADSTLLESLAFPPLNLTYFIDSVWEIRTPVSYDEIPEDLINAVIATEDQSFFSHYGVDVKGIIRATLSNLQAGRVVQGGSTITQQLVKVLSKNDERSLSRKLREAILALMVDYQYSKQEILTAYLNNVYLGHASPFELRGIAAASDYILGKDLKNLNLKECAIIAGLIRSPNSASPLRNHSFAAQRTQTVLNQMANMGDSLAAETQVKDKLIRIKHKSILHKMSWYFDQIAKEIKLRKLDTSDHTRHLTIQTPLDPWMQISATKVLKQQLNKLDPVSANKQKPLQGATVILDPYSGGVKALVGGRDYLKNSFNRAVDAQRPMGSLIKPFIYLTALGGIDAAGFITQADTVNDSPITVGQGKSKWKPHNYDKKYLGKITIRKALADSRNIPAVKIGQRIGVEKFLPVLRKTGITEIQQAYPSIFLGAVETSPLKIAGSYATIANGGNFTKPHLINKIFKDDTLIYFQQPAQALFSPATCYIMTDMLQNALNNGTGKRSRKYGFTHLGAGKTGTTNAGRDSWFAGYTNSLVTVTWVGKDNNSPTKLTGSSGALKIWSSTMQDILGQGRDKDFTTPTGIETAEINSATGQKASLFDTNVESMAFILGTAPTAIDNNEYIRQQFVAIKKTLHLENLKKTHKTLLKGGSENISDYTSWMSEQYEKTKNWLTQ

SEQ ID NO: 50130 - DNA, 2400 bp, Symbiobacterium thermophilum IAM 14863
  CDS (1)..(2400)
atgaggcggacctggcgctacgtcctgttcacccttctggccctcttcgtcctgtccggggccggcgtcgccgtcttcgtcgcgcagaccatcgccgccgcgccggagctgagcgagctcaactgggcgaccagcacggtgatctacgaccgggaaggaaacgaggtctaccggctgcacggcggcgagaaccgcatcccggtcagactcagccagatcccggagcacgtgcggaacgcctttatcgccgtggaggatccccgcttccgttcccacttcggcctcgatccccgcggcctcgcccgtgctgcctggcgcaccggcctgtacctcctcgggctgccgggggggcgggtggaaggcggatccaccatcagccagcagctggcccgcagcggctggctgacgcaggaggtgaccctgcggcggaagctgcaggaggcgtggatcgcgatccagttggagcggaagttctccaaggatcagatcctggagatgtacctcaaccagatctacttcggccagggggcgtacggtatccaggcggccgccgagaccttcttcggcaaggacgtcggccagctcaacatcgcagaggcggcccaactggccggcatggtcaacgggccgtccatctacgacccctacgtggacatggaggcctccctggagaggcgcgcggtggtgctggacgcgatgctccgggaaggcgtgatcacccgggagcagtatgaagaggcgatggccttccggcccaccctggccaacaccttcgagggcggggaagaccggcaggagggcaacgacttcatcgactacgtcatcagcatcctgaccgacgcgcagcccgggctcgcggagcggtacgggatccggctgcgggatccccagtcggtggcccgggcagggctgaaggtctacaccacgctggaccccacgctgcaggcgctggcggagcaggcgctggtcgagcagatggcggctgcggacgaggcctacggcatcccggccgaggggccgcggccggaggccgcggcggtggtgatgaacccccgcacgggtgaggtgctggcgctggtgggcggccgcacccgggagggcatgctggagttcaaccgggccaccgacgccctgcggcagccgggctcggccatcaagcccatcgtggcctacctgccggccctggaggccgggttgtcgccggcgacgatcctggacgacgcgccggtccggctgtccaacgacggtaccaccgtgtggccccagaacttcgacttcaggtaccaggggctgaagccggcgcgctggggcgtggagcagtcggtgaaccccatggccgtgcgggcgatgcagtttggcggcgggccctgggagggggccgcgctggcccggaagatggggctgacgacgatcctgccggaggacgagaacctggcgctggcgctgggcggcatcgagaggggcgtgagcgtgctggacctgacggccgcctacgccgccatcgccaacctggggctgaaggtcgacccggtggtgatcacccggatcgtcgaccgcaccggcgaggtgctgttcgaggcgcgcccccggcaggagcaggtggtcagccccggcgcggcctacctgatgatcgacatgatgaagggcgtcatccgccgggggacggcctacgcctttaccggcggcttccgggggtggccggccgcaggcaagacgggcaccaccgaggagaaccgggatgcctggttcatcgggttcacgccggacctggtgaccggggtctggaccggctacgacgatccgggcaaccccctgccctggaccggggcttacgtcccggtgcagatctggaaccgcatcatgacccaggccgtcaccgagcgcccggaggactggccgcggccggcggaggtggtggacgtcgcggtctgccggctgacgggcatgctgccggacgccaactgtccgcccgagcaggtggtgacggaactgttcctggcggggcacgagccgtcgggccccggcaacctgctggtgaaggccaaggtggtgcaggtcaccgtgccggcccaggacggacggccggcctaccagcagtggcagctgtggcagcccgggtgtccgggcacgccggtggagcggctgttcatccggcggccggagccgctggtgcgccaccccaccgacccgtggaacccccggtatctgccggccgactgggcggacgagctgcccgcggtcacctgccagccgcagccccgcgcgcggtggaactggctgacgctccccgggggttggtgggggacccgggacggcgccgaggagccggagggcgcgggcctgccggacgaggagttcgacctgcccgccggcccggatctggaggaacccctgcggtga

SEQ ID NO: 50131 - protein, 799 aa, Symbiobacterium thermophilum IAM 14863
MRRTWRYVLFTLLALFVLSGAGVAVFVAQTIAAAPELSELNWATSTVIYDREGNEVYRLHGGENRIPVRLSQIPEHVRNAFIAVEDPRFRSHFGLDPRGLARAAWRTGLYLLGLPGGRVEGGSTISQQLARSGWLTQEVTLRRKLQEAWIAIQLERKFSKDQILEMYLNQIYFGQGAYGIQAAAETFFGKDVGQLNIAEAAQLAGMVNGPSIYDPYVDMEASLERRAVVLDAMLREGVITREQYEEAMAFRPTLANTFEGGEDRQEGNDFIDYVISILTDAQPGLAERYGIRLRDPQSVARAGLKVYTTLDPTLQALAEQALVEQMAAADEAYGIPAEGPRPEAAAVVMNPRTGEVLALVGGRTREGMLEFNRATDALRQPGSAIKPIVAYLPALEAGLSPATILDDAPVRLSNDGTTVWPQNFDFRYQGLKPARWGVEQSVNPMAVRAMQFGGGPWEGAALARKMGLTTILPEDENLALALGGIERGVSVLDLTAAYAAIANLGLKVDPVVITRIVDRTGEVLFEARPRQEQVVSPGAAYLMIDMMKGVIRRGTAYAFTGGFRGWPAAGKTGTTEENRDAWFIGFTPDLVTGVWTGYDDPGNPLPWTGAYVPVQIWNRIMTQAVTERPEDWPRPAEVVDVAVCRLTGMLPDANCPPEQVVTELFLAGHEPSGPGNLLVKAKVVQVTVPAQDGRPAYQQWQLWQPGCPGTPVERLFIRRPEPLVRHPTDPWNPRYLPADWADELPAVTCQPQPRARWNWLTLPGGWWGTRDGAEEPEGAGLPDEEFDLPAGPDLEEPLR

SEQ ID NO: 50132 - DNA, 2574 bp, Symbiobacterium thermophilum IAM 14863
  CDS (1)..(2574)
atgcaatttaacgttaaggaggtggagcccatgccgcgtgcctccaacgcacggcagagacggccgagaaagaccaggctctggctgcgccgggcggtccagggcgtaaccctgctggtcgccgcctggctgctctactgcgcaggctccgccgtatacctcttctcgtccctgcccgccgccgggcttcatcccggccggccgtcgatggtctacgccttcgacggcagcgagatcggaccgctcaccggcgacgtctaccgggtgccggtggacctcggcgagctgcccgagtacctcccccgggccttcgtcgcctcggaggacaggcgcttctaccagcaccccggcgtcgacctgcggggtatcgcccgggccctgctgaccaacctccgggcgcgcagcatcatcgagggcggcagcaccatcacccagcaggtggtgaagaacaccttcctcaccccgcgccagaccctgacccgcaaggtgcaggaggccgtgctggccctgctgctggagacccggtacgagaaggacgagatcctgagcctgtacctgaaccagctctacatgggccacggcacctatggcgtcggcgccgccgcccagatttacttcaacaaagacgcaagggatctgaccctcggcgaggcggcgacgctggcgggcatcgcccccgccccggaaagcttcagcccgctgcgggaccccgaggccgcccgggagcggcgggacctggtgctggaccggatggtcgcggccggatatctgacgcccgaggaggcggacgccgagaaggcccggccgctcaacgtggtgcagggcgaactggagctgaacaacccctttccctggtacatggacgaggtccgggcggagctgttggaacggtacggactggatccccaggtcgtggcgctgatggggctggagatccacaccggcctggacccggcgatgcagcaggcggccgaggagcggctggcggcccgcatcttcccggcccacacccccgacggcgtggaggcggccttcgcggcggtggacccccgctcgggcgaggtgcgggccctggtgggcggccgcgagtacccccccggcggcggcctgaaccgggccacccggggccgcatctccccgggctccaccctgaagccggtcctcgtctacgcgccggccatcgagtacgaggggctgacgccggacagcatcgtcgtggacgaaccgttggacatcaacggctggcagccgcagaactgggacttccggttccggggcgaggtgacgctgcgggaggcggcccgcctctcgctgaacatcccggccgtccagctcctggaccgggtcggggtcgagcgggccaaggcgttcgcggagcggctgggcatccgcttcgccgaggccgaccgcgacctgaccctggcactgggggccatggccgacggggtgagccccctggagatggcgggggcgtaccaggcgttcgccaacggcgggacctaccgggaaccccacaccatcacccgcgtgatggcgaccggcgccgagctgaagggacggtccgcggccgtgcggcgggccatgcgccctgaaaccgcgcacgcagtcaccgacatcctgcagacggtggtcacgcagggaaccggcaccggcgccctgatcggccggccgatggcgggcaagaccggctccgtggaactgccgccggacccggccttcgaggggctctccggcaacagcgcggcctggttcgtcggctacacgcccgacgtggtggcctgcgtctgggtcggctatgaccgggtggatccggagcactacctgcccccggacgtgaacggctccacctaccccaccctgctgtggcggcaggtggtgggcgcagcgctggcgggcaggccggtgctggacttccccggccccggcggcggcccgcccgtggtggtgcagatgccggcgccgcccgccgggccggaggagccggccgggccagcggaaccgaccccgcccgccctgccgcgcatcgccgggctgaccgccgcgcccgggccgcagcccggctcggtgaacctggcgtggcaggccgagggcggcgatgtcccgacggagaacctccggttcctggtcctgcgggggaccgacgccgacgtgccggcggacgacgcgcacaccctcgccaccgtggcctcttccccctacctggacgtgctgacgcagccgggcacttactactaccgggtcgccgccgtcgatgcagcgacggggaccgtcggcgagccctcggcgccggttgccgtggaggtcacgctggaggagcccggcggccagggccccggcgacggcgctgagccgggcgacgaacgggagcccgacgacggcggtgggcccggcgacgacggggggccggcgctgccgggcgaggacggtgaacctgtcgggggcggacccgcggacccggggaacggtggccgccccgccgagggtgaacctgacgcaccggagcgggacgacggtcaccctgcgcagggtgaacccgacgaaccggagggtggcagcccacccgccgaaggatag

SEQ ID NO: 50133 - protein, 857 aa, Symbiobacterium thermophilum IAM 14863
MQFNVKEVEPMPRASNARQRRPRKTRLWLRRAVQGVTLLVAAWLLYCAGSAVYLFSSLPAAGLHPGRPSMVYAFDGSEIGPLTGDVYRVPVDLGELPEYLPRAFVASEDRRFYQHPGVDLRGIARALLTNLRARSIIEGGSTITQQVVKNTFLTPRQTLTRKVQEAVLALLLETRYEKDEILSLYLNQLYMGHGTYGVGAAAQIYFNKDARDLTLGEAATLAGIAPAPESFSPLRDPEAARERRDLVLDRMVAAGYLTPEEADAEKARPLNVVQGELELNNPFPWYMDEVRAELLERYGLDPQVVALMGLEIHTGLDPAMQQAAEERLAARIFPAHTPDGVEAAFAAVDPRSGEVRALVGGREYPPGGGLNRATRGRISPGSTLKPVLVYAPAIEYEGLTPDSIVVDEPLDINGWQPQNWDFRFRGEVTLREAARLSLNIPAVQLLDRVGVERAKAFAERLGIRFAEADRDLTLALGAMADGVSPLEMAGAYQAFANGGTYREPHTITRVMATGAELKGRSAAVRRAMRPETAHAVTDILQTVVTQGTGTGALIGRPMAGKTGSVELPPDPAFEGLSGNSAAWFVGYTPDVVACVWVGYDRVDPEHYLPPDVNGSTYPTLLWRQVVGAALAGRPVLDFPGPGGGPPVVVQMPAPPAGPEEPAGPAEPTPPALPRIAGLTAAPGPQPGSVNLAWQAEGGDVPTENLRFLVLRGTDADVPADDAHTLATVASSPYLDVLTQPGTYYYRVAAVDAATGTVGEPSAPVAVEVTLEEPGGQGPGDGAEPGDEREPDDGGGPGDDGGPALPGEDGEPVGGGPADPGNGGRPAEGEPDAPERDDGHPAQGEPDEPEGGSPPAEG

SEQ ID NO: 50134 - DNA, 2043 bp, Bacillus cereus ZK
  CDS (1)..(2043)
atgaaattgaagaacactcacttaaaaaaaatgcaggagtggttcaacaagagaaagaagcttcgtaatttattaattatattaggaagtttactcgctactctatttattgctataaatataataatttccattcaagacatatctgaattaaagcaagctgttccgcaaccgactttaatttatgatgcaaataatgaagttgcgactaaattagcttcttctaaaacagaaggcgtaaaaaagaaagatattcctgatattatggttcaagcaattgttgctgtagaagataaggaattttttaaccatcatggtatttactatagtggaattataagtgcggtttttaaaaatattacagcaggagaagttgtagcagggggaagtacaattacacaacaacttgcgaaaaatgtatttctgacacaagaccgcacatactctcgaaaaataaaggaatattttttaacaaaaaaaatagagcgtacgtatacgaaagatgaaatcattgaaatgtatatgaaccaaatttattttggtgaaggtgcttggggtataaaaagggcagctaaatcttattttgataaagatgtaaaagatttaacaatttcagaagctgcaacgattgcaggcttgattaaagcaccatctgcgtattcaccttataaaaactttaacaagtcaattgaaagacgtaatgtcgtattaagtttaatgaaagagcaagggtatatttctgacgaacagtataataaagaaaaagagagcggacttgtgttaaaacgtggcgttgatgataaatacaagggaaaatactctcaatatgtagactatattgttagagaagcgatggacaagtacgaattaacacaaaatgaaattttagcaggtggttatcgtatttatacagagcttgatccaaaaaaacaacaggctgtagaagacgttgtgaataatgatagttatttcaaagatagtggctcagaccaacttatgcaaacgggtgtagttcttatgaatccaaaaacaggtggtgtaccagctctagtaggaggcagagggccctatcagtttttacagtttaaccatgcaacacaattaaaaagacaacctggctcaacgctaaagcctttggctgtatatgtaccagcgttagaacaaggatatgaagtatacgatatattaaaagatgaaccatttaacattaaagaatataaaccacaaaatagcgatcatacttttcacggtgatgtgacaatgtatgaagctgtggcaaaatcgtataatgtttcggctgtgtggctattagaacaaattggattagataaaggattgaaatctttagagcgatttggtattccattagtaccagaagatcgtacgtatccgattgccttaggcggtatgcatgtggggacatctccatttgtaatggctcaagcatacagtacatttgcaaatgacggtgtccaagtggaagctcatgcaattagagagatacaaaatgctgaaggtgaaacgattggaaagtggtataagaaagagacacgagtgacgagcgagaaaatttctcaaaagatgacatatttattaaagggtgttgtcgaaaagggaacaggcgaaaaggcgaaagttactaatgttgatacagcaggtaagacaggaactactcaaattgtaaatggcccgagcaccggtgcaaaggattcatggtttgttggatacacaccagatttggtaggtgcgatttgggtaggatatgataaaacagatagcgatcattatgttccaggaggtagtcaaattacgacgacaatgttccgggatattatgaaaaaagcgaacgcaaatccagctcaaaaagcattccagttatcactcatatctgaggctgattataaaaaacaattgactacaatagaagaggaaaaacgaagaaaagaagaagagaagagaagaaaagaagaagaacaacaacgaaaacaagagcaacaagagtggcttgataaagtgaaagaatggattccttcattttggtaa

SEQ ID NO: 50135 - protein, 680 aa, Bacillus cereus ZK
MKLKNTHLKKMQEWFNKRKKLRNLLIILGSLLATLFIAINIIISIQDISELKQAVPQPTLIYDANNEVATKLASSKTEGVKKKDIPDIMVQAIVAVEDKEFFNHHGIYYSGIISAVFKNITAGEVVAGGSTITQQLAKNVFLTQDRTYSRKIKEYFLTKKIERTYTKDEIIEMYMNQIYFGEGAWGIKRAAKSYFDKDVKDLTISEAATIAGLIKAPSAYSPYKNFNKSIERRNVVLSLMKEQGYISDEQYNKEKESGLVLKRGVDDKYKGKYSQYVDYIVREAMDKYELTQNEILAGGYRIYTELDPKKQQAVEDVVNNDSYFKDSGSDQLMQTGVVLMNPKTGGVPALVGGRGPYQFLQFNHATQLKRQPGSTLKPLAVYVPALEQGYEVYDILKDEPFNIKEYKPQNSDHTFHGDVTMYEAVAKSYNVSAVWLLEQIGLDKGLKSLERFGIPLVPEDRTYPIALGGMHVGTSPFVMAQAYSTFANDGVQVEAHAIREIQNAEGETIGKWYKKETRVTSEKISQKMTYLLKGVVEKGTGEKAKVTNVDTAGKTGTTQIVNGPSTGAKDSWFVGYTPDLVGAIWVGYDKTDSDHYVPGGSQITTTMFRDIMKKANANPAQKAFQLSLISEADYKKQLTTIEEEKRRKEEEKRRKEEEQQRKQEQQEWLDKVKEWIPSFW

SEQ ID NO: 50136 - DNA, 2508 bp, Bacillus cereus ZK
  CDS (1)..(2508)
atgtcagaaaattatcgttctcgagaggagcgacgacaagttaaaaagaaaaaacaaccagcttctaaaacacaaaaaccaaaaggtaaaacatcattctttcgcaagtttttaattacttgtttattacttggtattgttggtttagtggggggagttgctacctttttcgtaatgattaaggatgcaccaaaacttgagaaagcaaaacttgttaatccgttatcctcaaaaatttatgataaaaatggcgatttggtatatgaatacgggaaagaaaaacggacgaatgttacgtatgatcaaattcctaaattagtagaaaatgcatttttagcaacagaagatgcacgtttttacgagcatagtggagtagactttaaaggtactgctcgtgctgttttggtgagtcttaaaggtgattacggttcacaaggtggaagtacgataacacagcaggttattaaaaattacttcttatcgatggaaaaaacatcaaaacgtaagattcaagaaatatatttagcgtataagctagaacaacagtattcaaaacatgaaattttagaaatgtatttaaataaaattaatttaggtaatcgttcatatggtatcgcaacagcagcacaaaactactacggtaaagaattaaaagagttaactttaccagaagttgcgatgctggcaggtttaccaaaagcaccgaataactatgatccaacgaagacagaaaatgttcaaagagcaacagaaagaagaaatgttgtcctaaaattaatgaatcgacatggttatattacgaaggcagaaatggaagaagcttcgaaagttgaagtaacagatggacttaagactgcaactgtacaagcaatgccatatcctgcatttatggatgcggttgtgaaagaagttgaaaaagaattgccagatgctaatattggttctgacggtttagaaatttatacaacattagacacgagagcacaggattttgctgataagattttaaatgaaaatattattaattatccaaatgataaattccaaggtgctttcacatttatggatacgaaaacaggagaagttcgtgctataggtagtggacgcggtgaaaataaagcagtatttaaagggcataatatggccattgaattagatcgtgcagctggttcgacgatgaagccaatctttgattacggtcctgcaattgaatacttaaaatgggctacgtatcatcaaattgatgattctccatttaaatattcaactggacaagaagttcgaaatgccgacagaagtcatttaggatctattacgatgcgtgaagcattaaaaatgtcgcgtaacgtcccggcagttaaaactgcaaaagaagtaggacttaataaagcgaaggaattctctgagaaattaggtattacacttaagtcagtaccagaatctacagcgattggtacaaacgaagtatcaccaactgaaatagcgggtgcttatgcgacatttggtaatggtggaaagtatgcaaaaccgcattttgttaagaaagtagtttatccagacggtaagtcacaaagtttcgggcaaaaaccaaaacaagttatagctgactctacagcatatatgattactgatatgcttcgttcagtagtgacatcaggtactggtacagctgcaaatattagttctttagatatagctggtaaaacaggtacaacaaactatgattcaaaacaattagcgaaatttaatattccagaaagtgcaactcgtgatagttggtttgcaggttacacgccgcagtatacgatggcagtatggactggatatatgaaagatggtaaagacgagtatattagtagtaaaaatacgaaaattgcacaattgatctttaaacaaatgatgagtaagtttgctactgaccaatcacgatttaaaatgccaagtagtgtaattcaagaaggaagtgagctacgtataaaaggtgaaaaacgtgattcttctccaaatacgagcgtacctgacacaacagaacaaccaaaacaaaatcagcagcaaaaaacggaagaagagaaaaagcaagaagaattaaagaaacaggaagaattgaaaaaacaagaagaacaaaagcaacaagaggaacttaagaagcaagaagaacaaaagaaactagaagagcaaaagaaacaagaagaagaaaagaaacaaaatgaacaaaataatggaggaggccaagggaatacgacacctccagcaaataacgggggaggtcaaggaaatacgacacctccagcaaataacggaggaggccaaggaaatacgacacctccagcaaataacggaggaggtcaaggaaatacgacacctccagcaaataacggaggaggtcaaggaaatacaacccctccagcaaataatggaggaggtcaaggaaatacaactccaccagcgaccacacaaccagagactggcggtaatgcaggagagacccctgctaataatggacaataa

SEQ ID NO: 50137 - protein, 835 aa, Bacillus cereus ZK
MSENYRSREERRQVKKKKQPASKTQKPKGKTSFFRKFLITCLLLGIVGLVGGVATFFVMIKDAPKLEKAKLVNPLSSKIYDKNGDLVYEYGKEKRTNVTYDQIPKLVENAFLATEDARFYEHSGVDFKGTARAVLVSLKGDYGSQGGSTITQQVIKNYFLSMEKTSKRKIQEIYLAYKLEQQYSKHEILEMYLNKINLGNRSYGIATAAQNYYGKELKELTLPEVAMLAGLPKAPNNYDPTKTENVQRATERRNVVLKLMNRHGYITKAEMEEASKVEVTDGLKTATVQAMPYPAFMDAVVKEVEKELPDANIGSDGLEIYTTLDTRAQDFADKILNENIINYPNDKFQGAFTFMDTKTGEVRAIGSGRGENKAVFKGHNMAIELDRAAGSTMKPIFDYGPAIEYLKWATYHQIDDSPFKYSTGQEVRNADRSHLGSITMREALKMSRNVPAVKTAKEVGLNKAKEFSEKLGITLKSVPESTAIGTNEVSPTEIAGAYATFGNGGKYAKPHFVKKVVYPDGKSQSFGQKPKQVIADSTAYMITDMLRSVVTSGTGTAANISSLDIAGKTGTTNYDSKQLAKFNIPESATRDSWFAGYTPQYTMAVWTGYMKDGKDEYISSKNTKIAQLIFKQMMSKFATDQSRFKMPSSVIQEGSELRIKGEKRDSSPNTSVPDTTEQPKQNQQQKTEEEKKQEELKKQEELKKQEEQKQQEELKKQEEQKKLEEQKKQEEEKKQNEQNNGGGQGNTTPPANNGGGQGNTTPPANNGGGQGNTTPPANNGGGQGNTTPPANNGGGQGNTTPPANNGGGQGNTTPPATTQPETGGNAGETPANNGQ

SEQ ID NO: 50138 - DNA, 2340 bp, Mannheimia succiniciproducens MBEL55E
  CDS (1)..(2340)
atgtcaaccgagcaagacaaatccgcacaaagcaatacatcgaacaaaccggctaaaaccctgcaaaataaaaaacgccgttttaccctttttatggcaaaactggcatttaccggcgcttgtttaatcggcgcctacggtatttatttagacgggcaaatccgttcaaaaatggacggccaaatttggcgtttgcccgctgaagtttacagccgcattgagagtattcgtttagaagataattggtcgttggataaaattaagcaaaccttattggaaaacgattatcgtcaaaccactctggttgccgcgcccggcgatttcaaaattgaagataacagcattgtgttgattcgccgcgcctttccgtttcccgagcaagcagaagcgcaacgggttttccgcctgcgctttacggacaacaaacttagtgtaattgaagatttaatcaatctaaaagcgattaatgaattcaaattatcgcctaaattaatcgccatgctgcaatccgagaaagaagaacgtcttgcgattccgctgcaaaactatcctcgtttattaattgatgcgctacttctcactgaagaccgcaatttttatcagcacgaaggtattagcccgctcggtatggcccgcgctatgattacgaatattcgcgccggtcatacagtgcaaggcggcagtacgctcacccagcagttagtaaaaaacctttttttaaccaacgaacgttctatttcccgcaaaattcacgaagccttgatggctattttgttagactttcgttacgataaaaacaccattttggaaacctaccttaatgaaatttatttaggacagagcggtgatattcaaattcacggattcgaattagccagccatttttatttcggtttgcctattagagaaatcagtcttgatcaaattgccttacttgtgggtatggttaaaggcccgtctttatacaatccttggcgtaaccccggctacgcgttggagcgtcgcaatgtggtattgcgcttgttactggagcataaaatcatcgggcaggaactttacgatatgttgagcaagcgtccgttaggcgtgcaggaaaaaggaaaaatcacaagaaattatccgtcttttattcaaaccttgcaggcggaactgcgggataatctgggcgaaaaccgtgaaaataaattactaggcgcccgtatttttaccaccttggatccgaaacaacaacgtgcggcggaacaggcggtagtgaaagcaaccggcgaattacagctcaaaacaaaaaatcccgatttacaggcggccatgattattgccgattataaaagcgggcagattttggctattgtcggcggcacgcaaattcaatatgccggctttaaccgcgcatttatggcaaaacggcaaatcggctcattggtaaaaccctcggtttatttagccgcactttccgaaccggataaattccgtttgaacacaccgttaaataaccgtccgattaccatcaccataaaaggcagtccgccttggtcgccacgcaattatgacaatcgtttcagcggttcggtgatgttaattgatgccttggctcgctctttaaatgtgccaaccgttaacctgggtatgaaaacagggcttaaaaaagtaatcgaaacccagcaggcaatgggctgggataaagtcaatatccctaaagtaccctctatgttactgggttcgttgcaagtatcgccttatgatgtaacaaagttgtatcagaccattgccaataacggcggcaaggttcggttaacaacaattcaaagcattacggacagacaaggtaacctgctttatcgccatgataacaatgccgaacaagtagtgccggaagaagccgcttatcaaacgctgtatgctatgcaacaggtagtagatcgaggaactgcgcgtagtttaatggaaaacttcggacaatatcatttggccggtaaaacaggtacgacgaatgacgcccgtgatacttggtatgtgggcattgacgggcaaaacctcgcgacggtttgggtcggtcgcgatgataacggcgaaaccaaactcaccggtgcaagcggcgcgctttatctttataaagattatttaacaagagtaccggttaaaaccttaaaattaactaaacccaaaggtattaaattcgtcggcattaacagctatggcggttggaattgcgataatccgatccgcaccattccggtctgggcgggaaaagatcaggttttctgtgcgccgacaccaaaacccgcaccggttgaacaagctcaacctgcggtagttgaagaagccgcgccggctcaataa

SEQ ID NO: 50139 - protein, 779 aa, Mannheimia succiniciproducens MBEL55E
MSTEQDKSAQSNTSNKPAKTLQNKKRRFTLFMAKLAFTGACLIGAYGIYLDGQIRSKMDGQIWRLPAEVYSRIESIRLEDNWSLDKIKQTLLENDYRQTTLVAAPGDFKIEDNSIVLIRRAFPFPEQAEAQRVFRLRFTDNKLSVIEDLINLKAINEFKLSPKLIAMLQSEKEERLAIPLQNYPRLLIDALLLTEDRNFYQHEGISPLGMARAMITNIRAGHTVQGGSTLTQQLVKNLFLTNERSISRKIHEALMAILLDFRYDKNTILETYLNEIYLGQSGDIQIHGFELASHFYFGLPIREISLDQIALLVGMVKGPSLYNPWRNPGYALERRNVVLRLLLEHKIIGQELYDMLSKRPLGVQEKGKITRNYPSFIQTLQAELRDNLGENRENKLLGARIFTTLDPKQQRAAEQAVVKATGELQLKTKNPDLQAAMIIADYKSGQILAIVGGTQIQYAGFNRAFMAKRQIGSLVKPSVYLAALSEPDKFRLNTPLNNRPITITIKGSPPWSPRNYDNRFSGSVMLIDALARSLNVPTVNLGMKTGLKKVIETQQAMGWDKVNIPKVPSMLLGSLQVSPYDVTKLYQTIANNGGKVRLTTIQSITDRQGNLLYRHDNNAEQVVPEEAAYQTLYAMQQVVDRGTARSLMENFGQYHLAGKTGTTNDARDTWYVGIDGQNLATVWVGRDDNGETKLTGASGALYLYKDYLTRVPVKTLKLTKPKGIKFVGINSYGGWNCDNPIRTIPVWAGKDQVFCAPTPKPAPVEQAQPAVVEEAAPAQ

SEQ ID NO: 50140 - DNA, 2622 bp, Mannheimia succiniciproducens MBEL55E
  CDS (1)..(2622)
atgaagatcgtaaaattaatatttagcaccttgctaaccatcgttattttaggctgtgtagccgggggattattatatttccatataaaatctcaattaccggacgttcagagtttaaaaaccgtcgaattacagcaaccgatgcaaatttataccgcagatgaaaaactgattggcgaagtcggcgagcaacgtcgcattccggttaaacttgaaaatgtaccgaaaatgctgattaacgccattttagccaccgaagacagccgcttttatgagcaccacggtttagacccggtaggcattgcccgtgcggtctccgtcgctatcgcaaacaaaggtgcatctcaaggcgcgagcacaattactcaacagcttgccagaaacttctttttaacgccggaaaaaacgattatccgtaaaacaaaggaagccattcttgctattgaaattgaaaatactttaactaaaaacgaaattctggaactttacctgaataaaatttatttaggctatcgttcttatggtgtcgctgctgcggcaaaaacctatttcggtaaaaacctagcggatttgactttatcggaaatggcgatcattgccggtttgcctaaagcgccttcaacaatgaatccgttgtattccttaaaacgctcggaagaacgtcgcaatgtggttttagggcgtatgctggaaatgcaatttattaataaagaacaatatgacgaagccgttcaggaaccgatcaaagcttcttatcatggcgcacaaattgagttccgcgcagattatgttaccgaaatggtgcgtcaggaaatggtaaaacgttacggcgaagaaagcgcctataacagtggttttaaggtttataccacaattctttctcaggatcaggcgcaagcacaaaaagcggtgcgtaacaacctaattgattatgatatgcgccatagccgttatcgcggcgcaacgcctttatggcaatcatccgaaacaccgtgggaaaacaacaagattattgatactttgcgtaagttaccgaattcagaaccgtttttgccggcggtgattttatccgtcgctaaagagggcaccgagttattattggcttccggtgaaaaaatgaccttaaatgccgccgcaatgcgttggggcggaagaaacgtatcactcaaaaccggtgagcaaatttggatccgacaacgggataataacgaatgggttttaggccaaattcccgaagctaattccgcactggtttccttaaacagtgataacggcgccattgaagctattgtaggcggttttagttttgaacaaagtaaattcaaccgcgccacccaatccatggtacaggtgggttcctctatcaagccgtttatttatgcggccgccttggaaaaaggcttaactttatcaagcgtattacaggatacgccgattagtattcgcaaaccgggacaagcggaatggcgcccgaaaaactcaccggatcgctatgacggtccgatgcgtttacgcgtaggtttgggacaatctaaaaatatgattgcaatcagagcaatgcaaacggcaggtattccttatgttgccgaatttttacaacgcttcggtttcaaacgcgaacaatatttcgccagtgaagcgctcgctttaggtgccgcttctttcacgccgttagaaatggcgcgaggttatgcggtgttcgataacggcggtttcttagtcgacccctttatcatcaaccgtattgttgataattcgggcaaagacattttcatagcgaatccgaaaattgcctgcactacttgtgatgaaatgccgacgatttacgggcaaactacagacaaagtagatggtttcaaagagaatgattccgtcaatgccgacggcaatttagcccaaaccgacgaaaacacaaacggtgaagaaaccgatcaaaacggcgaaaacaatgatgtaccggagttgcaaaatcaaggcggaacaatcaatgaagatgccttaaatttaatggtcgaaggcaaaaccgacagttctcaggtacagtatgcgcctcgggtaattaccggcgaattggcatttttaatccgcagtgcgttaaacaccgccatttacggcgaacagggactgggctggaaaggtaccagctggcgcatggcaaatgaaattaaacgtaaagatatcggcggtaaaacggggacaaccaacaacgctaaagtggcttggtacgccggcttcggcgccaatctcactacagccgtttatgtaggttttgatgacaataaacgtaacttaggtaaaggcgaagccggtgcaaaaaccgcgatgcccgcatggattaactatatgaaatttgtgctggaagatgttcctgaacgcgttttaccgacacctgccaatatcattgaaaaatccattgatttaggctcgggcttgctctcaaaaggcggcggtcgtactgaatacttcataaaaggtacggaaccgaaacgcgcctttgtacaggaacgcggttattatgtaccggaagggcttccgttccaaacgccttccgccagcgaatatgtacctattggtcaaccggcaccggctgcacccgcaccttctcgcaaagaattattctaa

SEQ ID NO: 50141 - protein, 873 aa, Mannheimia succiniciproducens MBEL55E
MKIVKLIFSTLLTIVILGCVAGGLLYFHIKSQLPDVQSLKTVELQQPMQIYTADEKLIGEVGEQRRIPVKLENVPKMLINAILATEDSRFYEHHGLDPVGIARAVSVAIANKGASQGASTITQQLARNFFLTPEKTIIRKTKEAILAIEIENTLTKNEILELYLNKIYLGYRSYGVAAAAKTYFGKNLADLTLSEMAIIAGLPKAPSTMNPLYSLKRSEERRNVVLGRMLEMQFINKEQYDEAVQEPIKASYHGAQIEFRADYVTEMVRQEMVKRYGEESAYNSGFKVYTTILSQDQAQAQKAVRNNLIDYDMRHSRYRGATPLWQSSETPWENNKIIDTLRKLPNSEPFLPAVILSVAKEGTELLLASGEKMTLNAAAMRWGGRNVSLKTGEQIWIRQRDNNEWVLGQIPEANSALVSLNSDNGAIEAIVGGFSFEQSKFNRATQSMVQVGSSIKPFIYAAALEKGLTLSSVLQDTPISIRKPGQAEWRPKNSPDRYDGPMRLRVGLGQSKNMIAIRAMQTAGIPYVAEFLQRFGFKREQYFASEALALGAASFTPLEMARGYAVFDNGGFLVDPFIINRIVDNSGKDIFIANPKIACTTCDEMPTIYGQTTDKVDGFKENDSVNADGNLAQTDENTNGEETDQNGENNDVPELQNQGGTINEDALNLMVEGKTDSSQVQYAPRVITGELAFLIRSALNTAIYGEQGLGWKGTSWRMANEIKRKDIGGKTGTTNNAKVAWYAGFGANLTTAVYVGFDDNKRNLGKGEAGAKTAMPAWINYMKFVLEDVPERVLPTPANIIEKSIDLGSGLLSKGGGRTEYFIKGTEPKRAFVQERGYYVPEGLPFQTPSASEYVPIGQPAPAAPAPSRKELF

SEQ ID NO: 50142 - DNA, 2076 bp, Bacillus licheniformis ATCC 14580
  CDS (1)..(2076)
atggacataatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtgggaaaaatggtttaaaaaaggagaataa

SEQ ID NO: 50143 - protein, 691 aa, Bacillus licheniformis ATCC 14580
MDIMTDKRVRLTIKTIRAFLFMGALMLIFLSIVVMTVVLAAKWQGAPSIQVPRSTVLYDGSGKQMGETHYGQKRYWVSLKNINPAVIDATLAVEDRNFFRHHGFDYMRMGGALIADLKAMSKVQGASTITQQYARNLYLGHDKTWKRKWNEAFYTIRLEQNYTKKDILEGYLNTIYYGHGAYGIEAASRLYFGKRAKDINTAEAAMLAGIPKGPSVYSPFVNEKKAKERQEMILTMMEKQNKLTEMQAAALKKMPLRFEKQDKQTTEKTAPYFYDEAVKEISRLLRLTPEQAETGGYNVFTTLNPRLQKIAEDTIEHTIDSSSDIQAGFAAINPSDGSVLALVGGRDYEKSPFNRVTQAMRQPGSTMKPFLYYSAVQNGFTPATRMRSAETTFELGQGSAYSPSNYHGYYADGPITLLQALALSDNIYAVKTHLFLGMDKLIDAAKQFGINSPLQKVPSLALGTSPVKPIEMVNGYAMFANGGKKIEPSFITKITDPNGKVLYEKPKRSKQILDPKAAFITANMMSGMFDKSLNGYTSVTGRTIADQLTRRYAGKSGTTSTDSWMIGFYPGLASGVWTGYDKERTIDAVAEKNYAKQIWAEFMEKALEDAPAAALMPPEGVKGMYIDPATGYAAAPSCPSKYFAYFIKGTEPEQVCYGKEIYKEQNAGHEKPAAPPHKRQKWWEKWFKKGE

SEQ ID NO: 50144 - DNA, 2385 bp, Legionella pneumophila subsp. pneumophila str. Philadelphia 1
  CDS (1)..(2385)
atgaaaaaaatggcatacttctggcgtaaaggtctttgggcgctgatgagcctgttttttctcctaatagtagctggcagccttctatacctttatctcgaaagccaattgcctaatgttgattcattaaaaactgtacaattacaagtgccattacagattttcagcaaagaaggtttattaattcaggaatacggtgaaaaaaaacgtattcccgtaacctatgacgaaattccccctactctgatccatgcattaattgcaacagaagatcaacgattttttgagcaccctggtgtagacgttatgggattgggccgagccgcagtaagcatgctcaaaactggaaccaaatctcaaggtggcagtacgatcaccatgcaagtagctcgtaattttttcttaagccgtaaaaaaacatttttacggaaattcaatgaaattatgcttgctatcaaaattgaccgggaattaagtaaagaaaagattttggaactttacttaaacagggtttatctgggtaatcgggcttacggtgttggtgcggcagccatggtttattttggaaaatcccttaaagaccttaatctggctgaactggctatgatagcaggacttcctcaagcgccctcaactcagaatcctatcgctaacccgcttgctgcaaaaaaacgtcgtgaccatgtactggagcgattactggaagaacattatatcaatgaagaacaataccaaaatgctgtcaatcaaccaattactgcaaaataccatggaactaatatcaaggtgaaagcgccttatgttgctgaaatgattcgtcagtctctgtacgacaattttggccccgaagcgtacactaaaggctataaggtatatacaaccattgacggcaaattacaaaatactgccaatgaagtggtagaaaaaaatctgattgattatgatcatcgacatggttacagagggccaattgccaatataggtgaaaaagacagtcaatctcccaagattaggcaaaaatacttgcggcaatatccagagcttaacagcctgattccagcagtggtcactgaagtaagagaaaaagaagcgactgcggcattacaaaatgggcaaataattattattccctgggagggtatgtcctgggccaggccggcactgaagagaggaggctgggttgggaaatcaccaaccaaagcacaacaagtggtagcagcaggcgatataatctatgtacaccccacggaaaaatcctggcaactcgcccaaattcctgaagcagaatctgcaatggttgctatgaatcctaaaaatggcgccattgaagttttggtcggaggatttaacttctcaaaaagtaaattcaaccgagctacccaatccagcagacaaccaggctccagtttcaaaccatttgtttacgctgcggctttgaacaatggttataatcttgctaccttaattaatgatgcccccatcgttgtagacgatcccagccaaccgaatttatggcggccacacaatgtgaatctaaaattcaatggccctacccgcctgaaacaggcattagttcaatctaaaaatttggtatctataagaattcttgatgatataggtattgattatacgatagatttcttaactcgttttggctttaataaaaaatcattgcctagagccttatcacttgctttaggaagtttatccattagccctatggatttaaccactgcttatgcagtctttgctaatggtggctataaagtagagccctacctcattgaccatataacagatgctgatggtaaaattctgttacaagccaaaccaagtgttgtatgtgacccttgtgataaagacaaagttgatgcctctaccttggcaccgcgcgttatttctgaagacattgcctttttaatgaatacggcattacgcgatgtaatacagcatggcactggacgtgctgcacgagtattaaatcgtcaagacatcgctggtaaaacagggactactaatgatcaagtagatgcgtggtttgccggatttaactctaatttggtagtaacaacctggattggttttgataatcccaaatcattgcatgaatatgctgcaaatcttgctcttccactatggattgattttatgaaagtagcattaaaagacaaacctgaaactgaattgaagcagcctgaaaatgttatagctgttcgaatagatccagtaagtggtttgctcgccaagcctaaccaggaaaatggcatcattgagtattttcgacaaaatgaggttccatctgaagaggatcaaggtcctgtctataatgcacataatgatcagcaggaagaagaactagcgccagtggaagaaagtctgttttaa

SEQ ID NO: 50145 - protein, 794 aa, Legionella pneumophila subsp. pneumophila str. Philadelphia 1
MKKMAYFWRKGLWALMSLFFLLIVAGSLLYLYLESQLPNVDSLKTVQLQVPLQIFSKEGLLIQEYGEKKRIPVTYDEIPPTLIHALIATEDQRFFEHPGVDVMGLGRAAVSMLKTGTKSQGGSTITMQVARNFFLSRKKTFLRKFNEIMLAIKIDRELSKEKILELYLNRVYLGNRAYGVGAAAMVYFGKSLKDLNLAELAMIAGLPQAPSTQNPIANPLAAKKRRDHVLERLLEEHYINEEQYQNAVNQPITAKYHGTNIKVKAPYVAEMIRQSLYDNFGPEAYTKGYKVYTTIDGKLQNTANEVVEKNLIDYDHRHGYRGPIANIGEKDSQSPKIRQKYLRQYPELNSLIPAVVTEVREKEATAALQNGQIIIIPWEGMSWARPALKRGGWVGKSPTKAQQVVAAGDIIYVHPTEKSWQLAQIPEAESAMVAMNPKNGAIEVLVGGFNFSKSKFNRATQSSRQPGSSFKPFVYAAALNNGYNLATLINDAPIVVDDPSQPNLWRPHNVNLKFNGPTRLKQALVQSKNLVSIRILDDIGIDYTIDFLTRFGFNKKSLPRALSLALGSLSISPMDLTTAYAVFANGGYKVEPYLIDHITDADGKILLQAKPSVVCDPCDKDKVDASTLAPRVISEDIAFLMNTALRDVIQHGTGRAARVLNRQDIAGKTGTTNDQVDAWFAGFNSNLVVTTWIGFDNPKSLHEYAANLALPLWIDFMKVALKDKPETELKQPENVIAVRIDPVSGLLAKPNQENGIIEYFRQNEVPSEEDQGPVYNAHNDQQEEELAPVEESLF

SEQ ID NO: 50146 - DNA, 2319 bp, Legionella pneumophila subsp. pneumophila str. Philadelphia 1
  CDS (1)..(2319)
ctgttgtgggcaatgagaaaagtaataaaatatcttagcataatcctgggttcgctatttgtcagtgggtttttattattatttttttctcccaagccttctttattagaagaattcaatttttctaaagcggtatatgatgataatcaacaattattaagattaattttaagtgacgatgacaaatacagactttatgtaccgttatctcaaatacccaaggagttaatggaggccacacttttacaagaagatcagtattttctctggcataaaggagtgaaccctttttccatggtgaaagccatctggcaaacttatgtggttaaatcgcgcagaatcggggcttcaacaatcacaatgcaggtggcacgaattcgttttggaattaactccaagaaaatttctggaaaattatggcaagttattagggcgttacaaatagagcgtcattatgataaagataaaattcttgaggcttatttcaatttggcgccttatggtggaaatatagagggagtaggggcggcgagcttaatttattttaataagcctgttagtaaacttggtttaccagaggcactaactttaagcattatccctcaaaatccagtaaaaaggacatcaaaaaacagtgaattaaaaaaaataagaaatcgcttatttgccagatggctgaagcagcatccgcaagaccaggagaagcagcctctgtttggactgcctttagttatgcaaaccaatcaaaacctacccttcctggctcctcattttgtaaatatggtactgaaggaaaatcctggtttatcacaaagtatttcaacaactttggattacaggcttcagttaatagttgagcgaattacaaggcattatttagcaagaaaaaaaatgtttggtgttcacaacgcggcggttttacttgtggatagccgtactatgagtattaaagcgttgatgggatctgctgatttttttaataacaagataagtggacaaatcaatggtgtagaaaccaaaaggtcgcctggctcaactctgaaaccatttatttatggattagcactcgatcaaggtttaattcaccccaatacagttttaaaggatgtaccacagagttttaatggttataatccggaaaacttcgattatgattttatggggcccatcaaagcaaaagatgctttggtacttagtcgtaatatcccggccatcgagctttccaatcaattaactaatccaacattacataaattacttgaacaggcgcatataactcagttgcgttctgaatcatattatggcttgtctcttaatttgggtggtgttgaactcactatgaaagagttagtcggtttatatgctatgctgattaatgatggggtctggtatccaatcaattcattaaaaggggttccgcgacaaaaaggtcgacacttgcttagcgcagaagcaagctttttagttttcgatatgctaaaaaatactccaatgaaagagtcgaataatgatggcagtttacaattaccaattgcctggaaaacaggaacttcatcaggatacagagatgcctggacagttggagtttttggtccttatgtattggcagtttggataggaaattttgataatcaggcaaatccggcttttataggtaaagaaattgctgcgcctttattttttgaattgattaatgcaataaaacatgaaagaggaccaatagctcgagttgaaaaataccctgaacacatgcatttggaaaaaatagaagtatgcaaagcctcaggtatgcttcctggtcgatattgtacggatacagaatggacctggtttattccaggtaaatcccctattaaaacggatacaatttttcgagaggtagcaattaacgggaagacggggcttcgtacttgtcacatcgatgaaaatactcgttttgaagtgtatgagttttggccctccgatttattaagaatattcaggagggcagggattcaacgccataccccgccattttttgaaccaggttgcgctttgtcgggaaatagtggtattagcccccaaattacatctccccaggcaggggtaagttatattgtccatgctaatacccaatcaaacaagataatcccattaactgcggtaacagatgctggaattgcacatttatactggtttatcaatgaaagttttgtagctgaaacaaaatcggatgaaccttatctctggcaggcgaaacctggtaaatatgtggtaagggtggtagatgaccgtggtttatctgatgcgcgggatattactattcagatggttagttga

SEQ ID NO: 50147 - protein, 772 aa, Legionella pneumophila subsp. pneumophila str. Philadelphia 1
MLWAMRKVIKYLSIILGSLFVSGFLLLFFSPKPSLLEEFNFSKAVYDDNQQLLRLILSDDDKYRLYVPLSQIPKELMEATLLQEDQYFLWHKGVNPFSMVKAIWQTYVVKSRRIGASTITMQVARIRFGINSKKISGKLWQVIRALQIERHYDKDKILEAYFNLAPYGGNIEGVGAASLIYFNKPVSKLGLPEALTLSIIPQNPVKRTSKNSELKKIRNRLFARWLKQHPQDQEKQPLFGLPLVMQTNQNLPFLAPHFVNMVLKENPGLSQSISTTLDYRLQLIVERITRHYLARKKMFGVHNAAVLLVDSRTMSIKALMGSADFFNNKISGQINGVETKRSPGSTLKPFIYGLALDQGLIHPNTVLKDVPQSFNGYNPENFDYDFMGPIKAKDALVLSRNIPAIELSNQLTNPTLHKLLEQAHITQLRSESYYGLSLNLGGVELTMKELVGLYAMLINDGVWYPINSLKGVPRQKGRHLLSAEASFLVFDMLKNTPMKESNNDGSLQLPIAWKTGTSSGYRDAWTVGVFGPYVLAVWIGNFDNQANPAFIGKEIAAPLFFELINAIKHERGPIARVEKYPEHMHLEKIEVCKASGMLPGRYCTDTEWTWFIPGKSPIKTDTIFREVAINGKTGLRTCHIDENTRFEVYEFWPSDLLRIFRRAGIQRHTPPFFEPGCALSGNSGISPQITSPQAGVSYIVHANTQSNKIIPLTAVTDAGIAHLYWFINESFVAETKSDEPYLWQAKPGKYVVRVVDDRGLSDARDITIQMVS

SEQ ID NO: 50148 - DNA, 2559 bp, Burkholderia pseudomallei K96243
  CDS (1)..(2559)
gtgctcgaggcgcgcctcgtgcgccgcccatccgacatgcctattatcaaacgaccgccttcctcccgcgccacgaacgagcaccattattcgctgcgacgctcgccggccggcgcctattacaccgatgacgacgatgatgacgagcgcgcgccgcgccgcacgggccgcgacggcggctcgcgcacgttcggctcgcgcgtcgcgctgtggttcgccgggctcttcgcgacgctgctcgtcgtcggcgcgctgatcgtaggctatgcgctggtggtgatggggccgcaactgccgtcgctcgacgcgctcacgaattaccagccgaaggtgccgctgcgcgtgtacagcgcggaccacgtgctgctcggcgaattcggcgaggagcgccgcagcctcgtgcgcttcgcggacatccccgacgtgatgaagaaggcggtgctcgcgatcgaggattatcgcttctacgagcacggcggcgtggatttcgtcggcatcctgcgcgcgggtgtggccgatctgctgcatggcggcgcgcggcagggcgcgagcacgatcacgatgcaggtcgcgcgcaacttcttcctgtcgagcgagaagacgtacacgcgcaagatctacgagatgctgctcgcgtacaagatcgaaaaggcgctgacgaaggaccagatcctcgagctgtacatgaaccagatctatctgggccagcgcgcgtacggcttcgcggccgccgcgcgcgtgtatttcggcaaggacctgaaggacgtcacgctcgccgaggccgcgatgctcgcggggctgccgaaggcgccgtccgcgtacaacccggtcgtcaacccgaagcgcgcgaaggtgcgtcaggagtacatcctgaagcggatgctggagatcggctacatcacgcagcagcagtacgatcaggcggtgaaggaggaaatccacgtgcgcacgccgggcaaccagtacgcggtgcacggcgagtacgtcgccgaaatggtgcggcagatgatgtatgcgcagtacaaggacgaaacctacacgcgcggcctgaccgtcacgacgacgatcaacgcggccgaccaggaagccgcgtaccaggcggtgcgccgcgggatcatggattacgagcgccgccacggctatcgcgggccggaaggcttcgtcgcgctgccgcccgccggcgacgagcgcgacgaggcgatcgacgacgcgctcgcggatcatcccgacaacggcgatctgcagtcggccgtcgtgctcgccgtctcgccgacggcggtcgacgtgcagttcgtcggcggcgcgacggcgacgatcaacggcgccgggctgcgtttcgcggccggtgcgttgagcgcgcgcgcgtcggccgcgctgaagatcaagccgggttcgatcgtgcgcgtgatgaaggacgcgaggagcgcatggcagatcgtgcagttgccgcaggtcgagggcgcgctcgtcgcggtcgcgccgcaggacggcgcgatccgctcgctcgtcggcggcttcgatttcaacaagagcaagttcaaccacgtgacgcaggcatggcggcagccgggctcgtcgttcaagccgttcatctattcggcgtcgctcgaaaagggcctcgggcccgcgacgatcatcaacgacgcgccgctctatttcccgccgagcgtgccgggcggccagccgtgggagccgaaggacgacgatcagccggacggcccgatgccgatgcgcaccgcgctgcagcgctcgaagaacctcgtgtcgatccggattctggcgtcgatcggcacgtcgtatgcgcaggactacgtgacgcagcgcttcggcttcgatcccgcgaagacgccgccgtatctgccgatggcgctcggcgcgggcctcgtcacgccgctgcagctcgcggcgggctacgcggtgttcgccaacggcggcttcaaggtcgatccgtatctgatcgccgaagtcgacgacgcgcgcgggcaggcgctgcaaaaggcgcagccggtggtcgcgggcgcgagcgcgacgcgcacgatcgacgcgcgcaacgcctacgtgatgaacagcctgctgcacaccgtcgcgacggcgggcacgggcgccggcacgaacgcgctcggccgcggcgacctgcagggcaagaccggcacgacgaacgaggcgaaggacggctggttcgccggctatcagcagtcgctcgtcgccgttgcatggatgggcttcgatcagccgaagagtctcggcagccgtgaattcggcgcgcagctcgcgttgccgatttgggtgaattacatgcgcaccgcgctcaacggcgtgccggagcagcagatggcgatgccggacgggctgacgacgatcgacggcgagctgtattacgcggatcgcacgccgggcgcgggcttcgtcgcgagcgtcgatttcaatccggccgcgagcccgaccgtgagcgcgaacgacgcgctcggctcggcgggcgcggcgggcctgacgccgccgcccgtgacgccggaggagaagcggcagatcatcgacatgttcgaaggcaacaagccttga

SEQ ID NO: 50149 - protein, 852 aa, Burkholderia pseudomallei K96243
MLEARLVRRPSDMPIIKRPPSSRATNEHHYSLRRSPAGAYYTDDDDDDERAPRRTGRDGGSRTFGSRVALWFAGLFATLLVVGALIVGYALVVMGPQLPSLDALTNYQPKVPLRVYSADHVLLGEFGEERRSLVRFADIPDVMKKAVLAIEDYRFYEHGGVDFVGILRAGVADLLHGGARQGASTITMQVARNFFLSSEKTYTRKIYEMLLAYKIEKALTKDQILELYMNQIYLGQRAYGFAAAARVYFGKDLKDVTLAEAAMLAGLPKAPSAYNPVVNPKRAKVRQEYILKRMLEIGYITQQQYDQAVKEEIHVRTPGNQYAVHGEYVAEMVRQMMYAQYKDETYTRGLTVTTTINAADQEAAYQAVRRGIMDYERRHGYRGPEGFVALPPAGDERDEAIDDALADHPDNGDLQSAVVLAVSPTAVDVQFVGGATATINGAGLRFAAGALSARASAALKIKPGSIVRVMKDARSAWQIVQLPQVEGALVAVAPQDGAIRSLVGGFDFNKSKFNHVTQAWRQPGSSFKPFIYSASLEKGLGPATIINDAPLYFPPSVPGGQPWEPKDDDQPDGPMPMRTALQRSKNLVSIRILASIGTSYAQDYVTQRFGFDPAKTPPYLPMALGAGLVTPLQLAAGYAVFANGGFKVDPYLIAEVDDARGQALQKAQPVVAGASATRTIDARNAYVMNSLLHTVATAGTGAGTNALGRGDLQGKTGTTNEAKDGWFAGYQQSLVAVAWMGFDQPKSLGSREFGAQLALPIWVNYMRTALNGVPEQQMAMPDGLTTIDGELYYADRTPGAGFVASVDFNPAASPTVSANDALGSAGAAGLTPPPVTPEEKRQIIDMFEGNKP

SEQ ID NO: 50150 - DNA, 2163 bp, Burkholderia pseudomallei K96243
  CDS (1)..(2163)
ttgccaacgaaggatttcgacatgaccgatcacacgccgcactcgtcgccgcccgcctcgccgacgccgcctcaggggcccgcgccgaagcgccgccgctatttccgcacgctcgcgggcctcgtgctcggcgcggcgatcgcgggcggcgcggtcggcacgtggacgctgcatcgcatctggacggcgctgccgtccgtcgagccgctcgccgtctatcgtccggcgctgccgctgcggatcttttcgcgcgaaggcgagctgctcgccgaatacggcgtcgagcgccgcgagttcgtgccgctcgaccgcatcccgccgctcgtgcggcacgcgctgctcgcggccgaggatgcgcagttctacacgcacggcgtggtcgacatcggcgggctcgcgcgcgcgacggtggcgaacgtcgtcaccggccagcccgggcagggcggcagcacgatcacgatgcaggtcgcgcgcaatttctttctgacgcgcgagaaggtgctgagccgcaagctcgccgagatcctgatgtcgtacaagctcgaacgcgcgtacagcaaggacaagctgctcgagctgtacatgaacgagatctatctcggcgagcgcgcgtacgggttcgcggcggccgcgtcggtgtacttcggcaagccgctcgatgcgctcacgcccggcgaggcggcggtgctcgcgggcctgccgaaggcgccgtccgcgttcaatccggtcgtcaatccggcgcgggcgacgatgcgccgcaactacgtgctcggccgcatgcgcgcgctcgggtatctggacgaggccgcgtaccggcaggccgccgacgcgccgatcgcgctcgcgaccacgccgccgcccggcatcctcgccgcgccgtacgtcgccgagcgcgcgcgccggatgatggtcgagcgcttccatgacgacgcctacacgctcggcctggacgtgacgacgacgatcgcgatgcgcgagcagcgcgcggccgacgcggcgctcgcgcgcgggctcgcgcaggtcggccggcgcgacgcgaaggacgcgctcgaaggcgcgctcgtgtcgatcgacgcggcgacgggcgacattctcgcgctcgtcggcggcgcggacttctcgcacaacgtgttcgatcatgcgttgcaggcgtatcggcaaccgggttcgagcttcaagccgttcgtctattcggccgcgctggagaaagggatgttccccggcgtgctgatcgacgacacgcagcgcacgctgtcgcgcgacgaaaccggcgcgaacccgtggcggccgcgcaatttcggcaaccactacgaaggcttcattccggtgcggcgcgggctgatgcgctcgaagaacctcgtcgcggtgagtctgatgcaggtcgcgcggccggatttcgtccagcagcacgcggcgcgcttcggcttcgagccgctgcgcaaccccgcgtcgctgccgctcgcgctcggcgcgggctcggcgacgccgctggaggtggcgagcgcctacggcgtgttcgccaacggcggcgtgcgcatggagccgcgcctcatcgaatcggtgcggcagcggcacggcggcgcgctgttcgacgcgcagcccgcgcccggcgtgcgcgtcatctcggcgcgcaacgcgttcgtgatggacagcatgctgcgcgacgtcgtcgcgcacggcaccgcgcgccgcgcggtcgcgctcaagcgcgcggacgcggcgggcaagaccggcacgtcgaacggctcgaaggacgtgtggttcgccggctactcgtcgggcgtcgtatcggtcgtctggatgggctacgacgcgccgcgcagcctcggccgcgcgacgggctcgtcggccgcgctgcccgtgtgggtcgactacatgaagaccgcggtcgacggccgcggcgcgatcgagcgcacgccgcccgcggacgtcgcgctcgtcgacggcgatttcgtctatgccgaatacgcgaacggcgacaagtgcgcgccgtcgctgccgccgttcgtgcgcagcccgttcgcgtgcggcgcggcgcgcggtgcgccggcggacggcggcgcgccggcgagcgcggcaggggcggcgggtgcgccgacgccggccgccgtcgacgcggccgagcgcgcgcgcgtgctcgagctgtttcgcaccgaagactga

SEQ ID NO: 50151 - protein, 720 aa, Burkholderia pseudomallei K96243
MPTKDFDMTDHTPHSSPPASPTPPQGPAPKRRRYFRTLAGLVLGAAIAGGAVGTWTLHRIWTALPSVEPLAVYRPALPLRIFSREGELLAEYGVERREFVPLDRIPPLVRHALLAAEDAQFYTHGVVDIGGLARATVANVVTGQPGQGGSTITMQVARNFFLTREKVLSRKLAEILMSYKLERAYSKDKLLELYMNEIYLGERAYGFAAAASVYFGKPLDALTPGEAAVLAGLPKAPSAFNPVVNPARATMRRNYVLGRMRALGYLDEAAYRQAADAPIALATTPPPGILAAPYVAERARRMMVERFHDDAYTLGLDVTTTIAMREQRAADAALARGLAQVGRRDAKDALEGALVSIDAATGDILALVGGADFSHNVFDHALQAYRQPGSSFKPFVYSAALEKGMFPGVLIDDTQRTLSRDETGANPWRPRNFGNHYEGFIPVRRGLMRSKNLVAVSLMQVARPDFVQQHAARFGFEPLRNPASLPLALGAGSATPLEVASAYGVFANGGVRMEPRLIESVRQRHGGALFDAQPAPGVRVISARNAFVMDSMLRDVVAHGTARRAVALKRADAAGKTGTSNGSKDVWFAGYSSGVVSVVWMGYDAPRSLGRATGSSAALPVWVDYMKTAVDGRGAIERTPPADVALVDGDFVYAEYANGDKCAPSLPPFVRSPFACGAARGAPADGGAPASAAGAAGAPTPAAVDAAERARVLELFRTED

SEQ ID NO: 50152 - DNA, 2493 bp, Methylococcus capsulatus str. Bath
  CDS (1)..(2493)
gtggcaattttttcccgaaagaccagaagaccccgttactggctgatgacactcgaagtcctgctggtcgccatcctggtcatcgcgctggggctgttcggactgtaccgccatctcgaaccgcaattgccggacatcgcgatactgaaagaagtgcgctatcagatccccatgtcggtctacagccgcgacggcaagctgatcgcgcagttcggcgagaagaagcgcagccccgtcgccatcggcagcgtcccccaggacctgatccatgcgttcattgcggccgaagacgaccgcttctatgaccacgtcggagtggattaccaaggcatcctgcgcgccgtgctcaccttcgcccggaccggcgaaaaacgtcagggcggcagtacgatcaccatgcaggtcgcgcgcaacttcttcctgagcagcgagaagacctttctccgcaagatcaaggaaatcatgctggcgatccggatcgattcggaactctccaaagaccagattctcgagctctacctgaacaagatctatttcggccagcacgcctacggcatcgaggccgcggcccaggtgtactacggcaaacacgtgggtgaactgaccctcggtgagatggcgatgatcgccgggctccccaaggcaccgtccgccttcaacccggtcgccaaccccgagcgggcccagacccgtcgcaactacgtactgcggcgcatgcgcaagctacgcttcatcaccgacgaggtctaccagagagccctgaacgagccgatcaccgctcgcatccacacccggctcatcgagctggacgccccctatgtcgccgagatggtacgcgccgagatgtatcagcaatacggcgatgatgcctacgagagtggctacgcggtctacaccaccatcgacagccatgcccaacgaacggcggagtcggccctgcagtcgggtttgcgagcctacgacgaaaggcacggctaccgcaaagccaaggttcacatcgatctcaaacagctgaaggccaagtcggcgtggaaccagatactggaagaccaaggccccgcgggcgacaccgtgccagcgttggtactcaccgccaccgacacgaccgcgggtctctataccgtaaatcacggcgaacccgaactctcctacgacgccgtccgctgggccagaccgttcatcagcgtggatgcccatggggtgccgccccgctcggtcaaggaggtactcaagcccggtgacgtgatccggatccgcaagaacgccgacggccgttgggtgctgacccagattcccaaggtccagggcgcgctggtcgagctggatgccgacagcggcgccatcatcgccgtcgccggcggcttcgactaccggctcagcaagttcaaccgcgccagccagggccaacgccagcccgggtcgggattcaaacctgtggtgtattccgccgccctggattcggggttcaccccggcgagcgtggtcaacgattcaccggtatccttcccagaccccgcctcgcctggcgggatctggcggccgcacaactattcgatgaaatacgcagggcccacccctttgcgggaagccctggccaaatcgcgcaacatggtgtccatccgactcttgcgcgccgtcggtctgcccaaagtaatcgagctggcagaaaaattcggcttcacgccggacgaactgccccgctcgtacacgctggcgctgggttccggtaccgcctccccgctccggatggcccaggtctatgccgtgttcgccaacgggggctaccgggtcgacccctacctcatcagccgcatcgaaacccagaacggtcggctgctgtatcaggccacgccggccatcgcctgcctggactgcgccgatggcaaatccacggcgaaccgggcgaaacgggtcatctcggaagaagtccattacatgatgcactccatgctgcaggatgtggttcgccggggcaccgccaccaaggcattggagctcggacgatcagacctggcaggcaagaccggcaccaccaatcagtaccgcgacgcctggttcaatggctatgtgcccggtctcgtgacggtggcgtgggtgggattcgactcgtaccagacgctcggcgacaaggaaaccggcggacagactgcattgcccatctggatggagttcatgaaggagatgctgcgcgacgtgcccgagcgcaaatttccccagcctgccgggatcatggccgcacggatcgaccccgcgacgggaaaccggctgcccgccagcgtccccggcgggatcgtggaactggtgccgcggccgacgccccaacccggcttcgatgccgccgccgaggagcccgaagtcgccgccccggcatcccagtccgatgcctcgggcgcgcgcgcccccgaatccatcccccccgaagaggaagaaatcggggaggctccaccggcgcagcccgcggaaacgccaaagccgatggaatccttgttttga

SEQ ID NO: 50153 - protein, 830 aa, Methylococcus capsulatus str. Bath
MAIFSRKTRRPRYWLMTLEVLLVAILVIALGLFGLYRHLEPQLPDIAILKEVRYQIPMSVYSRDGKLIAQFGEKKRSPVAIGSVPQDLIHAFIAAEDDRFYDHVGVDYQGILRAVLTFARTGEKRQGGSTITMQVARNFFLSSEKTFLRKIKEIMLAIRIDSELSKDQILELYLNKIYFGQHAYGIEAAAQVYYGKHVGELTLGEMAMIAGLPKAPSAFNPVANPERAQTRRNYVLRRMRKLRFITDEVYQRALNEPITARIHTRLIELDAPYVAEMVRAEMYQQYGDDAYESGYAVYTTIDSHAQRTAESALQSGLRAYDERHGYRKAKVHIDLKQLKAKSAWNQILEDQGPAGDTVPALVLTATDTTAGLYTVNHGEPELSYDAVRWARPFISVDAHGVPPRSVKEVLKPGDVIRIRKNADGRWVLTQIPKVQGALVELDADSGAIIAVAGGFDYRLSKFNRASQGQRQPGSGFKPVVYSAALDSGFTPASVVNDSPVSFPDPASPGGIWRPHNYSMKYAGPTPLREALAKSRNMVSIRLLRAVGLPKVIELAEKFGFTPDELPRSYTLALGSGTASPLRMAQVYAVFANGGYRVDPYLISRIETQNGRLLYQATPAIACLDCADGKSTANRAKRVISEEVHYMMHSMLQDVVRRGTATKALELGRSDLAGKTGTTNQYRDAWFNGYVPGLVTVAWVGFDSYQTLGDKETGGQTALPIWMEFMKEMLRDVPERKFPQPAGIMAARIDPATGNRLPASVPGGIVELVPRPTPQPGFDAAAEEPEVAAPASQSDASGARAPESIPPEEEEIGEAPPAQPAETPKPMESLF

SEQ ID NO: 50154 - DNA, 2280 bp, Methylococcus capsulatus str. Bath
  CDS (1)..(2280)
ttgacggtcccctctacgcgcatgatccgcaagctcctctacctgtcggtgttagcctcgacgatcgccctgaccgtctatctcgcccatcaggatgccgtgatccgcgaaaaattcgaggggcgacgctgggccttgcccgcccgggtatacgcaatgccggtggagctctatgccgaagcaccgattgctgcagatcaactggtgtggatgctggatcagctcaaataccggaacgaccccggcctgacctcgcaaggcagctacacccgcaagggcaacgagatacggctccgaacccgggagtttctgtttcccgacaaatccgaaccctccagcgaagtccgcgtcgaattcgccggcggtagcgtgcgcgcgctggagagcctggattctgacgaccacccctccctggtacggctggatccggtgcagatcggcagcttttaccccgcgctgaaggaagaccggatactggtcaagctcgacgacgtgcccaggccgctgatcgacgcactgctggcggtcgaagaccgtgatttctatgaacatttcggcctctccgccaagggcatcctgcgggccgcctggcagaacatcaaggcaggcggcttcgtccagggcggcagcacgctgactcagcaactggtcaagaatttctttcttagtgccgaacgtacgctggggcgtaagatcagcgaggccttcatggcgctgattctggaagcccgctacagcaaggctgcgattctcgaggcttatctcaacgaaatctatttgggccaggatggcacccgcgccatccatggtttcggtctggcgagccagtactatttcagccgtgccctcaacgaactggaactgcatcacgtggcgctgctggtcgccttggtgcggggaccgacctattacgatccgcacaaacaccccgagcgcagccgggaaaggcgcgatcgcgtgctggatgccatggcggaacagggtttcatcacttccgccgaggccgacgccgccaaacgacggccgctggacgtggtcaagaacccacaccaggccatcagccgttatccggcctttctcgatttgatccggcgccagcttcaggaacagtaccgtcccgaggacctgacttccgaagggctgcgcatttttaccacactcgacgtcttcgcccaggagcatctggattcggcgatcgccaagaccctggcacggctcgaccactccacccggccggaagaacggttggaaaccgctgccatcttcacccggcgctccaacggcgagatcgcagccttcgcgggcagccgcgatgtcgagtcgtcgggcttcaaccgcgcgctcgattccgcccgtcagatcggctccctttacaaaccggtggtgtatctcactgccctggagcagcccagcggctataccgtcgccacccccctgctggacgaaaccatcaaaatcgacggcggcggcaaaccgtggacgcccaggaattacgatggcagggaacacggacaggtgccgctccacacggctctggcccagtcgtacaacctggcgacggtacggctgggccttgccgtcggcgtcgaacgcaccgccgagacgctcagaaaactgggcgtaaaccgcgaggtggaaacctatccctcgctgctgctgggcgcggccaacctgtcgccgatcgaggtggccactctttatcagacgctcgctagcgacggtttcgtcacaccgctgcggggtatccaggccgtgctctcgcacgacggcgggactctgcagcggttcgggctggaacttcgacaggccgtggagccgggagcaatctatctgctgaataccatcctccaggaggtcatgagcgagggcaccggccgttctgtctatgcctaccttccggaaaacttccatgtcgccggcaagacggggacgaccaacgacatgcgcgacagctggttcgcgggtttcagcggcgactacaccggggtggtctgggtggggcgcgacgacaaccgctccgcgggtctgaccggggcccggggagcgctgcagatctggggcgccaccatgcagaagctggcgaaggaaccccttgatctcatcccgccggagaatatagtcatgctgcgagtcgaccgacaaacggggctgcgcgccgacgacggctgccccgacgcccatgaattgccgttcatcaaaggctcggaaccagcggcctgggcaccctgtgccgaaggtggggaaaccggcggagattcttggttccgacgactgttctga

SEQ ID NO: 50155 - protein, 759 aa, Methylococcus capsulatus str. Bath
MTVPSTRMIRKLLYLSVLASTIALTVYLAHQDAVIREKFEGRRWALPARVYAMPVELYAEAPIAADQLVWMLDQLKYRNDPGLTSQGSYTRKGNEIRLRTREFLFPDKSEPSSEVRVEFAGGSVRALESLDSDDHPSLVRLDPVQIGSFYPALKEDRILVKLDDVPRPLIDALLAVEDRDFYEHFGLSAKGILRAAWQNIKAGGFVQGGSTLTQQLVKNFFLSAERTLGRKISEAFMALILEARYSKAAILEAYLNEIYLGQDGTRAIHGFGLASQYYFSRALNELELHHVALLVALVRGPTYYDPHKHPERSRERRDRVLDAMAEQGFITSAEADAAKRRPLDVVKNPHQAISRYPAFLDLIRRQLQEQYRPEDLTSEGLRIFTTLDVFAQEHLDSAIAKTLARLDHSTRPEERLETAAIFTRRSNGEIAAFAGSRDVESSGFNRALDSARQIGSLYKPVVYLTALEQPSGYTVATPLLDETIKIDGGGKPWTPRNYDGREHGQVPLHTALAQSYNLATVRLGLAVGVERTAETLRKLGVNREVETYPSLLLGAANLSPIEVATLYQTLASDGFVTPLRGIQAVLSHDGGTLQRFGLELRQAVEPGAIYLLNTILQEVMSEGTGRSVYAYLPENFHVAGKTGTTNDMRDSWFAGFSGDYTGVVWVGRDDNRSAGLTGARGALQIWGATMQKLAKEPLDLIPPENIVMLRVDRQTGLRADDGCPDAHELPFIKGSEPAAWAPCAEGGETGGDSWFRRLF

SEQ ID NO: 50156 - DNA, 2370 bp, Nocardia farcinica IFM 10152
  CDS (1)..(2370)
atgatcgtgggcgcgttcggcaggcggtgggggcggcgcggcgccgggggcgatccgggatcggcgccgtacgcgtccatcgcggggtggaaggaccccgcgaccggcaccgccgagggctccaccgatcgggacgacgctgccgatccggacagcgctgccgaggacaccgcggccgaccgcgatcggggcgcggcaccgcggcggcgccggaccaggggcgagcggttgcggcggctggcactggcgctgttcgtgatcttcgtcgcggtgcccggcctgctgctggcactggtgtattggagcgccgagatccccgacccggccgcggtgcagaccaatcagatcgccaccatcaccgcctccgacggcacgaccgtactggcgaaggtggtgccgccggagggcaaccgcacgccggtgccgctgtcggaagttccccagcacgtgcgcgacgccgtgctctcggccgaggaccgcaacttctacaccaatcccggctactcgacctccgggttcctgcgtgccgcgcgcgacaacctgctcggcaaggaggacgcgggcggcggttcgaccatcacccagcagtatgtgaagaacgccttcctcggttccgaacgcacgatcagccgcaagatgcgcgagctggtgatcgcggcgaagatggcgcggcagtggaccaaggacgagatcctggccgcctacctcaacaccatctactacgggcgcggcgcctacggcatcgacgccgccgcccaggcctacttcgccaagccgcccgcgcagctgaccctggccgagggcgcggtgctggcctcggtgatccggacaccgtcgatcctggaccccgagacccacctcgacgacctgaaggcgcggtggcgctacgtcctcgacggcatggtggagatgggcgtgctcgcccccggcgaccgcgacgccaccgcgttccccgacatcgtgcccatcaccgaactccccgacgccagcgccgcccggggccccgaggggttgatccgcacccaggtgctgcgcgaactgcgcgactccgggatcagcgaacgcgaactgaacaccggcgcgctgcagatcaccaccaccatcgacgtgcgcgcccagcaggccgcgatgaccgcggtgcgggaccggctcgccggccagccgcccgaactgcgcgccgccgtcgtctcggtcgacccgcgctcgggggcggtgcgcgcctactacggcggcgaggacggcaccggctacgacttcgcgcaggcgccgttgcagaccggttcggcgttcaaggtgttcgccgtgatcgccgcccagcagcagagcatcccgctgacccgtgcgatcgacagttccccgatcaccgaccacggcaccaccatcaccaacgtgcagaacgagacgtgcgggcggtgctccatcgccgaggcgctcaagcgctccctcaacaccagcttctaccggctcaccatgtcgatgctggacggcccgcaggccatcgccgacgccgcgcaccaggcgggcatccccgagcacatcccgggtgtggcgggcaagaccctgaccgaggacggcggcccgccctacaacggcatcgtgctcggtcagtacctggtgcgtccgatcgacatggcctcggcctacgccaccatcgccgcctccggctggtaccaccggccgtatttcgtgcagcgggtggtgaccggcgacggccgggtgctgctggaccgcggcgtgccggagcggccggtgggcgagcaactaccggcgcccgaacagcgcattccggcgccgatcgcggagaagaccattcaggcgatgatgccgatcgcggcctactccaacgggcacgcactggcgggcggacgcccgtcggcggccaagaccggcaccacgcagctcggcgagaccgacctgaacaaggacgcgtggatggtcggcttcacgccgtcgctgtccaccgcggtgtggatcggcaccgagcactcccagccgatccgtaccgcgggcggtgccagcatctacgggtcggggctgccgtcggacatctggaagcagatgatggacgacgcgcacgagggcgcgccggtcgagcagttcccggtacccgacaccgccgccgagggaccgccctcgcaggtgggccggcagggaccgccgtcgggtaatccgtacgacatcctcaacccgccgcaggccacccgtccgcaggcgcccgccgtggtgatccccccggcgccgaacacccccgcgccggaacccgagccgcagatcgtgatcccgcccgcgcccgcgccggctcccgcgccgccgcctccgcccaggcagatcgagatcttccccggcctgaccgtgccggtgccgggctga

SEQ ID NO: 50157 - protein, 789 aa, Nocardia farcinica IFM 10152
MIVGAFGRRWGRRGAGGDPGSAPYASIAGWKDPATGTAEGSTDRDDAADPDSAAEDTAADRDRGAAPRRRRTRGERLRRLALALFVIFVAVPGLLLALVYWSAEIPDPAAVQTNQIATITASDGTTVLAKVVPPEGNRTPVPLSEVPQHVRDAVLSAEDRNFYTNPGYSTSGFLRAARDNLLGKEDAGGGSTITQQYVKNAFLGSERTISRKMRELVIAAKMARQWTKDEILAAYLNTIYYGRGAYGIDAAAQAYFAKPPAQLTLAEGAVLASVIRTPSILDPETHLDDLKARWRYVLDGMVEMGVLAPGDRDATAFPDIVPITELPDASAARGPEGLIRTQVLRELRDSGISERELNTGALQITTTIDVRAQQAAMTAVRDRLAGQPPELRAAVVSVDPRSGAVRAYYGGEDGTGYDFAQAPLQTGSAFKVFAVIAAQQQSIPLTRAIDSSPITDHGTTITNVQNETCGRCSIAEALKRSLNTSFYRLTMSMLDGPQAIADAAHQAGIPEHIPGVAGKTLTEDGGPPYNGIVLGQYLVRPIDMASAYATIAASGWYHRPYFVQRVVTGDGRVLLDRGVPERPVGEQLPAPEQRIPAPIAEKTIQAMMPIAAYSNGHALAGGRPSAAKTGTTQLGETDLNKDAWMVGFTPSLSTAVWIGTEHSQPIRTAGGASIYGSGLPSDIWKQMMDDAHEGAPVEQFPVPDTAAEGPPSQVGRQGPPSGNPYDILNPPQATRPQAPAVVIPPAPNTPAPEPEPQIVIPPAPAPAPAPPPPPRQIEIFPGLTVPVPG

SEQ ID NO: 50158 - DNA, 2439 bp, Nocardia farcinica IFM 10152
  CDS (1)..(2439)
gtggcccgccgcggcggcgcggcgaccggacccaagcccgccacggcgcgcagcgcgaccggcccgcgcccggccgtcgacggcgcgcgccgggccggcggcgccaccaccggcgagcgccgcgccgcgtccgggccaccgtccggcccgccgccgcgccgcgggggcggcagcggcggctcgggcgggtccggcggcggtcgcggacccggtcagggcaggcggatgccgtggcgcaccatccggcgggtgatgtacgtgctcaccgcgctggcgatcatggtgcccagcgcggtgttcctcatcgcctacaccaccgtgtcggtgccccagcccggcgacctgaagaccaatcaggtggccaccatctacgcccaggacggctccaccgtcatcagcaaggtggtgccgccgcagggcaaccgcaccgaggtcaccatcgaccagatcccgccgcacgtgcgcaacgccgtgatcgcggccgaggaccgggatttctacaccaaccccggcttctccatctccggcttcgcgcgcgcggcccgcgacaacgtcctgggcaaggagagcgcgggcggtggctccacgatcacccagcagtacgtgaagaacgcgctggtcggcgacgaacgctcgctgacaaggaagatgcgcgagctggtgatctcggcgaagatggccaggcagtggagcaaggacgagatcctggccgcctacctcaacaccatctacttcgggcgcggcgcctatggcatcgacgccgccgccaaggcgtacttcggcaagccggtccaggaactgaccgtggccgagggcgccgtgctggcggccaccatccagctgccctcgttgctggacccggagaagaatcccgacggtgccaagtcgcgctggaactacgtgctcgacggcatggtcagcggcggcaacctgtccgcggccgagcgccagaacatgcagtatccccaggtggtgtcgctggcggcgaaccaggacaacgagctcgattccggtcccgagggcctgatcaagacccgcgtcctggaggaactctccgccgctggcatcagcgagcagcagctcaacaccgcgggcctgcagatcaccacgaccatcgacccgcaggcgcagcaggccgcggtcgaggccgccaccgccaagatgcagggcgagcccgagcagttgcgcaccgcggtggtgtcgatcgatccgcgcacgggcgcggtgcgcgcgtactacggcggcaccgacggccagggctacgacttcgccaacgcgccgctgcagaccggttcctcgttcaaggtgatcggcctggccgccaacctcgagcagggcattccgctctcgcagatgtacgacagctcgccgctgaccgtgcacggcatcaagatcaccaacgtcgagggcgagtcctgcggtatgtgcaccatcgccgaggcgctcaagcggtcgctgaacaccagcttctaccgcatgcagctggacatgcagaacgggccgcagaagatcgccgagatgggacaccggctcggcatccccgaggaactgcccggcgtcggcaagacgctgtccgagccggacggctccggccccaacaacggcatcgtgctcggtcagtaccaggcccgcccgctggacatggcctcggcctatgccaccttggccgcctcgggcgtctaccaccagccgcacttcgtgcagaaggtcgtcaccgccgacggacaggtgttgctcgatcgcggcgaggtgccgggcgagcagcgtgtctcggcggccgtggcggacaacgtcaccgccgcgatgaagccgatcgccgcctactcccgcaaccacggcctggccggtggccgcgagtcggccgccaagaccggtaccgcgcagttgctggacaccggtgagaacaaggacgcgtggatggtcggctacacgccgtcgctgtccaccgcggtgtgggtcggcagcgtcgacaactcgccgctgcgcaactacgcgggcgcgatgatctacggctccagcctgccctcggacatctggaaggccacgatggacggtgccctggccggcacgcccaacgagaccttccccaagcccgccccgatcaagggccaggcgggcgtgcccgagtggacggcgccgtacaccccgccgtcgaccacggaagccccgctgctgcccccggtggtgatcacccccacccaggtggagatcctgcccggtatcaccatcccggtgcccggtgtgcagcccgcgccgcagcagacccagcagcagcgtccgcaacagaactccgagtccggcccgctgcccggccagccggtcgccccgaccggcggcgcgtcaccgggcggtggcaacggcaacggcaacggcgggggtggcggtaacgccgacgacgaggagggcagcgacagcccgcaacccacgcgaagccgctga

SEQ ID NO: 50159 - protein, 812 aa, Nocardia farcinica IFM 10152
MARRGGAATGPKPATARSATGPRPAVDGARRAGGATTGERRAASGPPSGPPPRRGGGSGGSGGSGGGRGPGQGRRMPWRTIRRVMYVLTALAIMVPSAVFLIAYTTVSVPQPGDLKTNQVATIYAQDGSTVISKVVPPQGNRTEVTIDQIPPHVRNAVIAAEDRDFYTNPGFSISGFARAARDNVLGKESAGGGSTITQQYVKNALVGDERSLTRKMRELVISAKMARQWSKDEILAAYLNTIYFGRGAYGIDAAAKAYFGKPVQELTVAEGAVLAATIQLPSLLDPEKNPDGAKSRWNYVLDGMVSGGNLSAAERQNMQYPQVVSLAANQDNELDSGPEGLIKTRVLEELSAAGISEQQLNTAGLQITTTIDPQAQQAAVEAATAKMQGEPEQLRTAVVSIDPRTGAVRAYYGGTDGQGYDFANAPLQTGSSFKVIGLAANLEQGIPLSQMYDSSPLTVHGIKITNVEGESCGMCTIAEALKRSLNTSFYRMQLDMQNGPQKIAEMGHRLGIPEELPGVGKTLSEPDGSGPNNGIVLGQYQARPLDMASAYATLAASGVYHQPHFVQKVVTADGQVLLDRGEVPGEQRVSAAVADNVTAAMKPIAAYSRNHGLAGGRESAAKTGTAQLLDTGENKDAWMVGYTPSLSTAVWVGSVDNSPLRNYAGAMIYGSSLPSDIWKATMDGALAGTPNETFPKPAPIKGQAGVPEWTAPYTPPSTTEAPLLPPVVITPTQVEILPGITIPVPGVQPAPQQTQQQRPQQNSESGPLPGQPVAPTGGASPGGGNGNGNGGGGGNADDEEGSDSPQPTRSR

SEQ ID NO: 50160 - DNA, 2385 bp, Legionella pneumophila str. Paris
  CDS (1)..(2385)
atgaaaaaaatggcatacttctggcgtaaaggtctttgggcgctgatgagcctgttttttctcctaatagtggctggcagccttctgtacctttatctcgaaagccaattgcctaatgttgattcattaaaaaccgtacaattacaagtaccattacagattttcagcaaagaaggtttattaattcaggaatacggcgaaaaaaaacgtattcccgtaacttatgacgaaattccccctactctgatccatgcattaattgcaacagaagatcaacgattttttgagcaccctggtgtagacgttatgggattgggtcgagccgcagtaagcatgctcaaaactggaaccaaatctcaaggtggcagtacgattaccatgcaggtagctcgtaattttttcttaagccgtaaaaaaacatttttacggaaattcaatgaaattatgcttgctatcaaaattgaccgggaattaagtaaagaaaagattttggaactttacttaaacagggtttatctgggtaatcgagcttatggtgttggcgcggcagccatggtttattttggaaaatcccttaaagaccttaatctggctgaactggctatgatagcaggacttcctcaagctccctcaactcagaatcctatcgctaacccgcttgctgcaaaaaaacgtcgtgaccatgtactggagcgattactggaagaacattatatcaatgaagaacaataccaaaatgcagtcaatcaaccaattactgcaaaataccatggaactaatatcaaggtgaaagcgccttatgttgctgaaatgattcgtcagtctctgtatgacaattttggccccgaagcgtacactaaaggctataaggtatatacaaccattgatggcaaattacaaaatactgccaatgaagtggtagaaaaaaatcttattgcttacgatcatcgacatggttacagagggccaattgccaatataggtgaaaaagacagtcaatctcccaagattaggcaaaaatacttgcggcaatatccagagctgaacaccctgattccagcagtggtcactgaagtaagagaaaaagaagcgactgcggcattacaaaacgggcaaataattattattccctgggagggtatgtcctgggccaggccagcactgaaaagaggaggctgggttgggaaatcaccaaccaaagcacaacaagtggtagcagcaggtgatataatttatgtacaccccacggaaaaatcctggcaactcgcccaaattcctgaagcagaatctgcaatggttgctatgaatcctaaaaatggcgccattgaagttttggtcggaggatttaacttctcaaaaagtaaattcaaccgagctacccaatccagcaggcaaccaggctccagtttcaaaccatttgtttacgctgcagctttgaacaatggttataatcttgctaccttaattaatgatgcccccatcgttgtagacgatcccagccaaccgaatttatggcggccacacaatgtgaatctaaaattcaatggccctacccgcctgaaacaggcattagttcaatctaaaaatttggtatctataagaattctcgatgatattggtattgattatacgatagatttcttaactcgttttggctttaataaaaaatcattgcctagagccttatcacttgctttaggaagtttgtccattagccctatggatttaaccactgcttatgcagtctttgctaatggtggttataaagtagagccctacctcattgaccatataacagatgctgatggtaaaattctgttacaagccaaaccaagtgttgtatgtgacccttgtgataaagacaaagttgatgcctctaccttggcaccgcgcgttatttctgaagacattgcctttttaatgaatacggcattacgcgatgtaatacagcatggcactggacgtgctgcacgagtattaaatcgtcaagacatcgctggtaaaacagggactactaatgatcaagtagatgcgtggtttgccggatttaaccctaatttggtagtaacaacctggattggttttgataatcccaaatcattgcatgaatatgctgcaaatcttgctcttccgctatggattgattttatgaaagtagcattaaaagacaaacctgaaactgaattgaagcagcctgaaaatgttatagcggttcgaatagatccagtaagcggtttgctcgccaagcctaaccaggaaaatggtatcattgagtattttcgacaaaatgaggttccatctgaagaggatcaaggtcctgtctataatgcacataatgataagcaggaagaagaactagcgccagtggaagaaagtttgttttaa

SEQ ID NO: 50161 - protein, 794 aa, Legionella pneumophila str. Paris
MKKMAYFWRKGLWALMSLFFLLIVAGSLLYLYLESQLPNVDSLKTVQLQVPLQIFSKEGLLIQEYGEKKRIPVTYDEIPPTLIHALIATEDQRFFEHPGVDVMGLGRAAVSMLKTGTKSQGGSTITMQVARNFFLSRKKTFLRKFNEIMLAIKIDRELSKEKILELYLNRVYLGNRAYGVGAAAMVYFGKSLKDLNLAELAMIAGLPQAPSTQNPIANPLAAKKRRDHVLERLLEEHYINEEQYQNAVNQPITAKYHGTNIKVKAPYVAEMIRQSLYDNFGPEAYTKGYKVYTTIDGKLQNTANEVVEKNLIAYDHRHGYRGPIANIGEKDSQSPKIRQKYLRQYPELNTLIPAVVTEVREKEATAALQNGQIIIIPWEGMSWARPALKRGGWVGKSPTKAQQVVAAGDIIYVHPTEKSWQLAQIPEAESAMVAMNPKNGAIEVLVGGFNFSKSKFNRATQSSRQPGSSFKPFVYAAALNNGYNLATLINDAPIVVDDPSQPNLWRPHNVNLKFNGPTRLKQALVQSKNLVSIRILDDIGIDYTIDFLTRFGFNKKSLPRALSLALGSLSISPMDLTTAYAVFANGGYKVEPYLIDHITDADGKILLQAKPSVVCDPCDKDKVDASTLAPRVISEDIAFLMNTALRDVIQHGTGRAARVLNRQDIAGKTGTTNDQVDAWFAGFNPNLVVTTWIGFDNPKSLHEYAANLALPLWIDFMKVALKDKPETELKQPENVIAVRIDPVSGLLAKPNQENGIIEYFRQNEVPSEEDQGPVYNAHNDKQEEELAPVEESLF

SEQ ID NO: 50162 - DNA, 2424 bp, Photobacterium profundum SS9
  CDS (1)..(2424)
ttgcacgccaccggaaataaaaagcttgatcctaaaaagcctgcaacgcctcgccgtaaatccccggccaaaacggcagtaaaaaaaacacccgctaaaaaaacacctagaaaatcaacgggtacacgtaagaaaagtactcgcaagaaaaagcctcaacaatctggttggttacgctggttgatgttatttggtttcaagatcagtttagtggtatgtgcggtgttgttagtgatcggtatttatctggataccgttgtacgagatagaatggatggtcagatctggaatttgcctgccgtggtttacgggcgcgtattaaccctgcagcctgggcagccgatcagcttacaagaagttcgccgtgaactggatttgttgcaataccacaaagtgcggaacccgcaacgtgtgggtgagtattcatcatcgtcgactcggattgagtttttccgtcgctcatttgattttgaaacgggaccagaaagccagcgtcatgtcatgttgacgtttgataaaagtgggttgaaatccatacaacaagttggcaccaaaaagccgctggcttatgtacggttagagccgaaaatgttgggaatgttaggttcaacgacagcagagcaacgtatgttcttgcctcgagagcagtttccagaggtattggtcgatgctctgttggtgacagaagatcgtgatttctaccatcatgatggtgtttctcccttggcgattgcacgggctttatttgcgaacataaaagcagggcgcacagtacaaggcggcagtacgttaacacagcagctagcgaaaaatttatttttaagccgagaaagaagcctgtggcgtaaagtccgtgaagcctatatagcgatgatcatcgactaccgttatagcaaagatcaagttttagaagcctatttgaatgagatctatttggggcaaaatggggcgaaagaggtccatggttttgcgcttggggcccgtttgtattttgggcgtcctattcaagaattacggattgatcagttagcgatgttagtgggtacggtaaaaggaccgtcttactataacccatggcgcaacccagaacgggcacgtcaacgtcgtgatctagtgcttcgtttaatgatggataacggggtcttaagtggtgaacaatacgaacaagcggcatctcgtgcattagatgtgcagtcgaaggcaatgattgcaacccgtcagcctgcttatttccagcaactacagcgtgaactgaagcaaaaagtgggtgataagttcacccctggcactggtttacgcatttttagtacgttagatcctctctcacaacaagaagctgaaaatacagtggcagagatgatcccgaagctgaataaaaaagcgggggtatctgtcgaaactgccttagtggctgctgatcgtcaaacgggagaaattcgcgccatgattggcggcagtcgtcctggttatgcgggttttaaccgtgcactcgatgcgagccgtcaaattggatctttggttaaacctgcagtctatttggccgcgcttcgtcacccagaacgttttacgttggccacaactattgatgataaacctatcgcattgaagggcagtaaagggacacaatggaagcctcgaaattacgaccgtaaatttcgtggagaagtacctttgtattatgcattggcaaaatcgcttaacgtaccgaccgttaatctagggatgcaagtcggcttaggggcggtgattgataccatggagcaactaggggttgatcgaaatgaagtccctaaactaccgtcaattttactgggcgcatttacgctaaccccatttgaagtaacgcagatgttccagacgattaccaatggtgggcgaaagtccaaactgaccgcgttacgtgccgtggtcgatcttgagggtaatctgctttatcagagcgttcctaaagcctctagagcggtgccggagcaagctgcatggctgacaacatatggaatgaaaaatgttgtcagccaaggtaccgcgcgtttcctgctgccgacatttggttgggctgcattagcgggtaaaacaggtacaaccgataaagcgcgtgatagctggtacgccggtgctgacgggcgtgaagttgtcactgtatgggtaggtcgtgatgataataaaccagtgagacttacgggttctgctggtgcgttacgtttatatgcaaattatttacaacgtcgccaagccaccgcgttgcgacttgattggccaagtaagatcacaacggtgaaatacgataggcagcctaatggtacgttaagctttaattgtagcggtacgcagtctttaccagtatgggataccgacggcaaattgaaagcgcaatgcaccggtaatcaacctaaagcgtggataaaagagatgtttacttggtaa

SEQ ID NO: 50163 - protein, 807 aa, Photobacterium profundum SS9
MHATGNKKLDPKKPATPRRKSPAKTAVKKTPAKKTPRKSTGTRKKSTRKKKPQQSGWLRWLMLFGFKISLVVCAVLLVIGIYLDTVVRDRMDGQIWNLPAVVYGRVLTLQPGQPISLQEVRRELDLLQYHKVRNPQRVGEYSSSSTRIEFFRRSFDFETGPESQRHVMLTFDKSGLKSIQQVGTKKPLAYVRLEPKMLGMLGSTTAEQRMFLPREQFPEVLVDALLVTEDRDFYHHDGVSPLAIARALFANIKAGRTVQGGSTLTQQLAKNLFLSRERSLWRKVREAYIAMIIDYRYSKDQVLEAYLNEIYLGQNGAKEVHGFALGARLYFGRPIQELRIDQLAMLVGTVKGPSYYNPWRNPERARQRRDLVLRLMMDNGVLSGEQYEQAASRALDVQSKAMIATRQPAYFQQLQRELKQKVGDKFTPGTGLRIFSTLDPLSQQEAENTVAEMIPKLNKKAGVSVETALVAADRQTGEIRAMIGGSRPGYAGFNRALDASRQIGSLVKPAVYLAALRHPERFTLATTIDDKPIALKGSKGTQWKPRNYDRKFRGEVPLYYALAKSLNVPTVNLGMQVGLGAVIDTMEQLGVDRNEVPKLPSILLGAFTLTPFEVTQMFQTITNGGRKSKLTALRAVVDLEGNLLYQSVPKASRAVPEQAAWLTTYGMKNVVSQGTARFLLPTFGWAALAGKTGTTDKARDSWYAGADGREVVTVWVGRDDNKPVRLTGSAGALRLYANYLQRRQATALRLDWPSKITTVKYDRQPNGTLSFNCSGTQSLPVWDTDGKLKAQCTGNQPKAWIKEMFTW

SEQ ID NO: 50164 - DNA, 2391 bp, Photobacterium profundum SS9
  CDS (1)..(2391)
atgacgatgtcagataaacacaaacagcacgaaccaagctcaccacttgatgattctaagacagcaccagaatcagcgtctcccgacggtaagcaaccgactcctacgtcaccaaatcctactccaccaaagaagacgaaacgtgtgtggattaagcgctcgctgattggtgccgtaatattgggttcggttagcatggtatggatgggtttttcacttaaccaagccgtaagtgaaaaatttgaagggcaactttggcagttaccttcggttgtctatgcgcgtgaactgactcttcagccgggtgctcccattcgatttgatgatttagttaacgaacttaaggtattaaaatacagaaaagttgcctcaccaaagcaaagtggtgagtattcggtaagccgtcagcgtgttgagcttgtacgccgtccctttgaatttaaagaaggcattgaaggcgctcggcatgttgtggttgattttgactatgcatcgattaaacgtatttcagaagtcgagtcaaaccgagaattaggctttcttcgtgtagagcctaaaatgctgggtatgttagaagcaaaagccgaagaacagcgtatttatttaccgaaagatgaaatgcctgagcatttaattcaagctttgctcacgacagaagatcgtaatttttatgagcatgatggtgtttctcccgttgcgattgcgcgtgcatttttagctaatctaaaagcgggtagaaccgttcaaggcggcagtacgcttactcagcagttgaccaaaaaccttttcttaagtagtgaacgtagcttatggcgtaaattcaaagaagcgtacatggcgttaatcattgattaccgttatgacaaagatcagatccttgatggctacttaaaccaagtgtatttagcacaaagcggggcagatgctattcatggttttgcgttgggagcacgtttctattttggacgccctttgtctgaattacgtgtcgaccaacaagctttgctggtggggttagtaaaaggtccatcatattataatccatggcgataccctgagcgtgtgaaacaacgtcgtgatttaattctcagcatgatgatggattcaaagcagctagaaccggcagattatgaagccgcaataaagttacccttagatttacaagaaaaaggtcagattgccaatcgccagcccgcgtattttgagcaaattaaacgagaactaaaagcgaatgttggtgatgactatcagccagataaaggtttacgattgttcacatcactcgaccctttatcgcaagaaaaagcagaattagcggttcgacaaacggtgcccaaattagagaaaaaggcaggtaaagaactagaaactgccgttgttattgcagatcgtatgtctggcgaaattcgagcaatggtaggcggaagtcgtccgggatatgctggctttaaccgcgctattgatgccaaacgtcagattggttctatcgttaaacctgccatctatcttgctgcacttgaacagccagaacgtttttctctcgcaacaagcttgaaagatcgaccgcttacgttaaaaggggcaaaaggcgagaattggtcgccacgtaactatgatcgccaataccgtggtgaagtgccgttgtatcaagctttggctaagtcttacaatattcctaccgtgaatcttggcttggctgttgggcttgataccgtgattgatacgcttgataagttgggtgtcgatcggaaagaagtgcccaagttaccttctatgttattaggcgcatttacattaacgccattacaagtgacccagatgtatcaaaccattgcgagtggtggtcataaagccgaacttacagcattaagcgcagtaacagatggtaaaggcaatatcatttatcaaaattggccaacatcatcccccgcagtacctgcacaagctgcttggttaacgatgtatggtatgcaaaaagtagtttcgactggtactggtcgttacttgaatgcacaatttccctcatcacatttagcgggtaaaacaggtacaacagataaaaaccgtgatagctggtatgtcggtattgatggacgagaagttgtgactgtttggatggggcgagatgataataaaggtattaatctaacgggttcttctggggcgctaagattgtattctgattatattaagcagcgtgatcctgaagcattagtgctacgtcgccctgctcaaattacgaacttcacatacagtcaatctcagaatggtacgtattcagccagctgtgtggggcaaagtaagttgccagcatgggatccgaaaggaaaccttcaacccagttgcgttaagagcgtggaaggctttttacaaaaattatttagttggtaa

SEQ ID NO: 50165 - protein, 796 aa, Photobacterium profundum SS9
MTMSDKHKQHEPSSPLDDSKTAPESASPDGKQPTPTSPNPTPPKKTKRVWIKRSLIGAVILGSVSMVWMGFSLNQAVSEKFEGQLWQLPSVVYARELTLQPGAPIRFDDLVNELKVLKYRKVASPKQSGEYSVSRQRVELVRRPFEFKEGIEGARHVVVDFDYASIKRISEVESNRELGFLRVEPKMLGMLEAKAEEQRIYLPKDEMPEHLIQALLTTEDRNFYEHDGVSPVAIARAFLANLKAGRTVQGGSTLTQQLTKNLFLSSERSLWRKFKEAYMALIIDYRYDKDQILDGYLNQVYLAQSGADAIHGFALGARFYFGRPLSELRVDQQALLVGLVKGPSYYNPWRYPERVKQRRDLILSMMMDSKQLEPADYEAAIKLPLDLQEKGQIANRQPAYFEQIKRELKANVGDDYQPDKGLRLFTSLDPLSQEKAELAVRQTVPKLEKKAGKELETAVVIADRMSGEIRAMVGGSRPGYAGFNRAIDAKRQIGSIVKPAIYLAALEQPERFSLATSLKDRPLTLKGAKGENWSPRNYDRQYRGEVPLYQALAKSYNIPTVNLGLAVGLDTVIDTLDKLGVDRKEVPKLPSMLLGAFTLTPLQVTQMYQTIASGGHKAELTALSAVTDGKGNIIYQNWPTSSPAVPAQAAWLTMYGMQKVVSTGTGRYLNAQFPSSHLAGKTGTTDKNRDSWYVGIDGREVVTVWMGRDDNKGINLTGSSGALRLYSDYIKQRDPEALVLRRPAQITNFTYSQSQNGTYSASCVGQSKLPAWDPKGNLQPSCVKSVEGFLQKLFSW

SEQ ID NO: 50166 - DNA, 2331 bp, Streptococcus thermophilus LMG 18311
  CDS (1)..(2331)
atggctaaatttaatttcagcaactttaaagaatcacttaacggttcaactaaacgtgctaaaaacacacaggttaaacgttcagattcttctcgctatagcaaaggaaaacgctcagctgcttcagatcaaaatttaggatggcgtattgcaaaatacgcttttattggactactcactttctttgtaatctgtgtcatcgctggtggtggactctttgcttactatgttagcagtgttcctaaacttaccgagaacaagttgcaatcaacaaactcaagtaggatttacgatggtaatggtagtcttattgctgacttgggatccgaaaaacgtgaaagtgcatcaacagatgagattcctataatcctagtcaatgcaattacctctatcgaggataagcgtttctttacccatcgcggcattgacgtttatcgtattatgggagccgctattaacaaccttcgccataacagcactcaagggggatctacacttgaccaacagttgattaagttagcctacttctcaactaatacctcagaccaaacccttaaacgtaagtcacaagaaatatggttatctctccaaatggagcgtcagtatactaaacaagaaatcttgaccttctacgttaataaggtttatatgggtaatggttactacggtatgaagaccgcagctaaatcttattttggtaaagaattaggtgacctctcagttgcccaagcagctcttcttgctggtatcccacaagcaccaacacaatatgatccttatgctaatccggatgctgctaaagaacgtcgcaacactgttcttaatgaaatgtatgaagacaaaaatatttctaaagaggagtacgagcaagctaaagcaacggatgtatcagatggtcttcttccacttacgaataaagctagctacgaaccatacctagataactacatcaaacaagttattgaacaagtctctaccgaagccaatgctgatatctactcagctgggctcgatgtctatacaaatcttgatcctgatattcaaaaatacatttggaatgtctacaactcaaatgattatattgcttatcctgatgacaaatttcaagtagcttctactatcattgatgttaccaatggacatgttgttgctcaattgggatcacgtcaccaagacgaaaatattgcccttggtacaaaccaagctgttcaaactgaccgtgactggggatctacaatgaaacctatcaccgattacgcacctgctattgaaaaaagagtatatactaacaccggtactaccgtttacgataccccttataatttcccagatacttcaactccagtttacaactgggaccgcaagtattacggaagtatctctctgacttatgcgattcaaaaatcacgtaacgttcctgcggttaaagcgcttcaagcgactggcttggagtatgctcaatcctttttgaaagatttaggtattgagtacccagagatgttctattcaaacgctatctcatcttcaacaacatcatcagatcctaaatatggtgcttcaagtgagaagatggcggctgcctatgcagcctttgccaatggtggtacttactataaaccatcctacattaaatcaattaaatttgaagatggttcaacaaaatcatacgattctaaaggtgtcgaggccatgtcgccacaaacagcttatatgatgaatagcatgttgaaacaggttttgacaggtggtacagcgactgaagcttatgtacctggcaccatcaatgctggtaaaacgggtacatctagctatagtgacgatgagtactatcaagtacaaaaagaaagtggcgtctacgctgatcttattgttcctgacgaaacgttcgttggttataatactaaatatgcaatggccatttggacaggttatgaaaaccgtaaaactccactttatggctcagacctaaatatcgctaaacaaatctacggtctaacaagtagatacctcaaccagatgtatggtgcaggttcgaaagatttcgatatgcctagtggtgtttacaacaatggtagttacgtcttcctaactggttcgtcaacgtcaaatgtttataacggatcactaggaacatctagctcatcatcaagttcagattatggtaaaagtagtgactcatcaagttcggattatggtaaaagtagtgactcatcaagttcacaagatagtcaacagtatggcccagatgcatcaacaaatccttcaacatcgggttctaacggtgctgagaattcaaattcaaacacttctacttctacagtagatgagtaa

SEQ ID NO: 50167 - protein, 776 aa, Streptococcus thermophilus LMG 18311
MAKFNFSNFKESLNGSTKRAKNTQVKRSDSSRYSKGKRSAASDQNLGWRIAKYAFIGLLTFFVICVIAGGGLFAYYVSSVPKLTENKLQSTNSSRIYDGNGSLIADLGSEKRESASTDEIPIILVNAITSIEDKRFFTHRGIDVYRIMGAAINNLRHNSTQGGSTLDQQLIKLAYFSTNTSDQTLKRKSQEIWLSLQMERQYTKQEILTFYVNKVYMGNGYYGMKTAAKSYFGKELGDLSVAQAALLAGIPQAPTQYDPYANPDAAKERRNTVLNEMYEDKNISKEEYEQAKATDVSDGLLPLTNKASYEPYLDNYIKQVIEQVSTEANADIYSAGLDVYTNLDPDIQKYIWNVYNSNDYIAYPDDKFQVASTIIDVTNGHVVAQLGSRHQDENIALGTNQAVQTDRDWGSTMKPITDYAPAIEKRVYTNTGTTVYDTPYNFPDTSTPVYNWDRKYYGSISLTYAIQKSRNVPAVKALQATGLEYAQSFLKDLGIEYPEMFYSNAISSSTTSSDPKYGASSEKMAAAYAAFANGGTYYKPSYIKSIKFEDGSTKSYDSKGVEAMSPQTAYMMNSMLKQVLTGGTATEAYVPGTINAGKTGTSSYSDDEYYQVQKESGVYADLIVPDETFVGYNTKYAMAIWTGYENRKTPLYGSDLNIAKQIYGLTSRYLNQMYGAGSKDFDMPSGVYNNGSYVFLTGSSTSNVYNGSLGTSSSSSSSDYGKSSDSSSSDYGKSSDSSSSQDSQQYGPDASTNPSTSGSNGAENSNSNTSTSTVDE

SEQ ID NO: 50168 - DNA, 2328 bp, Streptococcus thermophilus CNRZ1066
  CDS (1)..(2328)
atgacactttttgataatctaaaaaacaaactttttaaagaagaaactagcgggaagggtaaggaatcccagcctgctggaaaatcgaaggatttacaagataggataaaaggtctttttgccaagaagcctgatgaagttgaacaagccgttgaagaacttgacatgtcacgagaaagccaagagacttcacgttaccaacgttctaagcaaaagaaacctattgacacgaccaaacccttaggtaaggttcgggctttcttgagcaagttcactctttcgccaagaaatcctattcgccgtttctggcgtcgctatcatattggtaaaattctctttatcttggtagccgtgttggttctgacagtaggctcctatctcttctatatcgctaagacgaccaatgtctcagatcttcaggatgccttgaaggctactacggttatctatgacaaagaaggcaatcaagctggttcactgtcagggcaaaaagggacctatgtggagctagatgctattagtgatagcttagaaaatgccgtcattgcaacggaggatcgtaccttctacaaaaatagtgggattaacgtcaaacgtttcctcctagccattgtttctatgggccgatttggtggtggttcgaccatcacacaacagttggctaaaaatgcctttttgactcaggaacagacagtaactcgtaaggccaaggaattctttctttctttggaactaaccaagaaatacagcaagcaagaaatccttaccatgtatctcaataatgcctacttcggaaacggtgtttggggtgttgaagacgccagccaaaaatactttgggacaagtgctgccaatctaacggtggatgaggcagcgacacttgcaggtatgcttaagggacctgaaatttacaatccgattgataatatccaaaatgcaaccaaccgccgaaacactgtccttgccaatatggtagatgatgagaagttgagtcaagctgatgctgatagtgcagctggagttgatatggctagtcgcttggttgatacttatcaagggactggtgatgactataggtatccgtcttactttgatgctgtcattgaagaagctactaagacttatggcttgagtgaggatgaaattgttaaaaatggctataaaatctatacagagatggatgccaactcacaggctaatatgcagcagacttatgaaaatagttatctctttcccacgtcagaaagtgatggtagcacagcccagtcagctagtgtagcacttgatccatcaactggagcggttcgtggtttggtaggtcgtgtaggtggtacaggtgatacaaccttccgtaatttcaactatgcaacccaagggaagcgtagtcctggttcgacaatcaaacctttggtggtttatgctccagctctggcttcagggtggagcatcaataaggacctacctaatacgccaattgattacaatggctataccccaaccaactatggtggtgttgagactgaggatgtgcccatgtatcaagctttggccaactcttacaatattccggcagtttatctctttaaccaaatcggtatacaaaaagggattagttacggtcagaaatttggtcttaactttgataatgttccagaagaattagggattgcactcggtggtggtgtgacagctagtcctctacaaatggctcaggcttatgcgacctttgccaatggtggggagatgaatacagcttattttatcactaaaattgaaaatgctagtggtgatatcattgctacccatagtaagaagtctaaacgtattatcagccagtctgtagctaaccagatgactagcatgatgctcggtaccttctcaaatggttccgctgttaatgccaactacacgggttacactatggcaggtaagacaggtactgttcaggccgagtttaacaaagatttgaccagtgaccagtgggtaattggctatactcctgatgtggttataacgacttggattggttttgataagactgacgagaatcactacttaacaggagcaagctcaggaacggcttcaactattttcagctatatcgctgcagatgttttgccaaatacaccaggtaatgagtttaccgttgaaaatgcctatgcggctgatggtcaaaccttagattatacagcaaatccaaacgattcacgtaatagtaataataagtcatggacagacaaggcttcagacgttgtcaatgatgtaaaagatcaagcaagcagcctatgggataagacctcagactccttctcaggtctattcagatag

SEQ ID NO: 50169 - protein, 775 aa, Streptococcus thermophilus CNRZ1066
MTLFDNLKNKLFKEETSGKGKESQPAGKSKDLQDRIKGLFAKKPDEVEQAVEELDMSRESQETSRYQRSKQKKPIDTTKPLGKVRAFLSKFTLSPRNPIRRFWRRYHIGKILFILVAVLVLTVGSYLFYIAKTTNVSDLQDALKATTVIYDKEGNQAGSLSGQKGTYVELDAISDSLENAVIATEDRTFYKNSGINVKRFLLAIVSMGRFGGGSTITQQLAKNAFLTQEQTVTRKAKEFFLSLELTKKYSKQEILTMYLNNAYFGNGVWGVEDASQKYFGTSAANLTVDEAATLAGMLKGPEIYNPIDNIQNATNRRNTVLANMVDDEKLSQADADSAAGVDMASRLVDTYQGTGDDYRYPSYFDAVIEEATKTYGLSEDEIVKNGYKIYTEMDANSQANMQQTYENSYLFPTSESDGSTAQSASVALDPSTGAVRGLVGRVGGTGDTTFRNFNYATQGKRSPGSTIKPLVVYAPALASGWSINKDLPNTPIDYNGYTPTNYGGVETEDVPMYQALANSYNIPAVYLFNQIGIQKGISYGQKFGLNFDNVPEELGIALGGGVTASPLQMAQAYATFANGGEMNTAYFITKIENASGDIIATHSKKSKRIISQSVANQMTSMMLGTFSNGSAVNANYTGYTMAGKTGTVQAEFNKDLTSDQWVIGYTPDVVITTWIGFDKTDENHYLTGASSGTASTIFSYIAADVLPNTPGNEFTVENAYAADGQTLDYTANPNDSRNSNNKSWTDKASDVVNDVKDQASSLWDKTSDSFSGLFR

SEQ ID NO: 50170 - DNA, 2088 bp, Thermus thermophilus HB8
  CDS (1)..(2088)
gtggccgtgcggcttgcgcggttactcctctggggcctttggggggcggttttgggcggggcgggggcgttggggtatttggtctacgcctacacccgggacctgcccgacctctccgcctttgagaggctccggctcaccgccaccaccaccctctacgcccgggacggctccaccctcgccctcctcgccagcgtggaggacgggcgggccatcaaccggagcctggtccgcctctctgaggtctcgcccgcggccctcgccgccatcgtcttctccgaggaccggcgcttctacagccactacggcgtggatcccgtgcgccttctcggggccctgtacgcggtgctcaccggggacctccagggggggagcaccgtcaccacccaggtcatcaagaacaccctcctcaaggagctcgcccaggcccgcaccctggagcgcaaggtgaaggagtgggtcctggccctggagctggagaggcgctacaccaaggcggagatcctggagatgtacctcaacgtggtcccctggggggggaacgccgtgggcatccgggccgccgccgaggcctacttcggcaaggaccccgcggccttgaccctcgccgaggggctctatttggcgagcctcatccccgcgcccaacgcccgctaccaggacctcgagggggtgcgccgccgcatgcgccgggtcctggacgagatggtccgggagggctggattacggaggccctggcggagcgggcctggaaggagccgcttaagcccaggggctgggaggtgcgctacgacgaggagggcaaccttctggaggcccgcctggtggacccggaggcccgcatcctccgctccgtggactaccgcctcgccccccacttcgtcctcgaggtgcggcgcttcctggaggagcgcttcggcaaggagaaggtctacggggagggggggcttaaggtctacaccaccctggacccgaggatgcaggaggccgcggagaaggcggcccgggcggcccggcttcccgagggggcggacctcgccatcgtgggcctggacccggagacgggggaggtcttggccatggtgggcggggtgcgccgggagaacgacgagtacaaccgggcgacccgggccctgagaaacccggggagcgcggtcaagcccttcgtctacgccgccgccctggaggcgggctggacccaggtgaccctggtgcccgaccggcccatggagttcaaggacccgagccagcctgggggcgtctggcggcccaagaacttctccggcaccttcctgaaccgggagatcacggtgcgctacgccctggacctttccctcaacctccccgccgtctacaccgcccaggcggtgggcctggaccgggtggcggcgaagctcgcccaggcggggttcgcggtgcgctacgccgtccccgccatcgccatcgggggggcctccattacccctgtggacctggccgcggcctacgctgccttcgtcaacggcggctaccgggtggcccccctcctggtcctgcgggtggaggaccaggagggccgggtcctgtaccaggccaccccccacaggacgcggctcttcagcccggaggtggcctaccagggttgggacctcctcaaggggtacgtctacgacctgggggagaagggcctcgccaagggggccaggatcccggggcgggtggtgggggggaagacgggcaccaccaacgaggcccgggacctctggttcgccggggtgacccgggggctttccgccgtggtctgggtggggcgggacgacaaccggcccctcaggatgggggggagggagcccagtagctccgtggtcaacccccccatctggcgggacttcgtggccgaggccctaaaggggcgccctgggggcgacttccctcccccttcggggcttgtgcccgtgcgggtggacctggagaccggcctgccgagcgagaagggggtggtggtctacgtgcccgagggcaaggtgccctcggggaggcccccggaggaaagccccgccttgccccttcccctccccctcctcacgcccccggggggcgggctttag

SEQ ID NO: 50171 - protein, 695 aa, Thermus thermophilus HB8
MAVRLARLLLWGLWGAVLGGAGALGYLVYAYTRDLPDLSAFERLRLTATTTLYARDGSTLALLASVEDGRAINRSLVRLSEVSPAALAAIVFSEDRRFYSHYGVDPVRLLGALYAVLTGDLQGGSTVTTQVIKNTLLKELAQARTLERKVKEWVLALELERRYTKAEILEMYLNVVPWGGNAVGIRAAAEAYFGKDPAALTLAEGLYLASLIPAPNARYQDLEGVRRRMRRVLDEMVREGWITEALAERAWKEPLKPRGWEVRYDEEGNLLEARLVDPEARILRSVDYRLAPHFVLEVRRFLEERFGKEKVYGEGGLKVYTTLDPRMQEAAEKAARAARLPEGADLAIVGLDPETGEVLAMVGGVRRENDEYNRATRALRNPGSAVKPFVYAAALEAGWTQVTLVPDRPMEFKDPSQPGGVWRPKNFSGTFLNREITVRYALDLSLNLPAVYTAQAVGLDRVAAKLAQAGFAVRYAVPAIAIGGASITPVDLAAAYAAFVNGGYRVAPLLVLRVEDQEGRVLYQATPHRTRLFSPEVAYQGWDLLKGYVYDLGEKGLAKGARIPGRVVGGKTGTTNEARDLWFAGVTRGLSAVVWVGRDDNRPLRMGGREPSSSVVNPPIWRDFVAEALKGRPGGDFPPPSGLVPVRVDLETGLPSEKGVVVYVPEGKVPSGRPPEESPALPLPLPLLTPPGGGL

SEQ ID NO: 50172 - DNA, 2046 bp, Geobacillus kaustophilus HTA426
  CDS (1)..(2046)
gtggaggcgcaaagcaggcagcaaatgagacaaacaagacgaagacggtgttggctgcaggcgctcgttgtcgccgccttggctttggccgccgttgttgctgcgctcgagtgggcgattgatcgacaaaacattgccgccttggaaacaccgttgccggcagcgacaatcatttatgatgaacacggccgcatcgcgagcaagctcgcggcggcaaacatcgaagaagtgccgatcgacagggtgcccaactattttcttgaggccatcgtcgcgacggaagaccgccgcttttacgagcatgatggcgtcgattattatgggcttttgcgcgcgatgtggcgcaacattcgcgccggggcgtgggtcgagggcggcagcacgatcactcaacagctggcgaaaaacgtctttttaacgaatgaaaaaacgttgacacgcaaatggaaggaatggttgatcgcacaaaaaattgagcgcacgtacagcaaacaagaaattttagaaatgtacatcaatcgcatttatttcggtgcgggggcgtggggggtggccagcgcggcgaaaacgtactttggcaaagacgtttctgagttgacgctaagcgaatccgccatgttggttggtctcatcaaagcaccgtccgctttatcgccggtccgtcattacgataaggcggtcgcccggcgcaatgtcgtcttgtcgctcatgaaagaacaaggctatatcgatgatcaagagtggatcgccgcgaaaaacgagcacattgccattcaacaggaaccaaaacgcgacccgtatgccggaaaatatccgtactacgtcgatgaactaatccacgaagcgattgcacaatacggcctgacgcaaagcgatgtcctttccggggggctccgcatttacacggagcttgacccgaacatgcaacaagcgcttgaagccgtgtatgcgaatgattcgctgtttccatcaagcccggacggtgtgcctgtccaaagcggagcagtgctgctcgacccgaaaacgggcggggtgaaggcgcttgtcggcggccgcggccgccatgtgttccgcggtttcaatcgcgccacagagctcaggcgtcaaccggggtcaacgctcaagccgctcgccgtgtacacgccggcgctcgaacaagggtacgggccgttttcgctgctcaaagacgagccgcttaatctcggcggctaccgcccgcaaaactacgaccacacgcaccgcggcacggtgacgatgtatgaggcgatcatccattcgctcaatgtgccggccgtctggctgttaaacgaaatcggccttgacaaagggatggaggcgctgcaccggtttggtttgccgttggaaaaagaggaccgccagctcggcatcgcgctcggcggcatgtcccgcggcgtctcgccgctcgagatggcggaagcgtacgccgtattcgccaatgacggcgtccgtttggacggccatctcattacaaaaatcgttgatgcttacggccgcaaggtagcggagtggaagccgcggcgaacggttgtcacgtccaagaaagtggcgcagcaaatgacgtttttgctcgaaggcgtcatccgcgaagggaccgggaagcgcgctgccatcccggggcgggagcttgcgggcaaaaccgggtcgaccgaaatgacgatccccggcatcgacggggtgaaagaccaatggatggtcggctatacgccgcagctggtcggtgcgctttggctcggctatgaccggccggacgaaacacattatttgacgacgacgagcggggaaacggcggccatcattttccgccatatgatggaaaaagcgctggccgacgagcctgtcgtccgcttctcgctgccgcttgtgaaacaagcggaacgagaacacaaaaaacgtgagccaaaggcgcctgaatccgtgccgccaaaggtgaaggaaaaaccgcgtacgcccggccatgaaaaaggaaaaaacaaagagaaaaaagaaaaaaagcacggaaaagggcatggcggcaagcatgaataa

SEQ ID NO: 50173 - protein, 681 aa, Geobacillus kaustophilus HTA426
MEAQSRQQMRQTRRRRCWLQALVVAALALAAVVAALEWAIDRQNIAALETPLPAATIIYDEHGRIASKLAAANIEEVPIDRVPNYFLEAIVATEDRRFYEHDGVDYYGLLRAMWRNIRAGAWVEGGSTITQQLAKNVFLTNEKTLTRKWKEWLIAQKIERTYSKQEILEMYINRIYFGAGAWGVASAAKTYFGKDVSELTLSESAMLVGLIKAPSALSPVRHYDKAVARRNVVLSLMKEQGYIDDQEWIAAKNEHIAIQQEPKRDPYAGKYPYYVDELIHEAIAQYGLTQSDVLSGGLRIYTELDPNMQQALEAVYANDSLFPSSPDGVPVQSGAVLLDPKTGGVKALVGGRGRHVFRGFNRATELRRQPGSTLKPLAVYTPALEQGYGPFSLLKDEPLNLGGYRPQNYDHTHRGTVTMYEAIIHSLNVPAVWLLNEIGLDKGMEALHRFGLPLEKEDRQLGIALGGMSRGVSPLEMAEAYAVFANDGVRLDGHLITKIVDAYGRKVAEWKPRRTVVTSKKVAQQMTFLLEGVIREGTGKRAAIPGRELAGKTGSTEMTIPGIDGVKDQWMVGYTPQLVGALWLGYDRPDETHYLTTTSGETAAIIFRHMMEKALADEPVVRFSLPLVKQAEREHKKREPKAPESVPPKVKEKPRTPGHEKGKNKEKKEKKHGKGHGGKHE

SEQ ID NO: 50174 - DNA, 2691 bp, Geobacillus kaustophilus HTA426
  CDS (1)..(2691)
atgtctggtgaatatcgttctcgcgtagaacgaaagcaggcagcgaaacaaacgaaacagaagaaagcgaaaacgaaacgaggaagatcgtggttaaaaaccatcgccattgcgatattgctgatgatggtccttggcgccatcgggggtattgccactttcgcctatttcgttaaggacgctcctccgctggatgaggccaaaattaaagatccgctttcttccgtcttgtacgatatgaatggaaaacaagtagcggagcttggcggctacaagcgaacgtacatttcgtataaagacgtgccgaaagtgcttgaagatgccgtcttggcaacagaggacgcccgcttttatgaacaccacggcatcgatgtcgtccgcttggctggcgccgtcctcgccaacatcaaggaaggatttggtgcagaaggcggcagcacgatcacccagcaagtcgtcaaaatgacgtttttgtcgtcagaaaaaacgttgaagcgaaaagcgcaagaggcatggctcgcgctgcagcttgaacaaaaatattcgaagcatgaaattttggaaatgtatttgaacaaaatttattattcagacggcatttatggcgtcgctcgcgccgccgaatattattttggcaagacagacttgaaaaagctcactcttccggaagcggccttgctcgccggcatgccgcaaagtccaaaccggtataatccgtatgaccatccagaggcggcgaaaaaacggcgcgataccgtattgtcgctcatggcgaaacatggctttatcagccaggaagaagcggaaaaagcgaaacaagtgccgatccagtcgatgctcgctgagcggaaaaaatcgcaaagctccgtgccgtatgacgccttcattgacgaagtaatcaaagaagtgaccgacaaagcgaacgtcaacgtctttgaagatgggctgaaaatttatacaacgctcgatcaaaacgttcaaacatacgtagaaaagctattaaactctgacaaatactttaccaataagaaggatttgcaatccggcatcgccgtcgtcgacaccaaaacaggcgccattcgcgcgttaggcggcggtcgccatcgcgacaatatcgaattcggcttcaactacgcaatccaaccggtcggccagcccggttcaacgatcaagccgattttggactatggcccggcgattgaatatttaaaatggtcaacagcgcacattcttgttgacgagccgtatacgtattcggacggcacgccgatccgcaacgccggcggaaaatacgctgggccggtgacattgcgcaaagctctcacgtggtcatacaacattccggcgctcaaaacctatcaagccgtcggcaaagagcgggcgatggagttcgctaaccgactcggcatgggctttgatgaagtatatgagccttacgctatcggcggagtatcccgctacgtatcggtgctgcaaatggctggagcgtacactgcttttggtaataacggcgtctatacgaagccatatgccgtgacaaaaatcgtcttcccggacggcacggaaatggatttgcaacccaaaccaaaacgagtgatgcacgactataccgcctacatgatcacggacgtgctgaagtctgtcatccgctccggaacaggtcaattggccaatgttccaggacttgagctcgcaggcaaaacagggacgacgaactatgggaaagatggagcaaaattcggccttgaccgggacgatgtgccggacagctggattgtcggctatacgccaaactatacggcggccatttgggtcggcttcagcaagcgaagcagcacggcaaagcttgataaatatgagcagaaaatcccgaaatatttgctcagagacatcatgtcccacatcgatgacggtagtggggaattcaaacagccggacagcgtcgtcaagctgccgatcaaaaaaggcacaaacccgccgaagctcgccggcaaatacacgccggaaagcgaaattacgtatgaattgttcgtgcgcggcactgagccgacggagacggcgaacgacgtgccggaagaactgccggcggtgaaagggttgaccgctgtgtacgaccaagcggcgaacgccatctcggtttcgtggtcatacgatgagcaaaccgatgagacgatcttcgaggtgcgcgtcaaagatggccaaggtcaaacgaatacgatcaccacaaaagaccgttcgatcacgatttccaatccgacgccaggatggacgtacacaatcgccgtgtacgcaaaagacggcgaacgaatgagcaaaccggccatagccagcgttcatgtccccggcggagaagatcaaactcccgtgccacaacaaccgggggatgacagccaaggcagcggcgggcaaaacggcggcaccgatcaaggcaacagcgggaataacggaaacgaaaacggtcagggaaacaacaatgaacaaaacggcggcgcaagcggcggacaagaaaatggcaacagcggcggggccaaccaaaacaatggccaaacggatggaacaaacaaccaaggaacgaacaacagcggccaaacgaacggaacgaacggtggaacgggtgcaaacagcggaacgccgcctgtctccccgccgttaaaaaacggatccggagcgggtcttggcacccgtccataa

SEQ ID NO: 50175 - protein, 896 aa, Geobacillus kaustophilus HTA426
MSGEYRSRVERKQAAKQTKQKKAKTKRGRSWLKTIAIAILLMMVLGAIGGIATFAYFVKDAPPLDEAKIKDPLSSVLYDMNGKQVAELGGYKRTYISYKDVPKVLEDAVLATEDARFYEHHGIDVVRLAGAVLANIKEGFGAEGGSTITQQVVKMTFLSSEKTLKRKAQEAWLALQLEQKYSKHEILEMYLNKIYYSDGIYGVARAAEYYFGKTDLKKLTLPEAALLAGMPQSPNRYNPYDHPEAAKKRRDTVLSLMAKHGFISQEEAEKAKQVPIQSMLAERKKSQSSVPYDAFIDEVIKEVTDKANVNVFEDGLKIYTTLDQNVQTYVEKLLNSDKYFTNKKDLQSGIAVVDTKTGAIRALGGGRHRDNIEFGFNYAIQPVGQPGSTIKPILDYGPAIEYLKWSTAHILVDEPYTYSDGTPIRNAGGKYAGPVTLRKALTWSYNIPALKTYQAVGKERAMEFANRLGMGFDEVYEPYAIGGVSRYVSVLQMAGAYTAFGNNGVYTKPYAVTKIVFPDGTEMDLQPKPKRVMHDYTAYMITDVLKSVIRSGTGQLANVPGLELAGKTGTTNYGKDGAKFGLDRDDVPDSWIVGYTPNYTAAIWVGFSKRSSTAKLDKYEQKIPKYLLRDIMSHIDDGSGEFKQPDSVVKLPIKKGTNPPKLAGKYTPESEITYELFVRGTEPTETANDVPEELPAVKGLTAVYDQAANAISVSWSYDEQTDETIFEVRVKDGQGQTNTITTKDRSITISNPTPGWTYTIAVYAKDGERMSKPAIASVHVPGGEDQTPVPQQPGDDSQGSGGQNGGTDQGNSGNNGNENGQGNNNEQNGGASGGQENGNSGGANQNNGQTDGTNNQGTNNSGQTNGTNGGTGANSGTPPVSPPLKNGSGAGLGTRP

SEQ ID NO: 50176 - DNA, 2577 bp, Salmonella enterica subsp. enterica serovar Paratypi A str. ATCC
  CDS (1)..(2577)
atgacactaaatgggaaatctccagtgaagttcgtaaagtatttattgatccttgcagtatgttgcatcctgctgggagcaggctcgatttatggcctttatcgctatattgagccacagctacctgacgtcgcgacattgaaagatgtgcgtttgcaaattccgatgcaggtttacagcgcggatggcgaacttatcgcgcaatatggcgaaaaacgccgtattcccgttacgctcgatcaaattccgccggaaatgatcaacgcctttatcgccaccgaagatagccgcttttatgagcatcacggcattgacccggtaggtattttccgtgcggccagcgtcgcgctcttctccggtcacgcatcgcagggagcaagtaccattacccagcaactggcgcgaaacttcttccttagccccgaacgcacgctgatgcgcaagatcaaggaagcgtttctggcgattcgtattgagcagttgctgaataaaaatgagatcctcgaactctatctgaacaagatctatctcggctaccgcgcctatggcgttggcgcggcggcacaggtctactttggtaagacagtcgaccagcttagtctaagcgaaatggcggttatcgccgggctacctaaagcgccttctacctttaacccgctctactcgatggatcgggcgatagcgcgccgtaacgtagtgctttcgcgaatgttaagcgagggatatatcactcaggcgcagtacgatcaggcccgtagcgaacctatcgacgcaaattatcacgcgccggaaatcgccttctccgcaccttatctgtcggaaatggtgcgccaggaaatgtataaccgttatggcgaaagcgcctatgaagatggttatcgtatttacacgaccatcacccgcaaagtgcagcaggccgcgcaacaggcggtgcgtaataacgtgctggactatgacatgcgccacggttatcgcggcccggcgaatgtgctatggaaagtgggcgaaacggcgtgggacagtaaaaaaattaccgataccttgaaagcgttgccgacctacggaccgctgcttcccgccgtggtcaccagcgctaatccgcaagaggcgaccgctgcgcttgccgacggtacgtccgtttcgctacatatggaaggaatgcgttgggcgcggccttaccgctcggatacacagcaggggccgacgccgcgtaaagttaccgatgtcgtccagacaggtcagcaaatctgggttcgtcaggtggataacgactggtggctggcgcaggtaccggaagtgaactccgcgctggtttcgcttaacccgcaaacaggcgcggtactggcgctggtcggcggtttcgattttaatcagagtaaatttaaccgcgcgacgcaagctttgcgtcaggtggggtcgaacatcaaaccgttcctctacaccgccgcaatggataaagggctaacgctcgccagtatgctcaacgatgtgccgatttcccgctgggacgccggggcaggttcagactggcgtccgaaaaactccccgccgcagtacgccggaccgattcgtttacgccaggggctggggcagtcgaaaaacgtggtgatggtacgcgccatgcgcgccatgggcgtcgactatgcggcggagtatctgcaacgcttcggcttcccggcgcagaatatcgtgcataccgaatcgctggcgctgggctccgcctccttcacgccgatgcaggttgcgcgcggttatgcggtgatggcgaacggcggtttcctgatcgacccgtatttcatcagcaagattgagaacgatcagggcggcgtgatcttcgaagcgaaaccgaaaatcgcctgcccggagtgcgatatcccggtcatttacggcaatacgcagaaatccgacgtgctgaaaaacaccaatgtggaagaggtcgcggtttcgcaagagcagcaaaacagcgccgtaccgatgcctgaactggaacaggcaaaccaggcgctggtcgcgcaaaacggcacgcaagagtacgcaccgcatgtgattaatacgccgctggcgtttctgatcaaaagcgcgctgaacaccaatatcttcggcgaacccggctggatgggtaccggctggcgtgcggcgcgcgaccttaaacgtcgcgatatcggcggcaaaaccggtacgaccaacagctcgaaagacgcatggttctccggctatggtcctggcgtcgtcacttccgtatggatcggctttgacgatcaccgccgtgatttaggccgcaccaccgcttccggcgcgatcaaagatcaaatctccggctatgagggcggcgcgaagagcgcgcaacctgcatgggacgcctatatgaaagccgtgctggaaggcgtgccggaacagccgctaacgccaccgccgggcatcgtcacggtgaatatcgaccgcagtaccggacaactggcgagcggcggtaacagccgtgaagagtatttcatcgaaggcacgcagccgacacaacaggcggtacacgaggtgggaaccaccattattgataatggtgaaacacaggaactgttctga

SEQ ID NO: 50177 - protein, 858 aa, Salmonella enterica subsp. enterica serovar Paratypi A str. ATCC
MTLNGKSPVKFVKYLLILAVCCILLGAGSIYGLYRYIEPQLPDVATLKDVRLQIPMQVYSADGELIAQYGEKRRIPVTLDQIPPEMINAFIATEDSRFYEHHGIDPVGIFRAASVALFSGHASQGASTITQQLARNFFLSPERTLMRKIKEAFLAIRIEQLLNKNEILELYLNKIYLGYRAYGVGAAAQVYFGKTVDQLSLSEMAVIAGLPKAPSTFNPLYSMDRAIARRNVVLSRMLSEGYITQAQYDQARSEPIDANYHAPEIAFSAPYLSEMVRQEMYNRYGESAYEDGYRIYTTITRKVQQAAQQAVRNNVLDYDMRHGYRGPANVLWKVGETAWDSKKITDTLKALPTYGPLLPAVVTSANPQEATAALADGTSVSLHMEGMRWARPYRSDTQQGPTPRKVTDVVQTGQQIWVRQVDNDWWLAQVPEVNSALVSLNPQTGAVLALVGGFDFNQSKFNRATQALRQVGSNIKPFLYTAAMDKGLTLASMLNDVPISRWDAGAGSDWRPKNSPPQYAGPIRLRQGLGQSKNVVMVRAMRAMGVDYAAEYLQRFGFPAQNIVHTESLALGSASFTPMQVARGYAVMANGGFLIDPYFISKIENDQGGVIFEAKPKIACPECDIPVIYGNTQKSDVLKNTNVEEVAVSQEQQNSAVPMPELEQANQALVAQNGTQEYAPHVINTPLAFLIKSALNTNIFGEPGWMGTGWRAARDLKRRDIGGKTGTTNSSKDAWFSGYGPGVVTSVWIGFDDHRRDLGRTTASGAIKDQISGYEGGAKSAQPAWDAYMKAVLEGVPEQPLTPPPGIVTVNIDRSTGQLASGGNSREEYFIEGTQPTQQAVHEVGTTIIDNGETQELF

SEQ ID NO: 50178 - DNA, 2268 bp, Idiomarina loihiensis L2TR
  CDS (1)..(2268)
gtgataaaaagtcgatggtttcaatacctattctggacaagctttaagatagggctggtacttatcgccgttattgggctttatgccatttatctggatgccagtttatcccgtcattttagtaacaagcgctatcaggcccctgctttggtttacgcggatgaggtaacgctgagaaacaatcatcctatgcggctgcaagggctagtcggcattctggagcgagtcggttatcagcgtaatagtaataccgagcagtcgggttactactcggtgggtaaaaataatgtcatggtgcatcgtcgacctttcgacttttccgatggtccgcaaatggcgcaaagagtgcaaatcaactttcacggcgaccgtattaagtctattaagagctggcccagtggcagagagctggaaagctttcgcctggaacctgagctaataggccgcattagtaccttaagtaaagaagaccgtttgttagttgggctggaagtcgtgcctaacttactcattgaaaccctattaaaagttgaagacagaaatttttatcatcatcagggggtatcgccctggtcaattctaagggcgttggctgccaacctgaaagcaggcaggacggttcagggcggttctacgctgactcagcagttggtcaaaaacctctacctgagccgagaccagacgttatggcgtaagtttcacgaagccatgatgtcgctggttatcgattaccggtttgataaaaacaccatattagagacctacctgaacgaagtgtactttggccaggacggaagcaacgctattcacggtataggacttgccagtcagttttattttggtaagcaggtacaggagctgaacccaagcgaaattgctttaatggtggggatgataaaggggccttcttattatgacccaagacgctacccggagcgtgcccgtagccgcagggacacagtgcttaaagtcatgtttgaacaggatttactcggtaaagataactacgttgctgcggttgaacaggcgcttgacgttaaagaaagccgccgtctggttgagcacccgtaccctcattatatggacttagtacgtcgggaaatgaagcgtattattctgccggaagactggcaggaaactgggctgaaaatcttcacgcatttgcaggtggatgcacaaaatgcagtacaacgctcgttagcacaacagcttatggctgacggcgaagatgagaagttagaaggggcaatggtcgttgctgattaccgcaacggcactattagcgcgctcgctggtggccgcttaagtcaggctataggttataaccgggcgttgttggcactgcggccaataggctcattaatgaagcctattatatacgcagccgcgatgcaggattcagacattggtctgcatacgccggttgcagatgaacccattactttatcggataaaaagggaaaagaatggaagccgcaaaactacgataaagagtttgatggtagtttgctgttgtatgatgcgttggttcagtcgcgcaacttaccggccgttcgggtgggcatggaagtgggtatagaccagttagtgagttacttacgcgaattgggtgtgacaacgccgttacaagcctatccatcgttgactttaggatcagcatcgttgtctcccgtagcggtgacacgaatgtacagtgcgcttatgaatgatggccgttatcagcctttagctgcggtgtcgtctatcaccacccatcagggcgaagtgctgtatcggcgtcagaagtctgaagcagatgtggttttcgataaaaatgtgtcttatctgactcgctatggtttacggggagtggtggctgagggtaccgcaagtcgtctgcaacgtgctttagccggtcaggtagttggtggcaagacaggtacaacgaatgattatcgcgacagctggtttgttgcagtagatggtgagcacgtggttacggtctggttaggtcgtgatgataaccagccggttggcttaaccggaagtagcggcgctctcaaagttgtggcggatttttatgactacttaccgccgttgagcatggctttagatgtaccggagcctctgcagatgcaaaattttcacccgacaacgggacagagaattcctgaagactgcaacaatggtcggaaattaccggctgaggaaatcaggctccccgaggatattacctgtgaaggcactatccgcgagaaaagctggtgggaacgtttatttggtggttaa

SEQ ID NO: 50179 - protein, 755 aa, Idiomarina loihiensis L2TR
MIKSRWFQYLFWTSFKIGLVLIAVIGLYAIYLDASLSRHFSNKRYQAPALVYADEVTLRNNHPMRLQGLVGILERVGYQRNSNTEQSGYYSVGKNNVMVHRRPFDFSDGPQMAQRVQINFHGDRIKSIKSWPSGRELESFRLEPELIGRISTLSKEDRLLVGLEVVPNLLIETLLKVEDRNFYHHQGVSPWSILRALAANLKAGRTVQGGSTLTQQLVKNLYLSRDQTLWRKFHEAMMSLVIDYRFDKNTILETYLNEVYFGQDGSNAIHGIGLASQFYFGKQVQELNPSEIALMVGMIKGPSYYDPRRYPERARSRRDTVLKVMFEQDLLGKDNYVAAVEQALDVKESRRLVEHPYPHYMDLVRREMKRIILPEDWQETGLKIFTHLQVDAQNAVQRSLAQQLMADGEDEKLEGAMVVADYRNGTISALAGGRLSQAIGYNRALLALRPIGSLMKPIIYAAAMQDSDIGLHTPVADEPITLSDKKGKEWKPQNYDKEFDGSLLLYDALVQSRNLPAVRVGMEVGIDQLVSYLRELGVTTPLQAYPSLTLGSASLSPVAVTRMYSALMNDGRYQPLAAVSSITTHQGEVLYRRQKSEADVVFDKNVSYLTRYGLRGVVAEGTASRLQRALAGQVVGGKTGTTNDYRDSWFVAVDGEHVVTVWLGRDDNQPVGLTGSSGALKVVADFYDYLPPLSMALDVPEPLQMQNFHPTTGQRIPEDCNNGRKLPAEEIRLPEDITCEGTIREKSWWERLFGG

SEQ ID NO: 50180 - DNA, 2373 bp, Azoarcus sp. EbN1
  CDS (1)..(2373)
atgcgttgggttttctaccccgttgctgcgctgatcgttttggtcgttctcggcgtcgcaaccctgggggcgatgtctgcactggcctggccgaaccttccgtcgctgcgcgcgctgaccgattaccgccccaagatcccgctcagagtgtacacggcggacggccacattctcggtgaattcggcgaggaacggcgcgcagtcgtgcgcatcgacgccgtcccgatgcaactcaagcaggcaatcctcgcggccgaggacgagcgcttctacgagcatccggggattgacgtgatcggcatcgctcgggcagcgctggcgaacgtggtatcgggcgggcgcggccagggtgcttcgacgatcacgatgcaggtcgcgcgcaactttttcctttcgcgtgaaaagacctacaaccgcaagctgtacgagatcctgctcgcgctgaagatcgagcgcagcctgaccaaggaccagattctcgagctctacatcaaccagatctacctcggacagcgagcctacggcttctcgaccgcgtccaggacgtacttcggcaagtcgctgcaggagctcacgcttcccgagtcggcgatgctcgccgggctgccgaaagcgccttccgcgtataacccgatcgccaacctgcgtcgcgccaccctgcgccagcagtatgtgctgcgccgcatggtcgaagccggccacatcgacaacgagacctatgaaaaggcccgcgacactccgctgcagatcacgactgcgcgctcgacgacgaacccgatgcgcggcgattacgtggccgagatggcccggcagatcgccgtcgagcagttcggcgacgaggcctaccacgccggcatccgcatcatcacgacggtgatgcacgaggatcagctcgcggcgcagcgcgcggtgcgccagggcgtgctcgattacgatcgccgtcgcggctaccgcggccctgaaggcttcgtcgatctcaccgggatcgcagccgacgacgaggagcgcctcgacgagttgctgtcggagttcgaggagtacgacgacctgctcccggcgctggttctcgaagcttcgccgaagcgcgtccgcgtctatcaccacggcgaaacgatcacgatcagcggcaacggactgcgtttcgcggcgccgatgctcaaccagcgcgcgccccagagcaggcggattcgcgcgggcgccgtcgttcgcatccgcgacaacggcgagaaaggctgggaaatcctgcaggtgcccgaagtccaggcggcgctggtgtcgctcgacgcgaacaccggtgcggtccgggcgctgatcggtggcttcgacttcgaccacagcaagttcaaccacgtgacccaggcgctgcgccagccgggctcgagcttcaagccgttcatctattcggcggcgctcgaacgggggttttcgccgagcagtgtcgaagacgacgcgccgctcttcttccccgccggcgtcaccggcagcaaggcctgggaaccgcggaactacgatggcaaatacaacgggccgatgacgctgcgcgacggcctggtgcgctcgaagaacatgatatcgatccgcctgctgcagtcgatcacgccgcactatgcgcaggactacatcacgcgcttcggcttcgacgcgcagcgccatccgccatacctgaccatggctctcggcgcaggcagcgtgacgccctgggaaatggcaggagcctatgcggtgttcgccaatggcggttaccgcatcgatccgtacatcgtgaaggagatcatcgacggcgacggccgcgtagtggcaaaagtcgatcctccggtcgccggcgaaagcgccccgcgcgtcatcgatccgcgcaatgcgtggctgatgaattcgatgctgcaggacgtgatccggcgcggcaccggcacccgcgccctggcgctcaagcgcggcgatctcgccggcaagaccggcaccacgaacgattacgtcgatgcgtggttcaccggctacaaccccgacctcgtcgccgtaagctggatgggctacgaccagccgcgcaatctcggccgaggcgaaaccggcggttccgccgccctgccgatatgggtgaactacatgcggacggcgctcaagggagtcccggaaaaggctctcgcgcggcccgacggactgctcgcgatccagctgcaaggcagcggccgcgaagagtacatctaccgcgagaacctgccgtcccagccgctggaggttccgacgctgcccgtcgggctcttcccgccgaccgaagcgcccgacgaggcagtgccagtgccgctcgcctcgccggtcgaacccatctacgctcccgcgccggtcgtcgaacgcacgccgacgccggtgaagcgctga

SEQ ID NO: 50181 - protein, 790 aa, Azoarcus sp. EbN1
MRWVFYPVAALIVLVVLGVATLGAMSALAWPNLPSLRALTDYRPKIPLRVYTADGHILGEFGEERRAVVRIDAVPMQLKQAILAAEDERFYEHPGIDVIGIARAALANVVSGGRGQGASTITMQVARNFFLSREKTYNRKLYEILLALKIERSLTKDQILELYINQIYLGQRAYGFSTASRTYFGKSLQELTLPESAMLAGLPKAPSAYNPIANLRRATLRQQYVLRRMVEAGHIDNETYEKARDTPLQITTARSTTNPMRGDYVAEMARQIAVEQFGDEAYHAGIRIITTVMHEDQLAAQRAVRQGVLDYDRRRGYRGPEGFVDLTGIAADDEERLDELLSEFEEYDDLLPALVLEASPKRVRVYHHGETITISGNGLRFAAPMLNQRAPQSRRIRAGAVVRIRDNGEKGWEILQVPEVQAALVSLDANTGAVRALIGGFDFDHSKFNHVTQALRQPGSSFKPFIYSAALERGFSPSSVEDDAPLFFPAGVTGSKAWEPRNYDGKYNGPMTLRDGLVRSKNMISIRLLQSITPHYAQDYITRFGFDAQRHPPYLTMALGAGSVTPWEMAGAYAVFANGGYRIDPYIVKEIIDGDGRVVAKVDPPVAGESAPRVIDPRNAWLMNSMLQDVIRRGTGTRALALKRGDLAGKTGTTNDYVDAWFTGYNPDLVAVSWMGYDQPRNLGRGETGGSAALPIWVNYMRTALKGVPEKALARPDGLLAIQLQGSGREEYIYRENLPSQPLEVPTLPVGLFPPTEAPDEAVPVPLASPVEPIYAPAPVVERTPTPVKR

SEQ ID NO: 50182 - DNA, 2109 bp, Zymomonas mobilis subsp. mobilis ZM4
  CDS (1)..(2109)
atgagccgcaaaccttcaaagaaccctcaaaaccgcccccaaagaaaagccttgcgccttgtcttgatcgtcggtggcatattggcgacgattatcttggtcttggctgtgcttttgggaatagctgtttacacaaccaaaagtagcctgcctgattttgacaagctgaaggcttctcccaatggtcaaaccattcgggttcactcgaatgacggcacggttatcgttaatatgggtcccggctatggccgttggattccgtataatgatatcccgaaatccatgacgcaggcgatgatcgcaacagaagaccgtcgtttccgttatcatatcggtgtcgatccggtggggatgatgcgggctgtcggggtggcgattattcaccatggccaaggcaaacgctggcaaggggcatcgaccatcacccagcaattagcccgcaatgtcttcctgaccaataattacagctttgcccgtaaagcgcgggaagccttgctggcattagcgattgagcaaaaattcactaaaaaccagattttagaactttatcttaatcgggtctatttcggtggtggtgcttacggaattgatgcagcttcccgtaaattttacgggcatccggcaacccagctttcacttcccgaagctgctattatcgcaggtttggtcaaggcaccttccaattattcaccaaccgccgatccagaagccgcagttagccgtggacgcgttgttttgggattgatggcagaacagcatctgatcaacccaaccgagcagatcaatgccgatccgcaaaatgttgctttatcggctgaaccgcatcaaaatggtgtgcgctactttacagactgggctttggcacagttggattctctgatcgagcccagcacagaaccgattgacgtctggacaacgcttgatctcggaatgcaaagagccgcagatacaacgattcaagactccaccccgaaaggggcacaaggtgccttggtaacgcttgatagcgatggtgcggttcgagccatggttggtggccgcgattatgtttcttctatctataatcgggcaacacaggcgactcgtcagccaggttcatcctttaaactttttgtttatcttgcggctttggaaagtggggttcgccccgatgaccgtattgttgatgaaccagtgaccatcaacggatggagtccgagaaacgcttcccgtcatttttcgggtgatatcagcattagaacagcttttgccttttctttgaatacgattgccgccaaacttggcagtcaggtcggctttaacacggtcgccaccatggctaaaagattaggcatcacaacaccgattgatgttgtgccttcaatggtgctgggaacttccgatgtccgtttgattgatatgacccgcgcttttgctgtcgttgccagaaaaggtattgcggttaccccttatggtatcagccgtatcacgaccagctatggcaaattgttgtatcagcatcctgataacagcgatcaggtcttattagccccttgggttgcagcggaaatgactgatttgctgcaaacggcagttgccaccggaaccgcacgcgctgcccagataggtcgccctgttgccggtaaaaccggaacgacttcatctagtcatgatggctggttcatcggtttctctagtggtctgacaacaggcgtctggatggggcgcgatgattctaaacctgtgccggggttatccggcggtcatgctccggccatggcgttctcgaaatatatgcgtgtcgctgtggctgatcggcctgttgtgccttttgacacacaggtaactttgccagattctcaggttgaaccggatgacgaaacctatttcggtgatgctgcggctattcatccggcgacttccggtcttccggcggatacccccgcgcctactctgccaccagcggtgacagaaaaacacgcaggggatgcggatgacaaccgttccaagggcaatgaaaaacccgcgataaagccggattctggtaaagaaaaatcaacaggacatgccgatccagccttagataaaaactggctcgataatgttctcggccataatcctgagggttaa

SEQ ID NO: 50183 - protein, 702 aa, Zymomonas mobilis subsp. mobilis ZM4
MSRKPSKNPQNRPQRKALRLVLIVGGILATIILVLAVLLGIAVYTTKSSLPDFDKLKASPNGQTIRVHSNDGTVIVNMGPGYGRWIPYNDIPKSMTQAMIATEDRRFRYHIGVDPVGMMRAVGVAIIHHGQGKRWQGASTITQQLARNVFLTNNYSFARKAREALLALAIEQKFTKNQILELYLNRVYFGGGAYGIDAASRKFYGHPATQLSLPEAAIIAGLVKAPSNYSPTADPEAAVSRGRVVLGLMAEQHLINPTEQINADPQNVALSAEPHQNGVRYFTDWALAQLDSLIEPSTEPIDVWTTLDLGMQRAADTTIQDSTPKGAQGALVTLDSDGAVRAMVGGRDYVSSIYNRATQATRQPGSSFKLFVYLAALESGVRPDDRIVDEPVTINGWSPRNASRHFSGDISIRTAFAFSLNTIAAKLGSQVGFNTVATMAKRLGITTPIDVVPSMVLGTSDVRLIDMTRAFAVVARKGIAVTPYGISRITTSYGKLLYQHPDNSDQVLLAPWVAAEMTDLLQTAVATGTARAAQIGRPVAGKTGTTSSSHDGWFIGFSSGLTTGVWMGRDDSKPVPGLSGGHAPAMAFSKYMRVAVADRPVVPFDTQVTLPDSQVEPDDETYFGDAAAIHPATSGLPADTPAPTLPPAVTEKHAGDADDNRSKGNEKPAIKPDSGKEKSTGHADPALDKNWLDNVLGHNPEG

SEQ ID NO: 50184 - DNA, 2367 bp, Silicibacter pomeroyi DSS-3
  CDS (1)..(2367)
gtgtttgcacttgcagaaagacagcgtcagaggcgttttcggaacgaaatcccggcaaactcggccccggaatcgcgcaaagttgcacattttttgcacatcgacgtgcggttgcctaaaaatgcatcggcgattaaagggaaagatcgggaaaaacacacctcaacagtatcgcccgcccgcgctatggtgcggcaaaggcaaagaccgggcagagtgggcatgacggattccaagcgtcgcaaatcgcagcttgtcgcggacaagcgatacccgaccaagggcaaaccggccgccgccggcgccaagcgcaaacctgcgcccaagcgcaaggcgcccgcgcccaagcggcccaggcgcggtggtccgctgggttggctctcgcggttcttcggctggatcttcggcctgatctggggatttgcctggcggatcgggatgatcgttgcgctgctggtggggctggcggttgcgctggtctattcgaccctgcccgatgtcaccgcgttgctggacggacgggcgcgcggctcggtcaccttgttggaccgcgagggcgatgtctttgcctggcgcggcgaccagttcggcggtgtgatcaccaccgacaccgtttcgccgcatctcaagaatgcagtcgtcgcgaccgaggacaagcggttctattaccatgtcggcctcagcccgcgcggcatcgccagcgcggtgcgcatcaacctgcgcgaggggcgtgggccgctgtcggggcacggcggctcgaccatcacccagcagaccgcgaaacttctgtgcctcggggtgcctttcgaccccgaagaatggaaatccgaagcggcatacgaggccgactgccgccgcggttcgctgtggcgcaaggtcaaggaggcggtctattcgctggcgatggaggccaagtacagcaaggacgagatcctcaatatctatctgaaccgcgcctttctgggcgctggcgcccggggattcgaggctgccagccagcgttatttcggcaagtcctcggcccaggtggacccggcagaggccgcgatgctggccgggcttttggtggcgccgacccgatacgcgcccaccaacagcctgaaacgctcgcaggaaagggcgcgcgtcgttgtggcgctgatggaggagcagggatacctgaccgccgcccaggccgatggcgcccgcgccaacccggcccgcctgtccgaagccgccgccgcccaggcggggggatatttcgccgattgggtgatgagcgagctgcccgactatttcggcggcaacaccaccgaagacgtgatcatccgcaccacgcttgatcagcgcatccagacctcggccgaagaggcgatgcgctttgtgttccaggaaaaggtgcgcgacgggtccaaggcgcaggccgcgatcgtggtgatgtcggccgatggcgcggtgcgtgccatggtcgggggtcgcgacacaaaggtcaccggcgcgttcaaccgcgccacccaggcggcgcgtcagaccgggtcgtcgttcaagccctttgtctatgccacggcgctggagctgggtcactcaccgctcgataccgtggtggacgagccttattgcatcaatatcgcgggctcggggcaatggtgccccaagaactataccaacaagcattatggccgggtgaccctggcacaggcgctgaaggattcgctgaacgtgccggcggtcaaggtggccgaggcgatggggctggacaatgtgcgcagggtggccagcgatttcggcatcgatagcgatctggcggcgggtccggcgctggcgctgggcgcctcggaaagctcgctgatcgagatgaccggcgcctatgccggtatcctgaacggcggttcttcggtcgaaccctacggtctgaccgaactgcacttgcagggcgagaacgaggtgttgatggcgaccggaaccggcatcggcgagcgggtgatcaacaaggacgccgccgcgcagctgatctggatgatggagaaggtgatctccgaaggctcgggccgtcgcgccgcgctgccggggcgccccgccgcgggcaagaccggcaccacccaggcggcgcgcgatgcctggttcatcggcttcaccgcagactacgtgaccggcgtgtggatgggatatgacgacaacacaccgctcaagggggtgaccggcggcggattgccggccgaaatctggcacgagaccatgatccgcgtgcacgaaggcacccctgtgaacccgctgccaatgcaggcaccgcgccagcccaagccgatcgcccagcccaagccacaacaacccaagggcgggttggggcaggcggtggatcagttgttgcgggatctgttcgggaactga

SEQ ID NO: 50185 - protein, 788 aa, Silicibacter pomeroyi DSS-3
MFALAERQRQRRFRNEIPANSAPESRKVAHFLHIDVRLPKNASAIKGKDREKHTSTVSPARAMVRQRQRPGRVGMTDSKRRKSQLVADKRYPTKGKPAAAGAKRKPAPKRKAPAPKRPRRGGPLGWLSRFFGWIFGLIWGFAWRIGMIVALLVGLAVALVYSTLPDVTALLDGRARGSVTLLDREGDVFAWRGDQFGGVITTDTVSPHLKNAVVATEDKRFYYHVGLSPRGIASAVRINLREGRGPLSGHGGSTITQQTAKLLCLGVPFDPEEWKSEAAYEADCRRGSLWRKVKEAVYSLAMEAKYSKDEILNIYLNRAFLGAGARGFEAASQRYFGKSSAQVDPAEAAMLAGLLVAPTRYAPTNSLKRSQERARVVVALMEEQGYLTAAQADGARANPARLSEAAAAQAGGYFADWVMSELPDYFGGNTTEDVIIRTTLDQRIQTSAEEAMRFVFQEKVRDGSKAQAAIVVMSADGAVRAMVGGRDTKVTGAFNRATQAARQTGSSFKPFVYATALELGHSPLDTVVDEPYCINIAGSGQWCPKNYTNKHYGRVTLAQALKDSLNVPAVKVAEAMGLDNVRRVASDFGIDSDLAAGPALALGASESSLIEMTGAYAGILNGGSSVEPYGLTELHLQGENEVLMATGTGIGERVINKDAAAQLIWMMEKVISEGSGRRAALPGRPAAGKTGTTQAARDAWFIGFTADYVTGVWMGYDDNTPLKGVTGGGLPAEIWHETMIRVHEGTPVNPLPMQAPRQPKPIAQPKPQQPKGGLGQAVDQLLRDLFGN

SEQ ID NO: 50186 - DNA, 2034 bp, Synechococcus elongatus PCC 6301
  CDS (1)..(2034)
gtgcccttcaagcagattcccctgcgtctacgtcaggctttcctcgcggctgaggatcggcgcttctacgaacatagcggtatcgatctgttcgggattgcccgcgccagcgtcacaaacctgctcagcggtcaggtgcaggagggtgctagtaccatcacccagcagctggcccgcattgtttttctcagccaagagcgcagtctgcaacgcaagctcaacgaagcgctgatggcgcaaaagctagagcaagagttgaccaaggaccaaatccttgagcagtatctcaatttggtctatctcggggcaggggcctacggggttgctgatgctgcttggacttacttcagcaagccagtccaagacctcagcctaggagaaatggcaacgctggcggggctaccccccgcgcccacagcctactcgcctttggtctccttggaagtggctcaagagcggcgtaatagtgtgctgagccgcatgcaagaggtgggcttcatcaccccatctgaggcagaagctgctcgccgcgaaccccttgcgctcaagcctgcagcaccgaaatatgctcaaagtctggcgccctactttaccgactacgttcgccaggaactgccacgctttgttgcgccggatgtcttggagtacggcggcctgacgctcaagacgaccttgaactatcgctggcaacaagcggcggaccaggctatccaaaactcgacctacggcagtttgcagggggctctcgtcagtatcgatcctcgcgatggggcaattcgggcgatggtgggcggggtggatttcaatcgcagccagttcaaccgcgcgacccaggcctatcgtcagccgggttccactttcaagatgtttgtctatgcggcggcgatcgcttcaggaatgtcgccctcccaggtctacttggatgccgcgatcaatttggggggctataaaccgcaaaactttagccgtagctttagtggctcgatcagtctgacccaagcgttgactaattccgtcaatattgtcgcgatcaaggtgctgcgggatgttggcattgacaatgtcattcgggtggcccgccaaatgggaattcgggcggacttggcgcgctactatcccttggcattaggagcctcagacgtcacgctgctggagatcaccagtgcttacggcactctggccaatcaggggaaatatctgacaccccacccgatcgctgaaatcatcgatcatcgcggtcgagtcctctaccaagacaaacagatcaagccagtgcaagccctcgatcctgggtctgctgcgatcgtgacatccatgctggagcgcgttgtcacctctggaacgggggctgctgcttacctgcccgatcgcgcagtggcagggaaaacgggcacgaccgaacaagctcgcgacctctggtttattggctacatcccgcagttggtgaccggggtttggctgggctacgacaactttgccccgactggcagtgggagtagtgcagctgcggtggcttggtatcgctttatggtcgaggccattaaagacctgccccccgaaaaatttccgccgctgccgaaccccgatcaacggaaaccgctctttaaagctcagttcacaagtggcagtgacctaggggggatcgatcgtggacccggccgctatgactacggcgctggcattgagttggcggactcccccagttttgctggcagtctgcccgccgcaccagcctccaatgctggctcgagccgttcccgcgatcccgaaccggaatatagcagtgagccggcggcggaagaaccccgctacgaagatgctccccctgaggcaccggtgaatcttttgagccgggacccagtgccgtcgaagcagaacccgctcccccagcacccgttgaaccgcaggcaccggtgccccctccacctgaacccactgcaccacccctccccgtggagcctacggcacctcagcctcaggccccctagcttttattgccagcctattgcgaccgccaagaccaccagcgattga

SEQ ID NO: 50187 - protein, 677 aa, Synechococcus elongatus PCC 6301
MPFKQIPLRLRQAFLAAEDRRFYEHSGIDLFGIARASVTNLLSGQVQEGASTITQQLARIVFLSQERSLQRKLNEALMAQKLEQELTKDQILEQYLNLVYLGAGAYGVADAAWTYFSKPVQDLSLGEMATLAGLPPAPTAYSPLVSLEVAQERRNSVLSRMQEVGFITPSEAEAARREPLALKPAAPKYAQSLAPYFTDYVRQELPRFVAPDVLEYGGLTLKTTLNYRWQQAADQAIQNSTYGSLQGALVSIDPRDGAIRAMVGGVDFNRSQFNRATQAYRQPGSTFKMFVYAAAIASGMSPSQVYLDAAINLGGYKPQNFSRSFSGSISLTQALTNSVNIVAIKVLRDVGIDNVIRVARQMGIRADLARYYPLALGASDVTLLEITSAYGTLANQGKYLTPHPIAEIIDHRGRVLYQDKQIKPVQALDPGSAAIVTSMLERVVTSGTGAAAYLPDRAVAGKTGTTEQARDLWFIGYIPQLVTGVWLGYDNFAPTGSGSSAAAVAWYRFMVEAIKDLPPEKFPPLPNPDQRKPLFKAQFTSGSDLGGIDRGPGRYDYGAGIELADSPSFAGSLPAAPASNAGSSRSRDPEPEYSSEPAAEEPRYEDAPPEAPVNLLSRDPVPSKQNPLPQHPLNRRHRCPLHLNPLHHPSPWSLRHLSLRPPSFYCQPIATAKTTSD

SEQ ID NO: 50188 - DNA, 1878 bp, Synechococcus elongatus PCC 6301
  CDS (1)..(1878)
atgagcagcctgacaacaccacaattaccccgaccgcgatcgcggcgaaaatggccgctgcgccttgtctatggcagcagtgcgatcgcgatcggggctgtactgggactagccctcagctttcggaacttgcctgacgtacggctgctgcggcgctacgtgcccagccagaccacctacatctacgacatcaacggtgagttgatcgctgcgctccacgacgaagccaatcgggagacagtcccactcaaccaaatttcgccgaagttgcagcagtcggttctcgcgatcgaagacagtaatttctatgaccatcccggcattaacccgatcggcattggccgcgcgatcgtcgccaactttagttctgggggcgtggtcgagggcggttcaaccttaaccatgcagttggtcaaaaacctgtttctaacgcccgatcgcaactttggccgcaagctcagtgaagcggtattagcgctgcgcctcgagcaagtcatcagcaaagaccggatcctggaactctatctcaaccaggtttactgggggcgcaacctttacggggtggagatggcatcccgcagctatttcaataagtctgccgccaacttggattgggcagaggcgagcttcttagccggtttgattgcggctccagagttctacaccccctttgatgagcgcgatcgcctcagtccccagcgactcgaacgggccaaagagcgacaacggctggtgttgcagcgactggttgagatcggccagctcagccccagtgccgctagtgctgcagctgctgaacccctgaaatttggtgaaatcagctcttttcgaccgagcagcgctccctacgtcagcgatgcagtgattcaggaactcgcccaacagtttggccgcagtgcagtggttcaaggaggcctgcgtgtccaaaccacgatcgacctgcggatgcagcgactggccgaaaaggtcattcaggaaaactatcagcgcaatcgccgtgcaggcttacgggctgacgaaatggctcttgtcgcgatcgatccacgtacccacttcatcaaagccatggtgggtggcgtggactaccgcaccagtcagtacaaccgtgtgacccaagcgcgtcgtcagcccggttctgcctttaagccttttgtcttctacgcagccctcgccacaggcaaatataggcccaatagctcgatcgcagatacccctgtcacctatcagctaggggcagaaacctattcccctcagaactacgatcgcagttttgccggcaacatgagtctgaccagtgctctggcgcagtcccgcaatattcccgctgtgcgcctcggtcaaacagtcggccttgatcgcgtcatcgaaatttgtcgccgtattggcattagtagcccgatgcagccagtcgtctctctgcccctcggggcgatcggggtcacgccgctagaactgacgaacgcttatgcaacgctggctagcgggggttggtacgcgccaccgaccctcatcctgcaagtgcgcgatagccaaggtcgacgcttactggaccatacgcctcggcctcagccagaactgcagtcgaaggcagtggcccagctcaatcagatgatgcaggccgtggtcactagcggtacgggcagagcggctcagttcaatcgccccgtggctggcaaaactggcacaacatctgatgaacgggatatctggtttgtgggctacaccccagatcttgcggcttctgtttggttgggcaacgatgacaacagcaaaattgggggcggggcaaccggcggcgcgatcgccgcaccgatttggcgagaatttatgcaacaagccctcgcccaacagccagttgagtcgtttccaaagccctaa

SEQ ID NO: 50189 - protein, 625 aa, Synechococcus elongatus PCC 6301
MSSLTTPQLPRPRSRRKWPLRLVYGSSAIAIGAVLGLALSFRNLPDVRLLRRYVPSQTTYIYDINGELIAALHDEANRETVPLNQISPKLQQSVLAIEDSNFYDHPGINPIGIGRAIVANFSSGGVVEGGSTLTMQLVKNLFLTPDRNFGRKLSEAVLALRLEQVISKDRILELYLNQVYWGRNLYGVEMASRSYFNKSAANLDWAEASFLAGLIAAPEFYTPFDERDRLSPQRLERAKERQRLVLQRLVEIGQLSPSAASAAAAEPLKFGEISSFRPSSAPYVSDAVIQELAQQFGRSAVVQGGLRVQTTIDLRMQRLAEKVIQENYQRNRRAGLRADEMALVAIDPRTHFIKAMVGGVDYRTSQYNRVTQARRQPGSAFKPFVFYAALATGKYRPNSSIADTPVTYQLGAETYSPQNYDRSFAGNMSLTSALAQSRNIPAVRLGQTVGLDRVIEICRRIGISSPMQPVVSLPLGAIGVTPLELTNAYATLASGGWYAPPTLILQVRDSQGRRLLDHTPRPQPELQSKAVAQLNQMMQAVVTSGTGRAAQFNRPVAGKTGTTSDERDIWFVGYTPDLAASVWLGNDDNSKIGGGATGGAIAAPIWREFMQQALAQQPVESFPKP

SEQ ID NO: 50190 - DNA, 1845 bp, Bacillus clausii KSM-K16
  CDS (1)..(1845)
atgaaaacagggacaggctggatattaattgcggttttagccttatcgaccgtttttttattttccaacgtaacggcagaaatcacaaacgtacaatcagtaagacaaatagtcaatgagcacattgaccgcgacgccctctacttgtcttcaaacagtacaattgttgatgccaatggccgaacgtttgcggaactaaataacggaacgaaccgagtttacttgccttatagcgatattccagaaacagtcattcatgcttttatcgccactgaagacaagcgtttttttgagcaccacggcttcgatgccacaggcattgccagagcttttcttgcaaatgcaagcgaaggcggcattgaccaaggggcaagcaccattacccagcaaatggtacgcaatatctttttagaccattcccgtacatatgagcgaaaagtgagtgaactgctttatgcctatgagctggaacaacagtattctaaggaagaaattcttgagctttatttaaattccatttacttcggcaacggcgcttatggcgttgaggcagcggctcagctttatttcagcgaaacaacgaaccagttgtcccttgcgcaaatcgcgtttttgacagccattccgaataatccaacttattatgatccttttaaagacgaagccgcacatacccatgaacgaaaagaatgggtcttgcaaaagatggaagaggaagggttcattacgtctgctgagcataacgaagcattggaagaatcgatcgtcttacatcgttcccagcttaaaaacgaatttcctgattacagcgattttatcttagctgaatttaaaatgcttatccgccaactagagaatatggaggaagcgccaagcgaggaagtcgaagcgcgcgttaacgaactgctgaaacaaggggtaacgattgaaacagcgcttgatccagaccggcaacagcggctagtcgacagcgtggttcgagaattgcctgacaacgcacaaggagctgcgatggtgatcgataatgataaacgtacgattgtcgcgattagtaacggaagaggctacgaacggggcaacctcatgtacgcgacacagtcgtttcgccaccatgggtccgcttttaaaccattgatcgactatgtgccttatttagaagaaacaggtgctccgctaaccgcaacttttaacggcaatccatcgcctaactgtgctcaaaacagcagcaaacaaacagttggctgtgtgaataactacaatcatgctatgcctggcgttgtcacaatgcgagaagcattcaaacattcctacaatgtcccggcggaatacatgctggcgcaagtcggcgtcgaaaaagcgttatcttacttagagcctttttcttttagcaaacttaatgacgaggaacgcggcctcgctcttgccttaggcaccgttgatgtctccgtttatgaaatggcccaagcctattccacttttgcacacgacggcaaatttgctccagcacatggcatcgttcgcgttgttgatgaacacggggaaacgctctatcaatgggacgatgtgaaagaagtgcttgtctggtcaaaggaaacgaatgacaaaatgcggacgttgttggcggatgtaatcgcctcagggacaggcaaaggaattacgttggggcaaaatggctacatcggcggaaagacaggaacgagcagtcaataccgcgaccttgccttttctggactaaccgacaaatacacggcttcggtatgggtaggaagggatgaaggttccgtggaagacttgtcgccaagacgaccagcaatgaatatttgggaaacggccgtacgcgagtag

SEQ ID NO: 50191 - protein, 614 aa, Bacillus clausii KSM-K16
MKTGTGWILIAVLALSTVFLFSNVTAEITNVQSVRQIVNEHIDRDALYLSSNSTIVDANGRTFAELNNGTNRVYLPYSDIPETVIHAFIATEDKRFFEHHGFDATGIARAFLANASEGGIDQGASTITQQMVRNIFLDHSRTYERKVSELLYAYELEQQYSKEEILELYLNSIYFGNGAYGVEAAAQLYFSETTNQLSLAQIAFLTAIPNNPTYYDPFKDEAAHTHERKEWVLQKMEEEGFITSAEHNEALEESIVLHRSQLKNEFPDYSDFILAEFKMLIRQLENMEEAPSEEVEARVNELLKQGVTIETALDPDRQQRLVDSVVRELPDNAQGAAMVIDNDKRTIVAISNGRGYERGNLMYATQSFRHHGSAFKPLIDYVPYLEETGAPLTATFNGNPSPNCAQNSSKQTVGCVNNYNHAMPGVVTMREAFKHSYNVPAEYMLAQVGVEKALSYLEPFSFSKLNDEERGLALALGTVDVSVYEMAQAYSTFAHDGKFAPAHGIVRVVDEHGETLYQWDDVKEVLVWSKETNDKMRTLLADVIASGTGKGITLGQNGYIGGKTGTSSQYRDLAFSGLTDKYTASVWVGRDEGSVEDLSPRRPAMNIWETAVRE

SEQ ID NO: 50192 - DNA, 2148 bp, Bacillus clausii KSM-K16
  CDS (1)..(2148)
atggtcaaaaaactcgcactagcggctggcatcgtagcagcaatgatggtgctttcctttttaatctttgccgtcgccatattggcgggcacgtaccaaatcgatgaagaaaagctaatgatgaataattcaagtgtaatcgttgataccgacggcaacgtcatcacgaacttatatatggaaaatcgtgaagtgattccaattgaacaagtccctgaacttgttcaacaagcatttgtcgcaatggaagattcccgcttttatgaacaccagggcattgattttaaagcgattggccgtgccctttaccgtgatattctagcaggtgccaaagtagaggggggcagcacccttacacagcaacttgctaaaaatttgtttctctccaacgaaaaagcatggctacggaaaacaaatgaagtgcttatcgcgatgaatttagagcggcgttacagcaaaagcgagatattggaaaagtacttaaatcaagtttattttggccacggcgcttatgggattgaagcagctgcccatttgtattttaacaagccagcttcagaattaaccatttatgaaggagcctcccttgtagctgtcgtgaatgcaccaagcgcattttcgccaattgatgaaccggagcgcaacaaagagagacgtgatttagtgctaaaggtgatggcgcaacaagggtatttaagcactgaggaagctgaggaagcgcagagccaaccgctggaaaccgacagacaagagcaaacggtggatgagtcgttgtatacgtacattgatatggtcatggatgaagcgagtgagcgattcaacattagccatgaagagctgctaactggcgggtaccggattgtggttccaatgaacttggagttgcaaaagaaaacatatgaggcgctgcaaaacgatcgtttcttcccagaagaaaacaaagacgcccaaagcgctatgatgtttatggactcagaaacaggcggcattctcgctgtccaagggggccgtgattatgtgcggcgcggcttaaaccgcgtgaatgtaaggcgggcgcctgcttcaacatttaagccgttagcggtgtttgctccggcattagaaagtggcatatatcagccttattcgttgctgcgcgatgaattgcttcagtacgatgacggctatacacctaaaaatgtaaatggcgaatatagtggcgaaatgacgatgtatgaagcactgaccacatcctccaacgctccagcagtatggcttttaaatgaaatcggcattcaggagtctgtgtcaacgctcaaaaagttcggctttcacttgcctgataggcagctctccttggcactcggaggcttgcgagaaggggtaactccttatgagatggtacgtgcttaccgagcatttgcccatgaaggacaaattattgaacctcatgtgattagagacatctatgacagcaatgacaaacgtatcggcggtgctaagcctgttgaaacacaagtcattagtgcccaaacagcatggtcgatgacaagaatgctggaaaatgtcatggctgctggcacaggtgcaagtggacctgcaactacgtctgcggttgcgggtaaaacaggaacgcaaggatacgaggcagttgccggggcaaacagcgatgtgtggtttgttggctatacgccaaaagtggttggtgccgtttggatggggtatgatcaaacaaacgaaagccaatacttcgccgggggaagtggctatccgacacggttgttcaaagaaatggtcaactcctttcctgcttcattgcaggcaacggcgttcgaacagcctgaaggtactgctgatttagcttctccgctagcaatggaaaagattgaaggtttcacggcccaatacacaattggcggcaaaggtttaataagtgttcagttagaatgggacgcggttgaagatgagcgtattgcctttaatgtgtatgaagtcgacggtgattccaagaaacaagttgcttccaaattaacagaacctcattttacgattggaaaaatgaatccattctctttgccgaaataccaagtggtcacctatgacctagaaacggataccgaaggggctgcttctgaagcgctcgaaccttcgttttcattttcattctaa

SEQ ID NO: 50193 - protein, 715 aa, Bacillus clausii KSM-K16
MVKKLALAAGIVAAMMVLSFLIFAVAILAGTYQIDEEKLMMNNSSVIVDTDGNVITNLYMENREVIPIEQVPELVQQAFVAMEDSRFYEHQGIDFKAIGRALYRDILAGAKVEGGSTLTQQLAKNLFLSNEKAWLRKTNEVLIAMNLERRYSKSEILEKYLNQVYFGHGAYGIEAAAHLYFNKPASELTIYEGASLVAVVNAPSAFSPIDEPERNKERRDLVLKVMAQQGYLSTEEAEEAQSQPLETDRQEQTVDESLYTYIDMVMDEASERFNISHEELLTGGYRIVVPMNLELQKKTYEALQNDRFFPEENKDAQSAMMFMDSETGGILAVQGGRDYVRRGLNRVNVRRAPASTFKPLAVFAPALESGIYQPYSLLRDELLQYDDGYTPKNVNGEYSGEMTMYEALTTSSNAPAVWLLNEIGIQESVSTLKKFGFHLPDRQLSLALGGLREGVTPYEMVRAYRAFAHEGQIIEPHVIRDIYDSNDKRIGGAKPVETQVISAQTAWSMTRMLENVMAAGTGASGPATTSAVAGKTGTQGYEAVAGANSDVWFVGYTPKVVGAVWMGYDQTNESQYFAGGSGYPTRLFKEMVNSFPASLQATAFEQPEGTADLASPLAMEKIEGFTAQYTIGGKGLISVQLEWDAVEDERIAFNVYEVDGDSKKQVASKLTEPHFTIGKMNPFSLPKYQVVTYDLETDTEGAASEALEPSFSFSF

SEQ ID NO: 50194 - DNA, 2808 bp, Bacillus clausii KSM-K16
  CDS (1)..(2808)
atgtcagatgagtataaatcaaggcaggagcgcaaaaaagcccaaaatcgcagcaaaaatggcacaacgccaaaaaatggtgggaagaaacgaagcgtatggaaaaaaatctttaccacgatggcgattttaattggcttagcaattattggcggcgggattaccgttgcctctattgtagctggggcacctgatattgacgaagagcgcttgacgctgccacaatcattgcagatttttgatatgaatgatgagcaagtttatacgctagcctctggggaaaagcggataaatgccaatattgacgaaatgcctgaccatttaaaaaatgcctttattgctgtagaagaccaccgcttctatgaccattttggagtcgatttgaggcgcctcggcggggccgttgtggccaatttccgcgaagggtttggcgctgaaggcgcatcaacgattacccagcaactagttaaaaatttatttttgtctaatgaaaaagcattaacgagaaaaatccaagaacagtatttggccattcagctggagcgccgttatacgaaagatgaaatcttggaaatgtacttaaaccaaatcaaccttgggccatcggctggttacggcgtacaattagcagcagaaaaatatttcaacaaagaagacttaaacgatttgaccgttgccgatgcagccgtgcttgcagccattccacagcggccaagctactttgatccacaccgaaatccggagaacaatgaaaagcggcgcaatgtcgtcattgatcggatggaacgggaaggctttatcacagctgaagaagctgaagaagcacgcaatacaccgattgaagagcaactggattatgtagaaagcgaaaacagcgactatttaacgttttacgatgaagtgttaaccgaactggaagaaatgagcgacttgtcgacaaatgacatttacaattcaggcttaaaagtctacacaacacttgatatggatgcgcaagaacatgtcgaccatgtcatgaaatcgggagaatatgccgatctcgtcttcccagaaagcgaagatttccgtgctggcgtcacgctgcttgaaacgcaaacaggtgcgattcgcgcaatgggaaatggcattgacgaaaacgatccccgtgtcgaaaactatgcgactatccgtagacagcaagggtcggcgatgaaaccgctgctctcttacgcacctggtattaacgatcaacaatggtcaacagctaaaatctttgttgatgaagagtacacttatcaatctgatgccagcaaagagattcgcaactatgaccggacgtataaagggccgatgacgatgcggcaagcattggcagaatcacgaaatgtccctgctgtaaaagccatcaatgaagaaggcgtcgacaatgcctttgccttccttgataaaatgtttgtcgtaaatgaaaatgaccgttatgaatcagcggcactcggtggtgctgaagtttctacaaaagaaatggccggcgcgtatgccgcttttggaaacaacggcgaataccatgaaccatatacaattcgcaaaatcgtgtttccagacggccgggaactcaatacagagcctgaaccaacgcaagtgatggaagactatactggctacatgattactgatatgttaaaaacggtcgtcactgccggaacaggcaaagaagcccaaattcctggcgtgccaatcgccggaaaaacaggaacaacgaactatgtacctgaaacgatgcagaagtacaacatcccttctgggggattcccggcttcttcctttacaggctatagcaccaactatactgcctctgtgtggattggattttcgcaaaatggagaaggcaactacttgacgagcgcccatagcaaaacggcgcaaagaatgtttaaacacattatgacggaagtccatcaaggcatcgatacgcctgattttgtgaagcccgattcggttgtagagatgcgtgtcgaacgcagcaccggcaagctgcctagtgcagggacgccaagcagtgaaattgtcacagagctatttgtcaaaggcactggtcctacagaagtatcgcaggaatttgctagtatttctgacccaaccaacgtcagctactcgtatgacgaagaatcgaacagtgtgacattctcttggtcttatcctgccgatgaagttgatgacgtcaagttctccacttctgtcagcagcggttcccttaatgtagatgaaggcagcatggaagctgtcttaacgggagtcacaccaggtgaatcttatacctttacagtccgagcccaggcaacggacggaacaggtctacgaagtgcggctgtttcagtaacagcaacaattccaggtgggaccgaagaagaggaagaggaagaagaaccagaagaagaggaagagccagaagaagaggaagaagagccaaacgatggcgaggaaacaccgcctgatgaagatgaaggcaacgatgatgaaaacaacaatggcgagaacgatggttcagactctgattcagacacaggttcagatacagaccctgcggatggcggcaatgacaacgatgatggcaacggagacggaacagacaatggcggtaatgacggttctaaccctggttccgataatggaaacaatgataatgggaacagcggggggaacggcaatgacaatacgaatggtggcgggaacggcaacaataataacggaaacgaaacgccgcctaatgagccagacaattcatccgatggaagttcatcgactcaaagcgacagcagttctgaggaataa

SEQ ID NO: 50195 - protein, 935 aa, Bacillus clausii KSM-K16
MSDEYKSRQERKKAQNRSKNGTTPKNGGKKRSVWKKIFTTMAILIGLAIIGGGITVASIVAGAPDIDEERLTLPQSLQIFDMNDEQVYTLASGEKRINANIDEMPDHLKNAFIAVEDHRFYDHFGVDLRRLGGAVVANFREGFGAEGASTITQQLVKNLFLSNEKALTRKIQEQYLAIQLERRYTKDEILEMYLNQINLGPSAGYGVQLAAEKYFNKEDLNDLTVADAAVLAAIPQRPSYFDPHRNPENNEKRRNVVIDRMEREGFITAEEAEEARNTPIEEQLDYVESENSDYLTFYDEVLTELEEMSDLSTNDIYNSGLKVYTTLDMDAQEHVDHVMKSGEYADLVFPESEDFRAGVTLLETQTGAIRAMGNGIDENDPRVENYATIRRQQGSAMKPLLSYAPGINDQQWSTAKIFVDEEYTYQSDASKEIRNYDRTYKGPMTMRQALAESRNVPAVKAINEEGVDNAFAFLDKMFVVNENDRYESAALGGAEVSTKEMAGAYAAFGNNGEYHEPYTIRKIVFPDGRELNTEPEPTQVMEDYTGYMITDMLKTVVTAGTGKEAQIPGVPIAGKTGTTNYVPETMQKYNIPSGGFPASSFTGYSTNYTASVWIGFSQNGEGNYLTSAHSKTAQRMFKHIMTEVHQGIDTPDFVKPDSVVEMRVERSTGKLPSAGTPSSEIVTELFVKGTGPTEVSQEFASISDPTNVSYSYDEESNSVTFSWSYPADEVDDVKFSTSVSSGSLNVDEGSMEAVLTGVTPGESYTFTVRAQATDGTGLRSAAVSVTATIPGGTEEEEEEEEPEEEEEPEEEEEEPNDGEETPPDEDEGNDDENNNGENDGSDSDSDTGSDTDPADGGNDNDDGNGDGTDNGGNDGSNPGSDNGNNDNGNSGGNGNDNTNGGGNGNNNNGNETPPNEPDNSSDGSSSTQSDSSSEE

SEQ ID NO: 50196 - DNA, 2322 bp, Bacillus clausii KSM-K16
  CDS (1)..(2322)
atgaagcactttctttcgaagtggaagaacaactgggatgcctttatagcaaagctagatgacattcagttcttccggaaagtcggcattacataccaagtattatggaatttattccttattgtattcattattggctttttaggatttatgttcgctagcggaaccgccgcaggttactttgcttccctcgtagtcgatgaaaaaacatattcagaagaagacatgcgcacattcgtaggctcgctctcaaaaacaagcgacatttaccttgctggcggcgtttacttaggaaaaatccgcagtgaagtagaccgggaaattgtctcccttgatgacgtggccgatgaagtaaaatgggcgatcattgctacagaagacgaacatttttacgagcataatggcatcgtcccaaaagcgttgctacgggcaacgatgcaagagctgactagttcgtctgttcagacaggcggcagcacattgacacaacaattaataaagcaacaaattttatccgatgaagtatcgttcgaccgcaaagcaacagaaattatgctcgcgcttaggctcgaacagtttatgacaaaagatgaaatattggaagcctacttaaacgtcgttccgtttggccggaatgcctcgggccgaaatgttgctggcattgaagcggcagcacaaggggtctttggtgtttcggcaagcgagttaaacttgccacaagcagcttacttagctggcttgccgcaaagcccgtatggctacacgccttttacaaacgaccaacagcttaaagatcaagacggtttgcagcctgggttgaaccgttaccaaacggttttaagccgcatgtacgaaaaagagtacatcacaaaagagcaatacgaggatgcaaaagactacgaccttactgctgattttacaacaagcgcgcctgacccaatggaagaacggccgcggcttactgaagaaattatgaaccgggcaacggcagtgctcgtacaacaaaaaatcgataaccgcgatggttgggagaaattaagcgacactgctaaacaagttgaacgcaatcagtttaaagcggaagtcgaaaacgcgattatcaatggtggttacaacatcattacgaccattgataaagatttgtatgatgccatgaacgaggcagctcaacaatctgacgcgtattttggtgccgacaaacaagggcaacgggaagaagtcggctctgttttaatcgaaaataaaactggaaaaatccttagctttgtcggtggtcgtgaagaaagcttagatcatctgtataaccacgctacacgtgcttatcgccaagcaggctcgacgagcaaacctgttcttgcttatgcgggcgcgattgaagcaggagtaacccaaccagggcttgtcattcctgatgaacaagcgttttacaaagctggtgggagggaaattagaaactttgaccacgctcacaaaggcaatctcactgtgcgggaatcactggcacaatcacgcaacgtgcccgctgtagaggcgtggtggcatgtccctgatgacttaaaagtaaaactccgcgacgcagccggctttaatccagacatgcacggcgtgaatgaagcagtcgctatcggtggcggcaatgttaccgttgaacaaaatgtcagcgcctttagcgctttcggcaacaatggcgtccggatggaaccctatatgatcgaacggatcgaaacggattccggcgaagtcatttatgagcatcctgctagtaagcatacaatgtttagcccacaaacaaactatttggtcgccgatatgatgcgtgatgtgatgtacagcgcaaatggcactggccgcacagcagccaacaagttgcagtttcaagccgactgggctggaaaaacaggcacgaccaacagagactatgattcatggtttattgccgtcaaccctgaggtgacattaggcgtatggaatggttatagcggtgacaaaacaattagtttacgcaaacgcgttggcgggctcggcacaggggcgcggacacagtccatttgggccaatcttgctaatgctgcttatggtgttgacccggatctaatgacagcagaaggcaaacgctttgagcagcctgatggcattgtcgaaaaacgagtctgtggcttaacaggcggcccaccaacaaaagcatgcgaagaacaaggcttagtcactaccgacctatacagaagcgacatgatcgatcatatcgaggggctagccccgtttcaagcgaactttaaaccgaatgctcaaccatctaatgaaaaagaagatgatgacgattaa

SEQ ID NO: 50197 - protein, 773 aa, Bacillus clausii KSM-K16
MKHFLSKWKNNWDAFIAKLDDIQFFRKVGITYQVLWNLFLIVFIIGFLGFMFASGTAAGYFASLVVDEKTYSEEDMRTFVGSLSKTSDIYLAGGVYLGKIRSEVDREIVSLDDVADEVKWAIIATEDEHFYEHNGIVPKALLRATMQELTSSSVQTGGSTLTQQLIKQQILSDEVSFDRKATEIMLALRLEQFMTKDEILEAYLNVVPFGRNASGRNVAGIEAAAQGVFGVSASELNLPQAAYLAGLPQSPYGYTPFTNDQQLKDQDGLQPGLNRYQTVLSRMYEKEYITKEQYEDAKDYDLTADFTTSAPDPMEERPRLTEEIMNRATAVLVQQKIDNRDGWEKLSDTAKQVERNQFKAEVENAIINGGYNIITTIDKDLYDAMNEAAQQSDAYFGADKQGQREEVGSVLIENKTGKILSFVGGREESLDHLYNHATRAYRQAGSTSKPVLAYAGAIEAGVTQPGLVIPDEQAFYKAGGREIRNFDHAHKGNLTVRESLAQSRNVPAVEAWWHVPDDLKVKLRDAAGFNPDMHGVNEAVAIGGGNVTVEQNVSAFSAFGNNGVRMEPYMIERIETDSGEVIYEHPASKHTMFSPQTNYLVADMMRDVMYSANGTGRTAANKLQFQADWAGKTGTTNRDYDSWFIAVNPEVTLGVWNGYSGDKTISLRKRVGGLGTGARTQSIWANLANAAYGVDPDLMTAEGKRFEQPDGIVEKRVCGLTGGPPTKACEEQGLVTTDLYRSDMIDHIEGLAPFQANFKPNAQPSNEKEDDDD

SEQ ID NO: 50198 - DNA, 1932 bp, Campylobacter jejuni RM1221
  CDS (1)..(1932)
atgaaaatattaaaatatattttttcattttttactcttttgtttatagctggatttatttatgtggcttatcttttcacaagtgctgatactgagggttatacttttaaagaatacaaacctcctcttacaacacaaatttacgatagaaatggcaagcttgtggctaatatttttgaacaacatcgtttttacgctccttatgaagagcttcctccacgccttatagaagctttggttgctatagaagatacaagcttttttgaacataatggagttaatatcgatgccatttttagagctgctgtaaaaatcataaaaagcggtggaaaaaccatggaaggagcttccactcttacccagcaatttattaaaaacacggaattaacccctgaaagaactattacgcgtaaaattcgcgaagctttgcttgcttataaaatggaaaccattttaactaaagagcaaattttagaaaggtatttaaattttattttttttggacatgggtattatggagtaaaaaccgcagctttggggtattttcataaaaatttaaatgaattaagccttaaagagattgctatgttagtaggtatgccaaaagcacctagcagttatgatcctacaaagcatttagatctttccatttcaagagcaaataatgttatttcaagaatgtataatctaggttggatttcaaaagcagattatgatacagccattaaagaaattccgcaagtttatgatgatacgcttactcaaaatgctgctccttatgtcgtagatgaagtgattaaacaattaagccctaatatcaaagacttaaaaacaggtggatataaaatcattttaaatatagacttagatgttcaaaatatggcacagaatgctttaaaatttggttatgatgagatagtaaaacgcgataaagatgcaaatttaagcactttaaacggagctatggtcgtggtaaatcatcaaagtggtgatgttttagctttggtaggtggagttgattatgaaaaaagtaattataaccgcgctactcaaagtatgcgtcaacctggaagctcttttaaaccttttgtgtatcaagtggcgattaatttaggatattcgcctatgagtgaaattgctgatatttctagaatttttgaaggtggagcgggtaataatgaggattggaaacctaaaaatgaagggggtaaatttttaggtttaattaccttaaaagaagctttaacaagatcaagaaatttagctaccattaatctcgcacttgatatggggcttgatgttctttactctaaactaatggaatttggatttaaagatataccgcctaatttatcaatcgtattgggaagttttggtatttctcctttggagtattcgaaattttataccatgtttgggaactatggtacgattaaagatcctcaaattatcagacaagttcaggataaaaccggtaaaaccatcatggaatttaactcaaatgagcgtaaagtcagcgatgaagcgcaaagttttctggttttagatatgatgagaaatgttgttgaaaaaggcacagggcgtaatgcaagagtaaaagatatagaaatagcaggaaaaacaggaacaacgaataaaagtgttgatgcttggttttgtggacttacgcctgaaatagaagcaatcatttggtatggaaatgataacaacaagcctatgcgttatacagaaggtggggctagaacagctgctcctgtgtttagagaatttttaactcaatatatagaaaaattccctgatacaactagaaaatttagcattcctaatggagtttatcgtggaaattataaaggagaaagtgcttattataccaccaaatcaccattaccaaaagcaaatatgaaatttaatgaaagcgagattatattttga

SEQ ID NO: 50199 - protein, 643 aa, Campylobacter jejuni RM1221
MKILKYIFSFFTLLFIAGFIYVAYLFTSADTEGYTFKEYKPPLTTQIYDRNGKLVANIFEQHRFYAPYEELPPRLIEALVAIEDTSFFEHNGVNIDAIFRAAVKIIKSGGKTMEGASTLTQQFIKNTELTPERTITRKIREALLAYKMETILTKEQILERYLNFIFFGHGYYGVKTAALGYFHKNLNELSLKEIAMLVGMPKAPSSYDPTKHLDLSISRANNVISRMYNLGWISKADYDTAIKEIPQVYDDTLTQNAAPYVVDEVIKQLSPNIKDLKTGGYKIILNIDLDVQNMAQNALKFGYDEIVKRDKDANLSTLNGAMVVVNHQSGDVLALVGGVDYEKSNYNRATQSMRQPGSSFKPFVYQVAINLGYSPMSEIADISRIFEGGAGNNEDWKPKNEGGKFLGLITLKEALTRSRNLATINLALDMGLDVLYSKLMEFGFKDIPPNLSIVLGSFGISPLEYSKFYTMFGNYGTIKDPQIIRQVQDKTGKTIMEFNSNERKVSDEAQSFLVLDMMRNVVEKGTGRNARVKDIEIAGKTGTTNKSVDAWFCGLTPEIEAIIWYGNDNNKPMRYTEGGARTAAPVFREFLTQYIEKFPDTTRKFSIPNGVYRGNYKGESAYYTTKSPLPKANMKFNESEIIF

SEQ ID NO: 50200 - DNA, 2025 bp, Rhodobacter sphaeroides 2.4.1
  CDS (1)..(2025)
atgatccgggcgcggtggctgttcgcggcggcggcggggctgttcctcgccgccgccgcccgcgacggggtcgagggcttcatcgccgcgacagcgatgccgcctctggcgctgcagacctcggtcgaggtcgaggcgcgcgacggcacgctgctgcgcgcctataccgtcgccgacggccgctggcggctggagccggggccggtcgatccgctgttcctgaagatgctcgtggcctacgaggacggccgcttctacgaccacggcggcatcgatccgctggcgctgacgcgggcggtgctgcaggcgctgcgctacgggcaggtggtatcgggcggctcgaccctcaccatgcaggtcgcgcggctcctcgaagaaagcggcacgggccgggtggcgggcaagctgcgccagatgcgggtggcgctggcgctggagcggcggctttcgaaggaggagatcctgtcgctctacctccgtctggcgccctatggcggcaacctcgaggggatccgggcggcgtcgatctcctacctcggcaaggagcccgcccggctgaccgcggccgaggcggcgcttctggtcgccatcccgcaatcgcccgagggacggcggcccgaccgccaccccgagcgggccgaggccgcgcgggcccgcgtcctcgcccgcgccgtccgggcggaggtgatcgagtccgaccgcgccgaggctgccctgcgggagccggtgccgcgggcgcgcaagcccttccccgctgtggcaccgcatctggccgaccgggtggcgaaggccgatccgctgcgccagacgcaccggctgacgctcgacgcggccctgcagaaacggctcgaggcgctggccgccgagacggtcgaggcgcggggcgagcggcttcaggtggcgatgctggtggccgatcaccgctcgggcgagatcctggcctcggtcggatcggcggcctatcgcgccgaccggcggcaggggttcctcgacatgacggtggcgctgcgcagcccgggctcgcttctcaagcccctgatctacgggcttgccttcgacgaggggctcgcccatcccgagacgctgctcgacgaccggccgatggatttcgcgggctaccggccgcagaacttcgaccggatcttccgcggcgagatccgcgcgcgcgaggcgttgcagatgtcgctgaacctgcccgcagtcgcgctgaccgatgcgctggggccggcgcggcttctgtccgcgctggagcaggcgggggtgaagccggtgctgccgggcgggcagccgggcctcgccgtggcgctgggaggcgtgggcgtcacgctctccgacatggtccagctctatgcggcgctcgcccgcggcggggtggtgctgccgctccatgtcgagggcgagggcgcgccggggcggcggctgatgtccgaggtttcggcctggcaggtggcggacatcctgtcgggcatggcgccgccgcccggcgcgccggcgaaccggctggcctacaagaccggcaccagctacggccaccgcgacgcctgggcggtggggttcgacggacagcatgtggtggggatctggctcgggcgggccgacggcaccccggtgccgggggtcttcggcgccgatctcgcggcgccggtgctgttccgcaccttcgcccggctgaagcccgcgctggatccgctgccgcccccgccgcgcgcggccctgaccgtgagcaatgccgagctgccgcagccgctccgccggttccgctcgcggctggcggccttccagaccgtgggcgggccgcaggtggccttcccgcccgacggggccgaggtcgagcggctgcgcggcgggctgaaggtgaaggtcgagggcgggaccgcccccttcacctggctcgcgaacggggcgccggtcgcggtctcgctcggcgggcgcgagacgctgctcgacctgccggcggggttcctcaccctttcggtgatcgacgcggacggccgctctgcccggaccgcggtgcgactgcgctag

SEQ ID NO: 50201 - protein, 674 aa, Rhodobacter sphaeroides 2.4.1
MIRARWLFAAAAGLFLAAAARDGVEGFIAATAMPPLALQTSVEVEARDGTLLRAYTVADGRWRLEPGPVDPLFLKMLVAYEDGRFYDHGGIDPLALTRAVLQALRYGQVVSGGSTLTMQVARLLEESGTGRVAGKLRQMRVALALERRLSKEEILSLYLRLAPYGGNLEGIRAASISYLGKEPARLTAAEAALLVAIPQSPEGRRPDRHPERAEAARARVLARAVRAEVIESDRAEAALREPVPRARKPFPAVAPHLADRVAKADPLRQTHRLTLDAALQKRLEALAAETVEARGERLQVAMLVADHRSGEILASVGSAAYRADRRQGFLDMTVALRSPGSLLKPLIYGLAFDEGLAHPETLLDDRPMDFAGYRPQNFDRIFRGEIRAREALQMSLNLPAVALTDALGPARLLSALEQAGVKPVLPGGQPGLAVALGGVGVTLSDMVQLYAALARGGVVLPLHVEGEGAPGRRLMSEVSAWQVADILSGMAPPPGAPANRLAYKTGTSYGHRDAWAVGFDGQHVVGIWLGRADGTPVPGVFGADLAAPVLFRTFARLKPALDPLPPPPRAALTVSNAELPQPLRRFRSRLAAFQTVGGPQVAFPPDGAEVERLRGGLKVKVEGGTAPFTWLANGAPVAVSLGGRETLLDLPAGFLTLSVIDADGRSARTAVRLR

SEQ ID NO: 50202 - DNA, 1902 bp, Rhodobacter sphaeroides 2.4.1
  CDS (1)..(1902)
atggcgtgggtcttcgggctgatctggggaatcgtgatgttcttctggcgcatcctctggggcgtgggctggcgcatcctcgcggccgtggccctcgtcgtgggcctgtcctcctattatttctattcgcagctgcccgaggtggcccagctcgtcgacggacgcgcccgcggctcggtcacgatgctcgaccgcgagggtaaggtcttcgcctggcgcggcgagacctacggcggcatggtcacttcggacaaggtctcgaaatacctgcgcgaggcggtcgtcgccaccgaggaccggcggttctaccgccatttcggcgtgagcccccgcggcatcgcttcggccgtgcgcatcaacctgagcgaggggcgcgggccgctggaaggcaacggcggctcgaccatcacgcagcaggtggccaagcttctgtgcctcggcgtccaatacgatccgaaggaatggaagagcgaggccgactacgaggccgactgccgcaagggcgggatctggcggaaggtgaaggaggtgcccttcgccctcgcgatggaggcgaaatacaccaaggccgagatcctgacgatctacttcaaccgcgcctacctcggcgcgggcgcgcgcggcttcgaggctgcggcgcagcgctacttcggcaagtcggcgagcgaggtgagcgcctccgaagccgcgatgctggcgggccttctgaaggcgccctcctactacgcgcccacggccaacctcgagcgcgcgcgcgaccgggcgaatgtcatcatcggcctcatggaggagcagggctacctgacccgcgccgaagccgatcaggcccgcgcccatccggcacagctctccgaggcggcgcagagccgctccggcggcttcttcgccgactgggtgatggaatcgggcccggccttcctgacccgcgacacgaccgaggatgtcatcatccgcacgacgctcgaccagcggctgcagcgcgcggcggaaggcgcgctcgatgacgtgttcaagaccaaggtgagcgagggctccaaggcgcaggcggcggtcgtggtcatgtcggccgacggcgcggtgcgcgccatggtcggcgggcgcaaggttcaggcggcgggctcgttcaaccgcgcgacccaggcgctgcggcagacgggctcggcgttcaagcccttcatctatgccgccgcgatggatctgggctacagccccgcggacttcgtcgacgacagcccactcaccgtgatggtgaagggctcgggcccctggtcgccctcgaactacgaccggaagttccgcgggatcgtgacgctgaccagcgcgctcaagcagtcgctgaacatccccgccgtccgcatcaccgaggccgtgggccgcgagaaggtgcgtcaggtggcgtcggaattcggcatccagagcgatctcgccgccgggcccgcgcttgcgctcggcgtgtcggaggccacgctcctcgagatgaccggtgcctatgcgggcatcctgaacggcggctcggcagtgaagccctacgggctcgtcgaactccgcctgcagggcgaggatacgccactgatcggtcaggagggcggcatcggcgagcgggtgatctccgagcaggcggcccagcttctgacctacatgatgacccaggtgatcgagagcggcaccggcgcccgggcccgcctgccgggctgggaggccgcgggcaagaccggcaccacccaggcggcccgcgatgcatggttcgtgggcttcaccgccgattatgtggcgggcgtctggatgggctacgacgacaacacaccgctgaagggcgtgacgggcggggggcttcccgccgacatctggcgcgaagtgatggtgcgggtccacgaggggcttcagccccagccgctgaagtag

SEQ ID NO: 50203 - protein, 633 aa, Rhodobacter sphaeroides 2.4.1
MAWVFGLIWGIVMFFWRILWGVGWRILAAVALVVGLSSYYFYSQLPEVAQLVDGRARGSVTMLDREGKVFAWRGETYGGMVTSDKVSKYLREAVVATEDRRFYRHFGVSPRGIASAVRINLSEGRGPLEGNGGSTITQQVAKLLCLGVQYDPKEWKSEADYEADCRKGGIWRKVKEVPFALAMEAKYTKAEILTIYFNRAYLGAGARGFEAAAQRYFGKSASEVSASEAAMLAGLLKAPSYYAPTANLERARDRANVIIGLMEEQGYLTRAEADQARAHPAQLSEAAQSRSGGFFADWVMESGPAFLTRDTTEDVIIRTTLDQRLQRAAEGALDDVFKTKVSEGSKAQAAVVVMSADGAVRAMVGGRKVQAAGSFNRATQALRQTGSAFKPFIYAAAMDLGYSPADFVDDSPLTVMVKGSGPWSPSNYDRKFRGIVTLTSALKQSLNIPAVRITEAVGREKVRQVASEFGIQSDLAAGPALALGVSEATLLEMTGAYAGILNGGSAVKPYGLVELRLQGEDTPLIGQEGGIGERVISEQAAQLLTYMMTQVIESGTGARARLPGWEAAGKTGTTQAARDAWFVGFTADYVAGVWMGYDDNTPLKGVTGGGLPADIWREVMVRVHEGLQPQPLK

SEQ ID NO: 50204 - DNA, 2427 bp, Xylella fastidiosa Dixon
  CDS (1)..(2427)
atggcataccacgcagaagatgatttcaacgaagcgtcaaatggcaacatgctgggccattccccctggtggggctggctgatcgcttgcgccttggcaggcttggcgcttgccatgggctttctggtcccttacacgctttacctgaatcagcaggtgaccgctcgctttggtgagctgcgctggcagatcccaacccgggtctatgctcgccctttgatgctacaaccgggcatggcattagatgcgcgcacgttgaagatcgaactggatgctgcatcctatcgtgaggacaatcacggcgagttaccaggcacctaccaacaacaaaatggccgcttcactgtctccagccgtggctacgttgatgtggatggtgcaataccagcaagccgtctgatcatcacactgaacaacaaccaagtgtctgcactgcggaaggcagatacacgcaaaccaatcaggcgcgggcgactggatccagcacgcatcgccacactgtacggccagaagcaggaagaacgccgtttggtcaggttggaggaagttccccaactgctcgttaccggcttacaagtggtggaagaccgcgatttcaaacatcaccacggcatcgacatcaccagcattttgcgcgcagcctgggtgatggtgcgttccggcggtggcgttcgccaaggtgccagtaccctaacgcaacagctagcgcgtagcggactgcttggtatcggcaaagaacagacgttgcagcgcaaatgcaacgaaatcctgtatgcactgatcctggaggcacgctactccaagcgcgttatcctggagtcctatctcaatcaagtctacctgggtcaacgtggcagccaggccgtacatggtgtcgcaactggcgcggagttctggtatggacgtgagctaggctcgctcactactgaacaggtcgccctgctcatcggactggtcaaaggaccttcgtactacgatccacgccgtttccctgatcgcgcattgtcccgacgcaatttcgtgcttggcaaactgcatgaaaacaaactgatcgacgatgctgaatacatgcgcgcccaagcatcgcccctaggtgtccccaaagaacctggcctggttgcagccaaccgcttcgtcgcgtacctcgacctggtacgccgccagcttgctcacgattacccagagaatgtgttgcgtggcgcaggcatgaccgtacttaccggcatgtcgccctcagcacaagcctatgctgagagaggagtacaaaccacgctcagtgcactggaaaaggtcaaggggctgaaacgtccgccactgcaagccggactggtactgacggacgtgcataacggcgatgtcctggccgtggtcggtagtcgcgatgcaacccaatcgggtttcaatcgtgccattgaagcgcaacgccaggtgggttcgctgctgaaaccgttcgtctatctactagcactggcctcaccggatcgttggtccttgtccagttgggtagaagacaccccggtcaacataccgctggcacatggacgcatttggtcgccaagcaactcagacaacatcagccacggaaccgtgcgcttgattgatgcattggcacactcttacaaccaagcaacagtgcgcgttggcatgcaggtcggcccagaacgtgtggctcaattgattaacgttctggccggattaaaagccgacgccaacccatcgctgatcctgggcgcaaccgaccaaagcccttatgcaatgacgcagctctatcagttcctggcttctgggggtgaaatccaaccgttgcacgcagtgcgcggcgtactcgatccgcaaaacaaactgctcaaacgctatgacaataccccggcacctgcacagcccggcgactcagtcgcagccaacgtcatcagcgttgcgctacaggaagtggtcaacagcggtaccgcgcggcaactcatcatcgacggcttgggtcggctgtcccctgccggcaaaaccggaacctccaacgatggacgtgacagctggtacgcgggctacaccgggaaccacttggctgtcatttgggtcggcaacgaccaaaacgagcaaactggcctatacggcgccaccggtgccatgcgcgtttggtcgagcatcttctcgcagttaccaagcaccagattacaagtcaacggcaaaggactggattggcagtcagtcgagcctatgggcactggcaccacagacgcaaactgcccaggcgcacgccgctttccgtttgtagccggcttcgctccgccttatgcagcatgctctggtgctggcggagcacccgaagcagggcataatatcggctggcgtaactggttcgggctggataagcagaagggggaccaagcatcgccccccataacgcctcctcccgatcaatcgacacaatga

SEQ ID NO: 50205 - protein, 808 aa, Xylella fastidiosa Dixon
MAYHAEDDFNEASNGNMLGHSPWWGWLIACALAGLALAMGFLVPYTLYLNQQVTARFGELRWQIPTRVYARPLMLQPGMALDARTLKIELDAASYREDNHGELPGTYQQQNGRFTVSSRGYVDVDGAIPASRLIITLNNNQVSALRKADTRKPIRRGRLDPARIATLYGQKQEERRLVRLEEVPQLLVTGLQVVEDRDFKHHHGIDITSILRAAWVMVRSGGGVRQGASTLTQQLARSGLLGIGKEQTLQRKCNEILYALILEARYSKRVILESYLNQVYLGQRGSQAVHGVATGAEFWYGRELGSLTTEQVALLIGLVKGPSYYDPRRFPDRALSRRNFVLGKLHENKLIDDAEYMRAQASPLGVPKEPGLVAANRFVAYLDLVRRQLAHDYPENVLRGAGMTVLTGMSPSAQAYAERGVQTTLSALEKVKGLKRPPLQAGLVLTDVHNGDVLAVVGSRDATQSGFNRAIEAQRQVGSLLKPFVYLLALASPDRWSLSSWVEDTPVNIPLAHGRIWSPSNSDNISHGTVRLIDALAHSYNQATVRVGMQVGPERVAQLINVLAGLKADANPSLILGATDQSPYAMTQLYQFLASGGEIQPLHAVRGVLDPQNKLLKRYDNTPAPAQPGDSVAANVISVALQEVVNSGTARQLIIDGLGRLSPAGKTGTSNDGRDSWYAGYTGNHLAVIWVGNDQNEQTGLYGATGAMRVWSSIFSQLPSTRLQVNGKGLDWQSVEPMGTGTTDANCPGARRFPFVAGFAPPYAACSGAGGAPEAGHNIGWRNWFGLDKQKGDQASPPITPPPDQSTQ

SEQ ID NO: 50206 - DNA, 1947 bp, Lactobacillus gasseri
  CDS (1)..(1947)
ttgttcgtttgtacttattataccgttaaggtaaaaacttcaaacatctctaacatgaaggcagctctttctactacaactactatttatgataataaaaatcaaaaggcgggttcgctttattcgcaaaaaggttcttttgtagaattaagtcagatttcgccttatattcaagatgctgtgattgcgacagaagaccgaactttttataaaaatcctggttttagtgttaagggaatggctagagctgccataagtagtgtaattcaccacggtattgtcggtggtggttcaacgctaacgcagcagctagcaaagaatgccttactaacgcaaaagcagactttttctagaaaattagaagagctcttttttgcaatcgagattaatcgtgtctactctaaaaaagatattctaaccatgtacttgaacaacgcttactttggtaatggtgtttggggagttcaagatgctgcaaggcgttattttggtaaaaatgcgagcgatgtaacagtaggtgaagcagctactattaccgggatgctgagaagtcccagttattataatcctattgaccatatggataatgcaatttcacggcgtaatgttgtgctaggcttgatggctgatacagggaagatctctgagactcaggctgataatgctaaaaagacgacattaactttagaagatacattttctcaagaagatggttatcgctatccttacttctttgacgcagttgtggatgaagcaattgatcgttatggcttaaaagaagaagatgtaatgaacaagggcttaaagatttacactactcttgatactggctatcaaagtgccttgcaagacagttttgaagaaagctggaatttcccgtcaaatgctagtgatggaaccaaagttcaaggtgcaagcgtcgcaatggatcctaagacgggagctgttcgagcaatagttggcggaagagggcaacatgtctttcgaggctataatcgtgccacgcagatgaagcgtcagcctggttcaacgatgaagccactggctgtttattcgccagctctgcaaagtggctatcactacgattctgaactttctaataaattacaaaaatttggcaaaaatggttatgaaccaaaaaatgttgataatcaatactcaaataagattccaatgtatgaggctctagcacaaagtaaaaatgttccagctgtttggttattagacaaaattggtgtcagcaagggtgttcaatctgttgaaaacttcggcattcatgttaataagagtgaccaaaacttggctttagctttaggtggtttgtcgactggtgtttctccaatgcagatggcgagagcttacagcgcttttgctaatgaaggaaacttgccaaatcagtcttactgtattactaaaattactgatgctagcgggaatgtaattgctcaaaacaagaatcctggcagtcaccgaataatttctactaatactgcaaaagaaatgacctctatgcttttaggcgttttcacttctggtactggtagatcagctcagccggcaaactttagagtagctggtaaaactggatcaacagaggtgccagatagttatggctttggtacgaaagatcaatggattgttggttatactccagatgttgttttgtcaacttgggttggttttgataagacggatcaaaatcactacatggaaggaatttctgaaacaggaattacgcacctttataagtctgagttagaacgcttgctgccatatacttcgcaaacgcaatttaaggaaaagagcgctcagcaaatttctcaagatacaggtgcaaattcagactggctcggtaatattggaaaacaagtacaaaaaggaatcaatgatactgggtctaagtttaacgaatggtataataaccttaaaggacttttaggtcagtaa

SEQ ID NO: 50207 - protein, 648 aa, Lactobacillus gasseri
MFVCTYYTVKVKTSNISNMKAALSTTTTIYDNKNQKAGSLYSQKGSFVELSQISPYIQDAVIATEDRTFYKNPGFSVKGMARAAISSVIHHGIVGGGSTLTQQLAKNALLTQKQTFSRKLEELFFAIEINRVYSKKDILTMYLNNAYFGNGVWGVQDAARRYFGKNASDVTVGEAATITGMLRSPSYYNPIDHMDNAISRRNVVLGLMADTGKISETQADNAKKTTLTLEDTFSQEDGYRYPYFFDAVVDEAIDRYGLKEEDVMNKGLKIYTTLDTGYQSALQDSFEESWNFPSNASDGTKVQGASVAMDPKTGAVRAIVGGRGQHVFRGYNRATQMKRQPGSTMKPLAVYSPALQSGYHYDSELSNKLQKFGKNGYEPKNVDNQYSNKIPMYEALAQSKNVPAVWLLDKIGVSKGVQSVENFGIHVNKSDQNLALALGGLSTGVSPMQMARAYSAFANEGNLPNQSYCITKITDASGNVIAQNKNPGSHRIISTNTAKEMTSMLLGVFTSGTGRSAQPANFRVAGKTGSTEVPDSYGFGTKDQWIVGYTPDVVLSTWVGFDKTDQNHYMEGISETGITHLYKSELERLLPYTSQTQFKEKSAQQISQDTGANSDWLGNIGKQVQKGINDTGSKFNEWYNNLKGLLGQ

SEQ ID NO: 50208 - DNA, 2193 bp, Leuconostoc mesenteroides subsp. mesenteroides ATCC 8293
  CDS (1)..(2193)
atggcaaatgacaaagcgaatcaatggtcgcgtgtaaatcgtaatcataagatgtacgaccaataccctgcacaagaaccaccacgtccgccaaaaccaaatggtccaaagggtagtgggtccagaaaaccaagaaaaactaaaaagaagcgtcgttggatattagccatattcttatggttatttactcttggtctgattgctgggcttgcgggaacagccttgttcttcacttatgcgaatgatgcacccaatattacagagtcggatttagcttcggaaaactctacacagctcttagattctaaggggaatgtcttttggagcatggccactcaagatcgtgattatgctaattccaatgaaatacccaaacaattaaagcaagctgttgtttctattgaagatcgacgtttttacaaacatcatggtgtagacccaatacgtattgccggagctgcaatttccaatattaagggttcttctctggggatgcagggcggatctactctgacgcaacaattagttaaattgtccgtctttagtacatcaacgtctgaccaaacatttaaacgtaaggcgcaagaagcatggttagccttacgtgtggagaagaattttactaaaaatcaaattttgacgttttatatgaacaaagtgtacatgggacacggcgtttacggaatgaaaacagcttcagaatatttttatggtaaagcgttaactgatctttctttgccacaattggctttgcttgctggtatgccacaatcaccaacttattatgatccctacttaaaggacaccacggctgcaaaagagcgtcgtgacacagttttgaaagctatggttacttatggtgcgattacgtcaaagcaagcgacagaagcaatgaaagtgcctgtcagcgatggcttacaagatttaaatgccaaaacagaggcggctaatagcactcgtcaagttgctgatgggtacgctttatcagtaataacggaagccaaaaagctaggttatgatacaacaaaagccggtttgaaaatctatactaatatggattctaatttacaacaatccctttatgataatgccaatgatggttctgttactttttctagtgatgacttacaaattggtgcaacaatgacagatccaaataatggtcacgttatagcccaaattggcggacgtaatgttaataccttgcaggcacttaaccgagcaaccggcaagaaccgttcatctggttcatcaattaaaccattactagattatgggccagcaattgaataccttaactggccaacttatcgaacagttgaagataaaaaatacaaatataacggtacaaacataagtgtttacaactgggataaaaaatacatgggaaacattaccatgcgtacggccttaacgcaatcgcgaaatattcctgcaatcagaaccttagaagaggttggtggttcaaatgccgagaagtttgttaatggactaggcattacgacgaactcaacaccgggtggttcaatggccattggaatcgatgtttcaaccgaacaggaggcagcagcgtttggtgctgttgctaatggtggtgtctattacaagccaacttatatttctaaaattgtcactgcagatggcacaacccatagctacacatcaagtggcacacgtgctatgaagaccagtacagccttcatgttaactgatatgatgaagggtgttatcaagcctaatgcaaccgcagcagatgccgcaatttctgggttatatcaggctggtaagtcagggctagtagcctatgatgataatgctgggatgcctgataaagcgatatcggatgcttggtttaccggctatacaaaatcgtatacgctctctgtatggactggatttgatgttcctagtaaaaattacattccttggacagagcaagatttaccggcgcagtattatgccaaagtgatggcttatgctatgcaaaataagtcaaataccgattggaccgcaccagatacagttactgctaaagtgaagggaaatatcgttgaatatgaagtcaaagatgcttcttggagtaacggtggactgccgagtgtgaattccattgcgcaatctggggaaactccatctgaagcaggaattagtgcaaactctgcttcaactggttctacaactggcaacaattaa

SEQ ID NO: 50209 - protein, 730 aa, Leuconostoc mesenteroides subsp. mesenteroides ATCC 8293
MANDKANQWSRVNRNHKMYDQYPAQEPPRPPKPNGPKGSGSRKPRKTKKKRRWILAIFLWLFTLGLIAGLAGTALFFTYANDAPNITESDLASENSTQLLDSKGNVFWSMATQDRDYANSNEIPKQLKQAVVSIEDRRFYKHHGVDPIRIAGAAISNIKGSSLGMQGGSTLTQQLVKLSVFSTSTSDQTFKRKAQEAWLALRVEKNFTKNQILTFYMNKVYMGHGVYGMKTASEYFYGKALTDLSLPQLALLAGMPQSPTYYDPYLKDTTAAKERRDTVLKAMVTYGAITSKQATEAMKVPVSDGLQDLNAKTEAANSTRQVADGYALSVITEAKKLGYDTTKAGLKIYTNMDSNLQQSLYDNANDGSVTFSSDDLQIGATMTDPNNGHVIAQIGGRNVNTLQALNRATGKNRSSGSSIKPLLDYGPAIEYLNWPTYRTVEDKKYKYNGTNISVYNWDKKYMGNITMRTALTQSRNIPAIRTLEEVGGSNAEKFVNGLGITTNSTPGGSMAIGIDVSTEQEAAAFGAVANGGVYYKPTYISKIVTADGTTHSYTSSGTRAMKTSTAFMLTDMMKGVIKPNATAADAAISGLYQAGKSGLVAYDDNAGMPDKAISDAWFTGYTKSYTLSVWTGFDVPSKNYIPWTEQDLPAQYYAKVMAYAMQNKSNTDWTAPDTVTAKVKGNIVEYEVKDASWSNGGLPSVNSIAQSGETPSEAGISANSASTGSTTGNN

SEQ ID NO: 50210 - DNA, 2244 bp, Azotobacter vinelandii
  CDS (1)..(2244)
atggtgctggccggctttgccgtctacttcgatgccgtgatacaggagaaattctccggcaagcgctggacgctgccggccaaggtctacgcgcggccgctggagctgttctccggtctcaagctgtcgaagcaggattttctcaccgagctggatgcgctcggctatcgccgcgaggccgtcgccgggccggggtcggccttcgtatccggcaacaccgtcgaactgcatagccggggctttcgcttctatgagggcgacgagccggcacggaggatccgtgtacgcttctccggcgactccgtggccagcctgagcgatgccgccggcaaggacctggccgtcgtgcggatggagccgccgctgatcggcggcctgtacccgtcgcacaacgaggaccgcatcctggtccagcgcaacgaactgccgccctacctggtggaaaccctggtggcggtggaggatcgcgagttcttcagccacttcggggtgtcgccgaaatccatcgctcgcgccctgtgggtcaacgccacggcaggcggggtggttcagggcggcagcacgctgacccagcagttggtgaagaacttctacctgaacaacgagcgcagcctggtgcgcaaggccactgaagccatgatggccgtgctgctggagctgcactacgacaaggacgagattctcgaggcctatctcaacgaggtgttcctggggcaggacggcaatcgcgcggtgcacggcttcggtctggccagccagtatttcttcggccagccgctggccgagttgcagccgcatcagatcgccctgctggtgggcatggtcaaggggcccacctactacaatccacgccgcaaccccgagcgagccctggtgcggcgcaacctggtcatcgacctcatggtcgggcagggggtgatcgatgcggcgcaagccgaagccgccaagcagaagccgctcggcgtcaccgcccgcggcagcatggccgacagttcctatccggcgtttctcgatcttgtcaagcgccagttgcgcgaggactaccaggaggccgacctcaccgaggaggggctgcgcatcttcaccagcctggatccgatcctgcagagcaaggccgaggctgcggtacgaaataccttcaagcgcatcggcaagggcggtgatccggtcgaggcgtcgatggtggtgagcaatccggaaaccggcgaagtgctggccctgctcggcagccggcagccgcgtttcgccggtttcaaccgggcgctggacgcggtgcggccgatcggttcgctgatcaagccggccgtctacctcaccgcgctggagcggcccaaccagtacaccctgaccagttggctggccgatgtgcctttctcggtgaagggccaggacggccagctctggcgcccgcagaactacgaccatcgggcccatggcgacatctatctttatcaggggctggccaattcctacaacctgtcgaccgccaagctcggcctcgagttgggcgtgccgaacgtgctgaaaacattggcgcgtctgggcgtcaatcgcgaatggccggcctatccgtcgatgttgctgggcgctggggccttgaccccgatggaggtgtccagcatgtacctgaccatcgccagtggcggattcaatacgccgttgcgcggtatccgcagtgtcctgaccgccgacggcgaaccgctcaagcgttatccgttccagatccagcagcgtttcgatccaggggccatctatctgttgcagaacgccatgcaacgggtgatgcgcgaggggaccggccgttcggtctacagccagttgccgcgctcgctgacgctggccggcaagaccggtaccaccaacgattcgcgcgacagttggttcgccggcttcagccaggatctgctggcggtggtctggctgggacgtgacgacaacggcaagaccccgctgaccggtgccaccggggcactgagggtctggacggacttcatggccaaggccgatccactgccgctggatatgccgatgccggacaatgtcaccctggcttgggtgaatgcgcgcaacggactgggttccgagcagggctgtccggatgcggtgcagatgccctatatccggggcagcgagccgccaccggggcccgcttgcggcctgccgcaggctccggagggcaatgtgcaggatgtgatcgagaatgttcaggatgtcatggattgggtgcgtggctggtcgaattga

SEQ ID NO: 50211 - protein, 747 aa, Azotobacter vinelandii
MVLAGFAVYFDAVIQEKFSGKRWTLPAKVYARPLELFSGLKLSKQDFLTELDALGYRREAVAGPGSAFVSGNTVELHSRGFRFYEGDEPARRIRVRFSGDSVASLSDAAGKDLAVVRMEPPLIGGLYPSHNEDRILVQRNELPPYLVETLVAVEDREFFSHFGVSPKSIARALWVNATAGGVVQGGSTLTQQLVKNFYLNNERSLVRKATEAMMAVLLELHYDKDEILEAYLNEVFLGQDGNRAVHGFGLASQYFFGQPLAELQPHQIALLVGMVKGPTYYNPRRNPERALVRRNLVIDLMVGQGVIDAAQAEAAKQKPLGVTARGSMADSSYPAFLDLVKRQLREDYQEADLTEEGLRIFTSLDPILQSKAEAAVRNTFKRIGKGGDPVEASMVVSNPETGEVLALLGSRQPRFAGFNRALDAVRPIGSLIKPAVYLTALERPNQYTLTSWLADVPFSVKGQDGQLWRPQNYDHRAHGDIYLYQGLANSYNLSTAKLGLELGVPNVLKTLARLGVNREWPAYPSMLLGAGALTPMEVSSMYLTIASGGFNTPLRGIRSVLTADGEPLKRYPFQIQQRFDPGAIYLLQNAMQRVMREGTGRSVYSQLPRSLTLAGKTGTTNDSRDSWFAGFSQDLLAVVWLGRDDNGKTPLTGATGALRVWTDFMAKADPLPLDMPMPDNVTLAWVNARNGLGSEQGCPDAVQMPYIRGSEPPPGPACGLPQAPEGNVQDVIENVQDVMDWVRGWSN

SEQ ID NO: 50212 - DNA, 1974 bp, Nostoc punctiforme PCC 73102
  CDS (1)..(1974)
atgtcttcgccagaaatttttgaacaagaacaagcaggaattcagacttcacctagttacgagttttggaggcaagtaggtctcgtcactggtggtactcttttatcaattaatatgttggtaatttctattatggctggaggactacttggtttagtcattagtttccgtaatttgccacagcttagacaaatacggaacttcttaccagcagaaacaacttatatatacgacatcaaaggcaagcatttagcaagtatacatggagaagccaacagaaaaattgtacccttagataaaatttccccaaatttaaaacgagcagtcttagccggtgaagataattatttctataaccaccccggtattgatccaggaggtattggacgtgctgctttagttaactggacatcaggtactgtgaaggagggtggttctaccatcactatgcagttagtgaaaaatctctttttatctcgcaaacgtgctttaactcgcaaaatagcagaagctgtcttagcaattcgcttagagcaaattttcactaaagaccagattttagaaatgtacctcaatcaagtttattggggtcataataactatggtgtggaaacagcagcacagacatactttaataaatcggcagagaatttgactttgggtgagtcagcaatgatggcggctgtaatccaggctccagaacaatttagcccttttgtgaacaagaatttggctatacaaaaacaaaggcaagtactcggacgaatgctggaattaaaatggattaccaagcaagaatatgatgatgcgctccagcaagaaattaaacttggtaaaattaagtcatttgaagctagtatctttcctgatgtcaccaatcctgtagcacaggaactaattaaaaagtttgggcgtgatgcaactcttaaaggtggaatgcgagtgcaaaccacagtagccagtgacttgcaaatcatggcagaagaaactatcaaaaagtggcataaaactcttgaaggtcaaggattaaacaacaatcaaatggctttagtcgcaattgacccacgtacccactatatcaaagcactggtgggtggtgtagactcgaaaaagagcgaatttaaccgcgcaactcaggctcaacggcaacctggctctgcttttaagccgtttgtttactatactgcctttgctagtggtaagtttacaccaagtacaacggtgcttgattctcctgtaagctaccctgatgtgatgaatggctcgtactctccacgcaactacgataatacctttaggggtgcaatgccaattcgtactgctttagcactgtctcgtaacgttcctgcggttaagattggcaaagctgttggaataaataaaatcatcgccacttgccgtaccttgggaatcatgagtccgatggaacctgtaacttctttgccactgggtgcaattgctgttacaccactggaattggccagcgcttatgcgactttcgctaattacggctggcgctcacctccaacacttattgctcgcgttactgatagtagtggcaatgttttactggataatactcctaagcctcagttagttcttgacccttgggcatcagccacgattatagacgtgatgcaatcggtagttaaagaaggaactggtaaaggagctgctctagaccgccctgttgctggcaaaacagggacaacttcttcagagaaggatatttggtttattggtacagtgccacagctaacaactgctatttgggtaggcagagatgacaacaaacaattagctcatggtgcaacaggaggaggaatggttactcctgtctggcgcgattttatgaacaaggcgcttaaaaatgtacccatagaaaacttcaaacccccttctaagtttactcgccctcagcccactaaaaatatcatgaatactaaaaaactttctagtagtgtaccaaggtaa

SEQ ID NO: 50213 - protein, 657 aa, Nostoc punctiforme PCC 73102
MSSPEIFEQEQAGIQTSPSYEFWRQVGLVTGGTLLSINMLVISIMAGGLLGLVISFRNLPQLRQIRNFLPAETTYIYDIKGKHLASIHGEANRKIVPLDKISPNLKRAVLAGEDNYFYNHPGIDPGGIGRAALVNWTSGTVKEGGSTITMQLVKNLFLSRKRALTRKIAEAVLAIRLEQIFTKDQILEMYLNQVYWGHNNYGVETAAQTYFNKSAENLTLGESAMMAAVIQAPEQFSPFVNKNLAIQKQRQVLGRMLELKWITKQEYDDALQQEIKLGKIKSFEASIFPDVTNPVAQELIKKFGRDATLKGGMRVQTTVASDLQIMAEETIKKWHKTLEGQGLNNNQMALVAIDPRTHYIKALVGGVDSKKSEFNRATQAQRQPGSAFKPFVYYTAFASGKFTPSTTVLDSPVSYPDVMNGSYSPRNYDNTFRGAMPIRTALALSRNVPAVKIGKAVGINKIIATCRTLGIMSPMEPVTSLPLGAIAVTPLELASAYATFANYGWRSPPTLIARVTDSSGNVLLDNTPKPQLVLDPWASATIIDVMQSVVKEGTGKGAALDRPVAGKTGTTSSEKDIWFIGTVPQLTTAIWVGRDDNKQLAHGATGGGMVTPVWRDFMNKALKNVPIENFKPPSKFTRPQPTKNIMNTKKLSSSVPR

SEQ ID NO: 50214 - DNA, 1926 bp, Nostoc punctiforme PCC 73102
  CDS (1)..(1926)
atgtcgtcttctaggacttttgaagataaacagccacaacgtcgggcttcatcaggttttgagtttttgaaaggagttggtcaggtaactggcggcactctgctctcaattaccatgttggcaagttccattgtagccggaggactggttggtttagccattagtttccgtaatttgccagatgtaagacagctacgtaacttctttccctcagaaacaacttacatctatgacgttaagggtaaacttttaacgagtatccacggggaagccaaccgggaagtcgtacccctggatagaatttctccgaacttaaaacgggcggtattagcaagtgaagatagtcacttctacgatcaccacggtattaacccgactggtgttggccgggctatagtagttaacgctgtagcaggtggagtcaaagagggtggctccactgttactatgcaattggtaaaaaacctgtttttgtctcaaaagcgtgcctttacccgcaagttagcggaggccgtgctggcaatcaggttagagcaaattctcaccaaagaccaaattttagaaatgtacctcaatcaagtttattggggtcataacaattatggtgtacaaacggcagcccgtagttactttaataagtcatcagaatatttaagcttgggtgagtcagcaatgatggcgggtttgatccaagcaccagaagaattcagcccctttgtgagcatgaagctggcaaaacagaaacaaaaagaagtgctggggcggatgctggaattaaactggatcaaccagtctgagtatgacgatgccctcaagcaggaaataaaacttggtagaatcaaatcttttcaaggtagtgccctaccttatgtaaccaacaccgtagcgcaggaattggctaagaagtttgggcgtgagacactactcaagggtgggatgcgagtgcaaactacagttgatgccaaattccaaataatggcagaggaaactgtcactaagtggcataaaaaacttttagatcagggattatctaagaaccaaatggctctggtgtcaattgatccgcgcacacattttatcaaagcactagtgggcggtatagatccaaagaccagtgaattcaatcgtgcaactcaatctcaacgccagccaggttcttcttttaaaccctttgtatactatacagctttcgctactggtaaatatacgccagactcaacagtagatgattctccagtcagctatcgcgatggtaacggttggtactttcccagaaattatgatgggagttttaggggatcgatgccgattcgcacagctttagcccagtcacgtaacattcccgtgatcaagattggcaaggctgtggggatgaatcgagtgatcgaaacttgtcgtaccttgggtattatgagtccgatggaacctgttacttccttgcctcttggtgcaattggcgttacacctctggaaatggcaagtgcttatgcaacttttgctaattatggttggcagtcaccaccaactgtaattgcccgtgtcactgatagtagtggtaacgtattgctagacaacactcccaaaccacagctagttctcgatccttgggcatcagcagcaattcttgatgtgatgcgatccgtaatttctgaaggtactggtaaaggtgctgctatcggtcgtccagctgcgggtaagacgggaacaacatcatccgaaaaagatatttggtttgttggtactgtgccacagttaacaactgcggtttgggtaggcagagacgacaacagacaactagctgaccatgcaacaggtggtgttatggtcgctcccatctggaaagattttatggagaaggcgcttaagaacacaccagtagaaaacttcaagccaccttcccagttttctcgccccaagtcacaataa

SEQ ID NO: 50215 - protein, 641 aa, Nostoc punctiforme PCC 73102
MSSSRTFEDKQPQRRASSGFEFLKGVGQVTGGTLLSITMLASSIVAGGLVGLAISFRNLPDVRQLRNFFPSETTYIYDVKGKLLTSIHGEANREVVPLDRISPNLKRAVLASEDSHFYDHHGINPTGVGRAIVVNAVAGGVKEGGSTVTMQLVKNLFLSQKRAFTRKLAEAVLAIRLEQILTKDQILEMYLNQVYWGHNNYGVQTAARSYFNKSSEYLSLGESAMMAGLIQAPEEFSPFVSMKLAKQKQKEVLGRMLELNWINQSEYDDALKQEIKLGRIKSFQGSALPYVTNTVAQELAKKFGRETLLKGGMRVQTTVDAKFQIMAEETVTKWHKKLLDQGLSKNQMALVSIDPRTHFIKALVGGIDPKTSEFNRATQSQRQPGSSFKPFVYYTAFATGKYTPDSTVDDSPVSYRDGNGWYFPRNYDGSFRGSMPIRTALAQSRNIPVIKIGKAVGMNRVIETCRTLGIMSPMEPVTSLPLGAIGVTPLEMASAYATFANYGWQSPPTVIARVTDSSGNVLLDNTPKPQLVLDPWASAAILDVMRSVISEGTGKGAAIGRPAAGKTGTTSSEKDIWFVGTVPQLTTAVWVGRDDNRQLADHATGGVMVAPIWKDFMEKALKNTPVENFKPPSQFSRPKSQ

SEQ ID NO: 50216 - DNA, 2268 bp, Nostoc punctiforme PCC 73102
  CDS (1)..(2268)
atgagttctccccaaccccctcacaagccacaaacgttaattggtcaactgactcaagcagtccatactatccaagctagggttgatttttccaaactggcgctcaagcctaatgccaaagtaccagaactctgggtgcaggatgcgggggcggataaagcagaggtgtatccactgttgggcgatcgctatattctcggtcgtagctccaaatccagcgatatcgtcgtccgtaaccctgttgtcagccaaattcacctgtcactatcgcgcaattctactcagcgcacaccagttttcgtcatcaaagacgaaaactccaccaatggcatttatcgtggcaagcgtcgtgttaattccctagaactacgtcacggcgatattctgactctgggacccccagaactcgccgcttctgtgcgcttacaatacgtcgatccaccagcctggtatgtcaaagctgcaagttggacagcttatggtgttggtggtgtcagcgccttgttcgcgttggtaattggcgtagaatggctaaaattttcagttaaacccctacctacagctacacgcgctccagtagttgtttacgcccgtgatggagccaccccactgagagagcctcgaactatctctcatgtagatatgaagcgtttagaggaatttggcccttatttgccatctgccgtagtagcttcagaagatagtcgttattactggcactttggggttgaccctctggggattttacgagccgtgttgatcaatagtcgtagcggagatgtacaacaaggagccagcactgttacgcagcaagttgcccgcagtttgttccgagagtatgtaggcagacaggatacccttggacgcaaattacgagaagcagttgtcgccttaaagctagaaaccttttacagcaaagatgaaattttgctgatgtacttaaatcgggtttttttggggggagatacctctggctttgaggatgcagctcggtattactttgagaagcctgctaaagaattaactttggcagaagcagcaacattggtaggaattttacctgctcccaacgcatttgatttttgtggagatgggccaaataagctagaagcagctgaataccggaaccgcgtgattaagcggttgctggagatgggcaaaattaaacctgaagatgcgaaccgagctagacgttccactgttcaagttagccctaaagtttgtgaacaacaagctaagacgatcgctccttatttttacagttacgtcttctctgaacttgaatcaattttgggcgagggagccgcaaacgaagggaattatatcattgaaacccagcttgatcctgcgatccagagccaagctgaatcagcgttgcggaattcagtcaacaatagtggtggaaattttaatttttctcaaggggctgtagtaactcttgactccagtacaggtggcatcctcgcaatggtaggcggaactgattacaaaaaaagtcagttcaatcgtgctgttcaagctaaaagacaaccaggttctaccttcaaaatctttgcttacaccgccgctattcaacagggaatttcaccatccaagagttattcctgcgctcctttaacttggcaaggcttcacttacaaaccctgtcgttcaggtgctggcagtttagatattgccaccgggctggctctttcagaaaatcccatcgccttgggagttgctagagaaatcgggctgaataaagtggtagcgatggctcagaatttgggaatcaagtcaaacctcgatccggttcctggcttggtactaggccaaagtgtggtcaatgttttggaaatgactggtgcttttggctctattggcaatcgtggagtgtggaatcctcctcatgcgattaaccgaattttagacagtggtgattgcagcgatcgcaatgatatcaaaacctgccgtgtaatctactccttcgaccaagatccagatgctaacaaacgagttttgccaaatggtgtagccgatgagatgactagtttaatgcgtggtgtcatcagcagaggtaccggtcgtagtgctgccattgggctgggagaagctgggaaaacaggcacgactgataaaaacgttgacttatggtttataggttttatcccaagtcggcggcttgtaactggtgtctggctgggaaacgacaataattctccgacatctgggagcagcgctcaagccgctcagttgtggggaaattatatgcggagaattacgcgataa

SEQ ID NO: 50217 - protein, 755 aa, Nostoc punctiforme PCC 73102
MSSPQPPHKPQTLIGQLTQAVHTIQARVDFSKLALKPNAKVPELWVQDAGADKAEVYPLLGDRYILGRSSKSSDIVVRNPVVSQIHLSLSRNSTQRTPVFVIKDENSTNGIYRGKRRVNSLELRHGDILTLGPPELAASVRLQYVDPPAWYVKAASWTAYGVGGVSALFALVIGVEWLKFSVKPLPTATRAPVVVYARDGATPLREPRTISHVDMKRLEEFGPYLPSAVVASEDSRYYWHFGVDPLGILRAVLINSRSGDVQQGASTVTQQVARSLFREYVGRQDTLGRKLREAVVALKLETFYSKDEILLMYLNRVFLGGDTSGFEDAARYYFEKPAKELTLAEAATLVGILPAPNAFDFCGDGPNKLEAAEYRNRVIKRLLEMGKIKPEDANRARRSTVQVSPKVCEQQAKTIAPYFYSYVFSELESILGEGAANEGNYIIETQLDPAIQSQAESALRNSVNNSGGNFNFSQGAVVTLDSSTGGILAMVGGTDYKKSQFNRAVQAKRQPGSTFKIFAYTAAIQQGISPSKSYSCAPLTWQGFTYKPCRSGAGSLDIATGLALSENPIALGVAREIGLNKVVAMAQNLGIKSNLDPVPGLVLGQSVVNVLEMTGAFGSIGNRGVWNPPHAINRILDSGDCSDRNDIKTCRVIYSFDQDPDANKRVLPNGVADEMTSLMRGVISRGTGRSAAIGLGEAGKTGTTDKNVDLWFIGFIPSRRLVTGVWLGNDNNSPTSGSSAQAAQLWGNYMRRITR

SEQ ID NO: 50218 - DNA, 1926 bp, Nostoc punctiforme PCC 73102
  CDS (1)..(1926)
atgtcatcctttaaaacttttgcagagaaacaatcacaagttcagactttacctacttctgagtttttgaaaaaggtcggtcaagtaactggtggcacactcctatcaattactatgctatcaagctccgtgctggctggagggttagttggtttagccattagtttccgcgatttaccagatgttagacaactacgaagctttgtaccttcagaaacaacttatatctatgatattaaaggcaagcttttaacacgtatacatggggaagctaatcgccaagtagtgcctttagatcaaatttccccaaatttaaaacgagctgtattagctagtgaagatagtcgcttttatgagcatcatggtattaatcccggtggtattggacgcgctgcattagtcaattttgcatctggggaagtgcgagagggtggttctacaatcaccatgcagttagtgaaaaatattttcttatctcaaaaacgtgcttttacccgaaaaatagcagaagcagtattagcaattcgcttagagcaagttcttagtaaagatgaaatattagaaatgtacctcaatcaagtttactggggtcataataactatggtgttcagacagcagcacgcacttattttaaaaaatcagcacaaaatttgaatctgggcgaatcagcaatgatggcgggtttaattcaagctccagaagaatttagcccgtttgtcagcatgaagctggcaaaacaaaaacaaaaagaagtattggggcgaatgttagacctgaattggattagccaacaagagtataatgatgccctcaaacaaaaaattaaacttggtcaaattaggtcatttcaaggtagcgctttgccttatattaccaacaccgtagctcaggaattaattaaaaagtttgggcgtgaaacattgctcaaaggaggaatgcaggtacaaactacagtagatactagcttccaaatgatggcagaaaaaactattaagaagtggcatcaaacccttgaacgtcagggattaaataataatcaaatggctctagtggcaattgatcctcgcacacattttgttaaagcactagtgggtggtgtagattcaaaaactagcgaatttaatcgagcaactcaagcccaccgtcagccaggatcttcttttaagccgtttgtttactatactgcttttgctagtggtaaatttacaccacgtacaacaatcctagatactccggttagttaccgtgatggtaacggttggtattctccccgaaactacgataatagctttatgggagcaataccagttcgcactgctctggctctgtctcgtaatattcctgcaatcaagattggcaaagctgtgggtatgaataaagttattgaaacttgccgtactttgggaattatgagtccaatgttacctgtgagttctttaccactaggtgcaatcggtgtgacaccgctagaaatggctagtgcttatgcgactattgctaattacggctggcgatcgcctccaacgattattgcccgtgttactgacggtagtggcaatgtgttaatagataatactcctcaacctcagcgagtgcttgacccttgggcatcagcagcaactttagacgtgatgcaaacagtagttagagaaggaactggtagaggtgcagatataggtcgtccagttgcaggaaagacgggtacaacctcttcagaaaaagatatttggtttattggtacagtaccgcagttaacaactgccatttgggtagggagggacaacaaccgacaattatctagccacgcgacaggcggaggtatggttgctcctatttggcgtgattttatgcagaaggcactcaaagatgtaccagtagaaaacttccagccaccttctaattttcctcgtccgaaatcaaattaa

SEQ ID NO: 50219 - protein, 641 aa, Nostoc punctiforme PCC 73102
MSSFKTFAEKQSQVQTLPTSEFLKKVGQVTGGTLLSITMLSSSVLAGGLVGLAISFRDLPDVRQLRSFVPSETTYIYDIKGKLLTRIHGEANRQVVPLDQISPNLKRAVLASEDSRFYEHHGINPGGIGRAALVNFASGEVREGGSTITMQLVKNIFLSQKRAFTRKIAEAVLAIRLEQVLSKDEILEMYLNQVYWGHNNYGVQTAARTYFKKSAQNLNLGESAMMAGLIQAPEEFSPFVSMKLAKQKQKEVLGRMLDLNWISQQEYNDALKQKIKLGQIRSFQGSALPYITNTVAQELIKKFGRETLLKGGMQVQTTVDTSFQMMAEKTIKKWHQTLERQGLNNNQMALVAIDPRTHFVKALVGGVDSKTSEFNRATQAHRQPGSSFKPFVYYTAFASGKFTPRTTILDTPVSYRDGNGWYSPRNYDNSFMGAIPVRTALALSRNIPAIKIGKAVGMNKVIETCRTLGIMSPMLPVSSLPLGAIGVTPLEMASAYATIANYGWRSPPTIIARVTDGSGNVLIDNTPQPQRVLDPWASAATLDVMQTVVREGTGRGADIGRPVAGKTGTTSSEKDIWFIGTVPQLTTAIWVGRDNNRQLSSHATGGGMVAPIWRDFMQKALKDVPVENFQPPSNFPRPKSN

SEQ ID NO: 50220 - DNA, 1932 bp, Nostoc punctiforme PCC 73102
  CDS (1)..(1932)
atgtcttcgtctaatacttttgtagagcagcagccaaaaactcggattgcacctaatttggagtttttgaaagaagtaggtcaagtagctggtgttactctcctctcaattactatgctggcaagttctgtgatttctggaggactggttggtttagcagttacttttcgtaacttgccagatgtcagacaactaaaaaacttcttcccagaagaaacaacttatatctatgacattaaaggtaagcttttagcaggtatacatggagaagctaatagaaagattgtaccgctagatgaaatttccccgaatttaaaacgagcagtattagcaagtgaagatagccacttctacaaccaccacggtattaaccccgtcggtattggacgtgctgcgttagtcaactggacagcaggtagtgtccgggaagggggttctacaatcaccatgcagttggtgaaaaatatatttctatctaagaagcgtgctttcactcgaaaaatagcagaagcggtactggcaatccggttagagcaaattcttgataaagaccagattttagaaatgtacctcaatcaagtgtactgggggcacaataactatggtgtacaaaccgcagcccgaacttactttgacaaatcagcagcaaatttaactctgggcgaatctgcaatgatggcgggtttaatccaagcgccagaggaatttagcccgtttgtgaatatgaaactggcaaaacaaaaacaaaaagaagtgcttcgacggatgctggaaatgaaatggattagccagcaagaatataatgatgctctccagcaagaaatcaaacttggcaaaatcagatcatttcaaggtagtgcccttccttatgtaaccaataccgtagcccaggaaataattaaaaagtttgggcgtgatgtcttgctcaaaggtggaatgcgggtacaaactacagtagatgccaacttccaactaatggcagaagaaactattaaggagtggcataaaaccctagaagggcgaggcttacataaaaatcaaatggctttagtagctatcgatccccggacgcactttatcaaggccctagtgggtggtatagattcaaaaaggagtgaatttaaccgggcaaatcaagcccagcgtcaacctggatctgcttttaagccatttgtttactatactgcttttgctagtggtaagtttacaccaagtacaacagtaatcgatgctccagttagctatcgagatggtgatggttggtactatccacgcaactacgatggtggctttatgggtgcaatgccgattcgtactgccttagcattatctcgtaatgtgcctgcggtcaagattggcaaagctgtgggtatgaatacagtcatcgacacctgccgtaccttgggaataaacagtccaatggttgccgtaagttctttaccattaggcgcaattggtgtaacaccactggaaatggctagtgcttatgccacctttgctaattatggctggcaatcacctccaacagctattgtccgtgttactgatagtagtggcaatgtattgttagacaatactcctaaacctcagctagttcttgacccttgggcatcagcctcattattagatgtgatgcaatcggtagttactgatggtactggtaaaggtgctgcactagataggccagttgctggtaaaacgggtacaacttcttcagaaaaggacatttggtttattggttctgtaccccagttaacaactgctatttgggtaggaagagatgataacaaacaattagccagtggtgccacaggtggaggtatggttactcccgtctggcgtgattttatgcagaaggcgcttaaggatgtaccagtcatgaaatttaaaccgccttctgaatttcctcgacctaagccagtcaaaatctag

SEQ ID NO: 50221 - protein, 643 aa, Nostoc punctiforme PCC 73102
MSSSNTFVEQQPKTRIAPNLEFLKEVGQVAGVTLLSITMLASSVISGGLVGLAVTFRNLPDVRQLKNFFPEETTYIYDIKGKLLAGIHGEANRKIVPLDEISPNLKRAVLASEDSHFYNHHGINPVGIGRAALVNWTAGSVREGGSTITMQLVKNIFLSKKRAFTRKIAEAVLAIRLEQILDKDQILEMYLNQVYWGHNNYGVQTAARTYFDKSAANLTLGESAMMAGLIQAPEEFSPFVNMKLAKQKQKEVLRRMLEMKWISQQEYNDALQQEIKLGKIRSFQGSALPYVTNTVAQEIIKKFGRDVLLKGGMRVQTTVDANFQLMAEETIKEWHKTLEGRGLHKNQMALVAIDPRTHFIKALVGGIDSKRSEFNRANQAQRQPGSAFKPFVYYTAFASGKFTPSTTVIDAPVSYRDGDGWYYPRNYDGGFMGAMPIRTALALSRNVPAVKIGKAVGMNTVIDTCRTLGINSPMVAVSSLPLGAIGVTPLEMASAYATFANYGWQSPPTAIVRVTDSSGNVLLDNTPKPQLVLDPWASASLLDVMQSVVTDGTGKGAALDRPVAGKTGTTSSEKDIWFIGSVPQLTTAIWVGRDDNKQLASGATGGGMVTPVWRDFMQKALKDVPVMKFKPPSEFPRPKPVKI

SEQ ID NO: 50222 - DNA, 2424 bp, Nostoc punctiforme PCC 73102
  CDS (1)..(2424)
ttgattgatagtggttatataagttactactttgagcgaggaactgacgtggggaagcttacctcctggttcaagcgaagaccaactaatttgagtgactctgaacaaggaggaacgaatgagagcttaccatcagcacatctggcgcaggcgaggcagttactgagcaaaatgaaaattttaccatctagggttaaggtcaatcaggcaactggcggtaaaccactctatcgtcgcttatggttttgggcaggcttgggtataggtggtgggatagttgcctcgatctacggcatcagtctaatagaccgcacgttgccagatcaggccgagttaaacgccgtgctgagagagcaaacactgaccatcaaagctgctgatggaactatattacaacaacaaggtgaagctaccagagaacagctcaagctagaacaaataccagataatttaaaaaaagctttcattgcctcagaagatagaagatttaggcaacacaacggatttgacccgcaagggattgtcagagcgggtttgaataatttgcgatcgcaaggtgtggtagaaggtggtagcaccatcacccaacagttaacgcggattctctttttgaaacaagaacagacaatctggcgcaaactcaaggaagtccgcctagcacaaaaaatggagcatgaattaaccaaagatcagattctagagcgttacctgaatctggtttatttgggaggtggagcttatggtgtggcagatgccgcctgggtatactttagtaaatcgccagaccagcttacccttgcggaaatggcaacgatcgccggattagcccccgctcctagcttatacgccccagacaagaatcccgaagcggcaatccggcgaagaaatctggtattgcaacggatgcaagaggatggagtgattacaccagagcaaaggcaagcagcactccaagaaccactaacccttaaaagcagtttacccaagcgagtacaagtagaatcaccatactttaccagctacattcaaaaagaattgccgaagtacgttcctgctaaagtgctggcaagtgagggattagttgtggaaaccacgctgaacccgacttggcagaaagttgcagaagaggcggttgccaaaacgctgcgaaatcaggggcgctgggagaactttaaacaagcagcaatggttgccattgacccccggagcggtgaaattaaggcaatggttggaggaaaagactttggtaaaaaccagtttaatcgagttacccaggcacaacggcagccaggatcgacatttaaagggtttgtatatgccactgcgatcgctagcggtaaaagcccctatgatagctacgaggatgcaccctttgtagtagatggctacgaaccgaaaaactatagtgaaagatttcggggttcaatgaatatccgagatgctctcacccgctctattaatattattgcggtgaaggtgttgattgatgtcggatttacgccgacgattaaacttgcccatgatatgggaataaaatctgaactcaagcccacctactccttggctctcggctcaaatgaagtaaatctactggagttgaccagcgcttatggcagttttgcaactcagggattgcacacagaacctcatggtattacccgcatcctcaatcgccaaggtaaggtaatctggtcagctaatttcaaatctaaacgcgccctcgactctgacagtgccgctatcatgacttggatgctacgtaacgtcgtagaagaggggactggtgctgctgcccaattaggtaatagaccagttgctgggaagactggcacctcagacgaagcccgcgatttgtggtttattggctacattccccagatggtgacaggggtctggctaggtaatgatgataaccgccccacttatggtagtagtggcagcgccgcttacacctggcacgaatttatggaaaaagcggcagaggggatgcctgtcgaaaagtttcctaaacgtcccaagctagaaggccgcaaaggtaccatcaaagctcagtcaatcaagcccaaacaagtgctgaatcgttctattgactctgatgatgactcagaaggggaaaaggctagaaattctgatgatagcggttcatctaggagacgtagaaggaggaggagctattctcaagaagaacagcaatcaagcgattctaccccaagacggagaaggcgcgatcgcagtgaagaatcaaattctagtaactcttcttcagaatcatctactcctcggcgacgctctagaagagtagaatctgactctcccccggctcccagaactcgccgatcttcctctcccgacaatagttccggttcttccggttcttcatcgccacaaccatcctggcgcgagagacttagaccttctaattaa

SEQ ID NO: 50223 - protein, 807 aa, Nostoc punctiforme PCC 73102
MIDSGYISYYFERGTDVGKLTSWFKRRPTNLSDSEQGGTNESLPSAHLAQARQLLSKMKILPSRVKVNQATGGKPLYRRLWFWAGLGIGGGIVASIYGISLIDRTLPDQAELNAVLREQTLTIKAADGTILQQQGEATREQLKLEQIPDNLKKAFIASEDRRFRQHNGFDPQGIVRAGLNNLRSQGVVEGGSTITQQLTRILFLKQEQTIWRKLKEVRLAQKMEHELTKDQILERYLNLVYLGGGAYGVADAAWVYFSKSPDQLTLAEMATIAGLAPAPSLYAPDKNPEAAIRRRNLVLQRMQEDGVITPEQRQAALQEPLTLKSSLPKRVQVESPYFTSYIQKELPKYVPAKVLASEGLVVETTLNPTWQKVAEEAVAKTLRNQGRWENFKQAAMVAIDPRSGEIKAMVGGKDFGKNQFNRVTQAQRQPGSTFKGFVYATAIASGKSPYDSYEDAPFVVDGYEPKNYSERFRGSMNIRDALTRSINIIAVKVLIDVGFTPTIKLAHDMGIKSELKPTYSLALGSNEVNLLELTSAYGSFATQGLHTEPHGITRILNRQGKVIWSANFKSKRALDSDSAAIMTWMLRNVVEEGTGAAAQLGNRPVAGKTGTSDEARDLWFIGYIPQMVTGVWLGNDDNRPTYGSSGSAAYTWHEFMEKAAEGMPVEKFPKRPKLEGRKGTIKAQSIKPKQVLNRSIDSDDDSEGEKARNSDDSGSSRRRRRRRSYSQEEQQSSDSTPRRRRRDRSEESNSSNSSSESSTPRRRSRRVESDSPPAPRTRRSSSPDNSSGSSGSSSPQPSWRERLRPSN

SEQ ID NO: 50224 - DNA, 2361 bp, Nostoc punctiforme PCC 73102
  CDS (1)..(2361)
atgaaactaattttacgatcgctactccaaattaaacacagtagcaaatttatcctagctgtgctggtaatctgcctgattatacgcttattaccgtattttgcgcccgttcgagccgcagatattgcccaaaatcaactggcaatgcaatttagcgatcgcaatggtttaccattaggaacattgctcacccgtgaccaagaacatacatcagtcgtaccgctaaatcaagtttcgccccagtttatccatgctattttagccgccgaggatggcagcttttaccatcacggcgcgttggatatgaaagctgttatccgcgccagcaaagaagctatccacgcgaaacgaattgtttccggcgcttccactattactatgcaactgtcacggatgttagatcccgtcccccgcagcttttctggtaaactgcaagagatttggctatcttggcggttaacagcagggatgaataaagatgaaattctctctgcatatattaatcggctaccaatgggcgggaatatatatggtgtggaagcagccgcgcagacttatttttccatcccagcgagtgagttaaatcttgctcaagctagtttgttggctgctatccccaataatcccacatattttaatccttatgaacattgggaacggttgaagcagcgacaaaaatacgtcctcaatcgtatggtagaggaaaaatatattagtggagcgatcgcagcagcccgaacacaaaccgaaaaagttgtgtttcagtctcgcccacgaggaattatcgccgcaccacactttttattttggttagccaatcaaatccccccaactcctcttgaaaagcaaggctggggagataaatccgttattcgcacaactataaatcgccctttacagcagtttgtagaagcacaggtgcagcaggtgatttcttccctagccgctaataatgttcatgatgcagctgcgttggtaattgacaaccacactggtgaggtattggcttatgtcggttcgcctgattactttaatcaagcaaaactaggacgcaatgatggagtgcaagcgctacgtcaacctggttctaccctcaagccttttgtttatgaattagctttagaaaaaagtttaattcgcccaaataccattttggcagatgttcccgcccgttatgcaattcccggcgcgagactttacagcccaaccgattacacggaacgctttcttggccctgtgcgggtgcgaatcgccttagcaaattcgttgaatgtacccgcagtcagggttttagaaaaagtaggtgtgcagacttttttagaacgattgcatcaacttgggtttgaaaatctcaatcaaaccccagaacattacggtttagggttaactctcggtagcggcgaagtcagtttatgggaactagctagagcttacgttactatggcacgacttggagagtctatccctttagtaagcacattttctgattctccaatccaaaattcaagttgcgctgaaagcgcaccaaatatgcgatgtaatatccaaaattcaacgacgatatggcaattaattactaacatactcagtgataatcatgctcgtgccacagcatttggtgtaaactctgtgttaaatttaccctttcctgttgccgttaaaactggcacttcttccaattttcgtgatacttggacagttggcttcactactgattacaccgtcgctacttgggtaggcaatttcaatggcgaaccgatgcgacaagtttcaggtgtgacaggggctgcacccttgtggaatcggattatgttacacctgcacgaacatcaagaaccagcagcttttccacctccagaaggtttaatacaattacctatttgtgcaatttcgggattacggccgacatcagattgtacctcagttgtgcaggaatatttctatccagaagataaaattgcctacgaaggtaacaatcaatttaacttaccaccagagtataacgagtggttggcaaaacaacagcaatcgagtcttgtttctaccaatttgagaattttgtccccgcatcatggcgacttatttttactgtatccaggtgaagaaacgaagcaaaaactcgaatttaagctagcgggaaataaatctgcacctgttgaatggtggctcaatggtgaaaagttagatacaaattcagctaattctttattttggaatttacgtcctggtaagtggactttggaagcaagaagcggtgaaatgaatgacaaggtaagttttcaggtgaaattagctaatattaaacccacgcgtcgaggattttctattagtaattctcaggtaaaggggaatcacccataa

SEQ ID NO: 50225 - protein, 786 aa, Nostoc punctiforme PCC 73102
MKLILRSLLQIKHSSKFILAVLVICLIIRLLPYFAPVRAADIAQNQLAMQFSDRNGLPLGTLLTRDQEHTSVVPLNQVSPQFIHAILAAEDGSFYHHGALDMKAVIRASKEAIHAKRIVSGASTITMQLSRMLDPVPRSFSGKLQEIWLSWRLTAGMNKDEILSAYINRLPMGGNIYGVEAAAQTYFSIPASELNLAQASLLAAIPNNPTYFNPYEHWERLKQRQKYVLNRMVEEKYISGAIAAARTQTEKVVFQSRPRGIIAAPHFLFWLANQIPPTPLEKQGWGDKSVIRTTINRPLQQFVEAQVQQVISSLAANNVHDAAALVIDNHTGEVLAYVGSPDYFNQAKLGRNDGVQALRQPGSTLKPFVYELALEKSLIRPNTILADVPARYAIPGARLYSPTDYTERFLGPVRVRIALANSLNVPAVRVLEKVGVQTFLERLHQLGFENLNQTPEHYGLGLTLGSGEVSLWELARAYVTMARLGESIPLVSTFSDSPIQNSSCAESAPNMRCNIQNSTTIWQLITNILSDNHARATAFGVNSVLNLPFPVAVKTGTSSNFRDTWTVGFTTDYTVATWVGNFNGEPMRQVSGVTGAAPLWNRIMLHLHEHQEPAAFPPPEGLIQLPICAISGLRPTSDCTSVVQEYFYPEDKIAYEGNNQFNLPPEYNEWLAKQQQSSLVSTNLRILSPHHGDLFLLYPGEETKQKLEFKLAGNKSAPVEWWLNGEKLDTNSANSLFWNLRPGKWTLEARSGEMNDKVSFQVKLANIKPTRRGFSISNSQVKGNHP

SEQ ID NO: 50226 - DNA, 2325 bp, Haemophilus somnus 2336
  CDS (1)..(2325)
atggctgcgaaacaaaaacgaaatacaactcaaccaaaaaagaaaaataaaaaacaacggttgtttatttttagtgcaaaacttggttttactctattatgtggaattgcattttacggtatttatttagacggaaaaatccgcaataaaatggatggtcaaatttggcagttacccgccgaggtttatagccgtattgaaaacatacgtttatctgatcaactgaatctggaacaaatcaaacaagcactgttagaaaatgaatatcgccaaacgaccatgcttgccacgcccggtgattttaaaattgaaaataatactttggttattttacgcagagccttccctttcccaagtcaacctgaagcacaacgcctttttcgcctacgttttaataatgataataaactttctatcattgaagacctgatcaatgtaaaaaccatcagtgagtttcgtcttgatccaaaacttattgcgatgttgcaatcagatagagaagaacgtctagctattccgctacaacattatccaagattattgatcgatactttacttttaaccgaagatcgcaatttttatgaacatgatggaataagtttgcttggcattattcgtgctttaattaccaacatcaaagcaggacataatgtacaaggcggaagtacactgacacaacaactggttaaaaatttatttttaagcaacgaacgcacattaagccgtaaaatgaatgaagcattaatggctttgattttagattttcgttacgataaaaatcgcatattagaaacctatcttaatgaaatttatttgggacaaaatggcagcacacaaattcatggatttgaattggcaagccatttttattttgggctacctgttcgggaaatcagtttggatcagattgccttgttggttggcatggtaaaaggtccttcactatacaatccttggcgtaaccctcaaaaggccttagaacgtcgtaatgttgtattaaaattaatgctcaatcataaaatgattagtaatgaactctatgacttactcagtaaacgtcctctcggcgtacaaaaaagaggacaaattaaccgcaagtatccggcatttattcaaactctacagcaagaattaagaagcaaactgggcgaaaacaaactttcctctttatccggtgcaagaattttctctactttggatccgaaacaacaagaacatgcagaaaaatccgtgataaaagcagtctcagaattacagcgaaaatataaaaatccacatttagaaagtgcgatgattattgctgattataaaatgggtgaagtaaaagccattgttggtggtttacagacaaactatgcgggatttaaccgtgctttacacgctcgtcgccaaattggttccttagttaaaccgtcaatttacttagcggcgttatctgatcctgagcaatttcgccttaatacgcttattcaaaatcagcctattacaattcgtatcaaaggaactcagccatggcagcctcgtaactacgatagaaaatacagtggttccgtcatgctaatagatgcacttgttcgctcgctcaatattccaacagttaatattggtatgaaagtaggcttaaacaaagtaattgaaatgcaaatggcaatgggttgggataatgtaaaaatacctaacgtgccttcaactttgttaggtagttactctatttccccttatgaggttacagaattattccaaactattgccaatgaaggaaaacatattccgttgtcaactcttgacagtattacagacaagcaggggaatctgatttaccaacgttcaataatgccacaacaagtcgttccccaagaagcagctttccaaaccttatttgctatgcaacaagtcgttgaacgagggacagctcgtagcttacaaaatcaatacgcttcacttaaacttgccggaaaaacaggtacaacaaatgaatcaagagatacttggtatgttggtattgatggtgagaatgttgttactgtatggttagggcgagatgataatgtaacaacaaaattaaccggtgcgagtggtgcattaaaaatctatcaagattatttatctcgtgctgaaataaaaatgttaaatccacaaacaccagctaaaattgaatggattggtatagactcttatggaaactggaattgctcaagtcctaaaaagcttcctgtttggataaataacgatcaatttttttgtaatgacattcccgaagagccaaagccatctatttgggatgttctatctgcacctgttgaagaggctaaaccaagcccataa

SEQ ID NO: 50227 - protein, 774 aa, Haemophilus somnus 2336
MAAKQKRNTTQPKKKNKKQRLFIFSAKLGFTLLCGIAFYGIYLDGKIRNKMDGQIWQLPAEVYSRIENIRLSDQLNLEQIKQALLENEYRQTTMLATPGDFKIENNTLVILRRAFPFPSQPEAQRLFRLRFNNDNKLSIIEDLINVKTISEFRLDPKLIAMLQSDREERLAIPLQHYPRLLIDTLLLTEDRNFYEHDGISLLGIIRALITNIKAGHNVQGGSTLTQQLVKNLFLSNERTLSRKMNEALMALILDFRYDKNRILETYLNEIYLGQNGSTQIHGFELASHFYFGLPVREISLDQIALLVGMVKGPSLYNPWRNPQKALERRNVVLKLMLNHKMISNELYDLLSKRPLGVQKRGQINRKYPAFIQTLQQELRSKLGENKLSSLSGARIFSTLDPKQQEHAEKSVIKAVSELQRKYKNPHLESAMIIADYKMGEVKAIVGGLQTNYAGFNRALHARRQIGSLVKPSIYLAALSDPEQFRLNTLIQNQPITIRIKGTQPWQPRNYDRKYSGSVMLIDALVRSLNIPTVNIGMKVGLNKVIEMQMAMGWDNVKIPNVPSTLLGSYSISPYEVTELFQTIANEGKHIPLSTLDSITDKQGNLIYQRSIMPQQVVPQEAAFQTLFAMQQVVERGTARSLQNQYASLKLAGKTGTTNESRDTWYVGIDGENVVTVWLGRDDNVTTKLTGASGALKIYQDYLSRAEIKMLNPQTPAKIEWIGIDSYGNWNCSSPKKLPVWINNDQFFCNDIPEEPKPSIWDVLSAPVEEAKPSP

SEQ ID NO: 50228 - DNA, 2541 bp, Haemophilus somnus 2336
  CDS (1)..(2541)
atgaggatcgcaaaattaatatttagtaccttactaacgttgattattttagggtgtgttgtagtcggtattttttacattcagataaagaaagatttgcccagtgttgatggtttaaaaacagttgagttacagcaacccatgcaaatttatactgctgatggaaaattgattggtgaagtaggggagcagcggcgtattccggttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacctaaataaaatttatttcggttaccgtgcttatggcgttgcggcagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgtggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacaattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattccaatccatttattcctgctgctgttctgtccataagtaaaatgggcgctaacttgttgttagcggatggtaagaatattactttatctaacaatgcgatgcgttgggcgggtaaaaaaatgcctaaagagggcgatcaaatttgggtaagacaacagaataaagaatgggttttagggcaaattccggaagctaattctgcattagtttctcttaatagtgataatggtgctattgaagcgttagttggcggttttagttttgagcaaagtaaatttaatcgtgctacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggagaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgctaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttaataaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagaacacttcaagcgtcgtgatattggcggaaaaacgggtacaaccaataattctaaggttgcatggtatgcgggatttggtgcaaatctagccactgtggtatatgtcggatttgatgataataaaaggagtttagggagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatattttattagaggtacggaacctaaaagaacattcgttcaacaaggacgtggttactaccttccttctgaaacggatctgccaagtgcggaaccggaagaaattttctaa

SEQ ID NO: 50229 - protein, 846 aa, Haemophilus somnus 2336
MRIAKLIFSTLLTLIILGCVVVGIFYIQIKKDLPSVDGLKTVELQQPMQIYTADGKLIGEVGEQRRIPVKLQDIPQKLIEAVLATEDNRFYEHHGLDPIGIARAISVAISKGNASQGASTITQQLARNFFLTPEKNLVRKIKEAILAIEIEHVLTKDEILELYLNKIYFGYRAYGVAAAAKTYFGKELSQLTLSEMAVIAGLPKAPSTMNPISSLKRAQDRRNVVLGRMLETNYISKAEYDVAISEPIVASYHGTQLEFRADYVSEMVRQEMVRRFGEEQAYTKGYKVFTTILSKDQAQAQKALRENLIAYDIRHGYRGAVTLWKKNEKAWETEAIVAHLKSLPNSNPFIPAAVLSISKMGANLLLADGKNITLSNNAMRWAGKKMPKEGDQIWVRQQNKEWVLGQIPEANSALVSLNSDNGAIEALVGGFSFEQSKFNRATQSLVQVGSSIKPFIYAAALEKGLTLSSVLLDSEIVIQKPGQEPWTPKNSPNRYDGPTRLRVGLGLSKNMIAIRAIQMAGVDFSAEFLQRFGFKSENIFASEAMALGAASFTPLEMARAYAVFDNGGFLVDPYLIEKIQDNMGNDVFIANPKIACITCHDIPVIYGETEKLDGFKENTSISDNANALDLGGEEVSEITDIPELNTVNKKLDESAVLFMAEAKTEHSTEQYAPRVISGELAFLIRSALTSAVFGEEGLDWKGTSWRMAEHFKRRDIGGKTGTTNNSKVAWYAGFGANLATVVYVGFDDNKRSLGRGETGSATAMPAWISYMKFSLNDIPERKLALPPNIVEKNIDVRSGLLAETGEGKIEYFIRGTEPKRTFVQQGRGYYLPSETDLPSAEPEEIF

SEQ ID NO: 50230 - DNA, 2403 bp, Actinobacillus pleuropneumoniae serovar 1 str. 4074
  CDS (1)..(2403)
atgtcaaacaaccaaactcaaacaccggaacaagacgaaactccgtcaaagaaaaagccgttttttattccgacctgccttaaattagggcttgtcggcgcttgctttgccgcattctacgggatttatctcgacggacgtattcgagcgaaaatggacgggcaagtttggcaattacctgcagaagtttatagccggattgaaagtgtcagcgttgaagataaattatcgcttgaagcgatcaaacaagtgttattggataacggttatcgccaggtttctcaaattgcgacgccgggcgatttcaaaattgaaaacaatacgcttgttttattacgtcgtgctttcccgtttcctgaaacaccggaagcacaacgtattttgcgtttacgttttgacaacgacaaactgacgcatatcgaagatttagttcagcgtcgattaattaacgagtttcgacttgacccgaaattaattgcaatgctgcattcggataatgacgaagaacgccaagcgttacgtttgcagcaatacccgtatttccttattcaagcgttaattctaaccgaagataagcgtttctatcagcacgacggtatcagcccgctaggcattgcgcgagccttaatggcaaactatcaggcgggcagaacggtacagggtgcgagtacgcttactcaacaattagttaaaaacctgtttttaaccagcgaaaaaaccatcgtgcgtaaagtgaatgaagcgttaatgtcgctcattttggattttcgctacgataaaaaccgcattcttgaaacttacttaaacgagatttatttaggtcaaaacggtagctatcaagtgcacggatttgccttggcaagccaattctatttcggtcgtccgattcaagaaatcaccccgtcacaaatggcgttattggtcggtatggtgaaaggaccttcgctctataatccgtggcgacatccggaagccgcacttgaacgtcgtaatgtggtgttaaaattattactagaaaaccaagcgattacccagccggagtatgaattattggtaaaacaaccgctcggcgtaaaagaaaaaggcacgatttaccgccaacaaccggcatttatgcaagcgttaaatcttgatctaaaagcggaactcggcgaaagcaaatatgcgcagctttccggtgcgaagatttttacgacattagacagaaagcagcagcgttcggcggaacaggcggtaattaacggattggaaaaactggaagagtcgaatagtaaaatcagagatttacaatccgcaatcgtagtggcggaatataaaaccggtaaagtgcgtgcgattgtcggcgaccgtttaacccaatttgccggttttaaccgtgcgattcagactaaacgccaaatcggttcattggtcaaaccttcgatttatgcgatcgcgctttcggatccgaagaatttccgtttaaatacgccgatccaaaaccaaccgatcaccatttataccaaaggctctccgccttggacaccgaaaaactatgataaacgctttagcggttcggtcatgttaatggatgcgttagtgcgctcgttaaatattccgaccgtgaatatcggtatgaaagtcggcttaaagaacgtgattgcgaagcaaaaagagatgggttgggataaagccgatattccggcgtatccttcgatgttgctcggttcgtactctatttcgccgtatgatgtgaccaagtcttatcaagtattggcaaataacggtttaaaaacaccgcttacgacgattgaagccattatgtcgcatgacggtagcctgctttaccagcgcaataccgaagaagtcagccgccaagtattaccgcaagaggcaacaattcaaacactatatgctatgcaacaagtggtagaacgaggtacggctcgcagcttacaaaacgaattcgctcatttacgtttagccggaaaaaccgggacgaccaataatgcgcgcgatacttggttcgtcggagtggacggtgaaaacgtcaccaccgtatggttagggaaagataataataccgataccaatttaaccggttccagcggtgcattgttcgtgtataaacaatatttggaacgtgctttaccgaccgcgtttaaattgccaaaagcgaaaagtatgcaatgggtgggcatcaatggctacggtacgattaattgcgatccgaaccgtcaaattccaatgtggcgagatcggggacagcactactgtactaatgccggtaatgtggtcgaagccgccaaaccgaccgtattggaagcgatttcattagataaaaccaaaacggaaaataccaaagccgatgtggctgcggatcaacaagtcttaccggcggaagaaatcgcaccgaccgaataa

SEQ ID NO: 50231 - protein, 800 aa, Actinobacillus pleuropneumoniae serovar 1 str. 4074
MSNNQTQTPEQDETPSKKKPFFIPTCLKLGLVGACFAAFYGIYLDGRIRAKMDGQVWQLPAEVYSRIESVSVEDKLSLEAIKQVLLDNGYRQVSQIATPGDFKIENNTLVLLRRAFPFPETPEAQRILRLRFDNDKLTHIEDLVQRRLINEFRLDPKLIAMLHSDNDEERQALRLQQYPYFLIQALILTEDKRFYQHDGISPLGIARALMANYQAGRTVQGASTLTQQLVKNLFLTSEKTIVRKVNEALMSLILDFRYDKNRILETYLNEIYLGQNGSYQVHGFALASQFYFGRPIQEITPSQMALLVGMVKGPSLYNPWRHPEAALERRNVVLKLLLENQAITQPEYELLVKQPLGVKEKGTIYRQQPAFMQALNLDLKAELGESKYAQLSGAKIFTTLDRKQQRSAEQAVINGLEKLEESNSKIRDLQSAIVVAEYKTGKVRAIVGDRLTQFAGFNRAIQTKRQIGSLVKPSIYAIALSDPKNFRLNTPIQNQPITIYTKGSPPWTPKNYDKRFSGSVMLMDALVRSLNIPTVNIGMKVGLKNVIAKQKEMGWDKADIPAYPSMLLGSYSISPYDVTKSYQVLANNGLKTPLTTIEAIMSHDGSLLYQRNTEEVSRQVLPQEATIQTLYAMQQVVERGTARSLQNEFAHLRLAGKTGTTNNARDTWFVGVDGENVTTVWLGKDNNTDTNLTGSSGALFVYKQYLERALPTAFKLPKAKSMQWVGINGYGTINCDPNRQIPMWRDRGQHYCTNAGNVVEAAKPTVLEAISLDKTKTENTKADVAADQQVLPAEEIAPTE

SEQ ID NO: 50232 - DNA, 2325 bp, Pseudomonas aeruginosa UCBPP-PA14
  CDS (1)..(2325)
atgacgcgtccccgatccccccgttcccgtaacagcaaagcacgcccggcacccggcctgaacaaatggctcggctgggccctcaagctcggcctcgtcggcctggtgctcctcgccggcttcgccatctatctcgatgccgtggtgcaggagaaattctccggccggcgctggaccatcccggcgaaggtctatgcccgcccgctggagctgttcaacggcctgaagctgagcagggaagacttcctgcgcgaactcgacgccctcggctaccgtcgcgagcccagcgtgagcggccctggaaccgtgtcggtggcggccagcgcggtcgaactcaatacccgtggcttccagttctacgaaggcgcggaaccggcccagcgcgtgcgcgtgcgcttcaacggcaactacgtcagcgggctgagccaggccaacggcaaggaactggcggtggcgcgccttgagccgctgctgatcggcggcttgtatccggcgcaccatgaggatcgcatcctggtcaagctcgaccaggtgccgacctacctgatcgacaccctggtcgcggtcgaggatcgcgacttctggaaccaccatggcgtgtcgctgaagtccgtggcccgggcggtgtgggtcaacaccacggccggccagctgcgccagggcggcagcaccctgacccagcagttggtgaagaacttcttcctgagcaacgaacgcagcctgagccgcaagatcaacgaagcgatgatggcggtgctgctggagctgcactacgacaagcgcgacatcctcgagtcctatctcaacgaggtgttcctcggccaggatgggcaacgagcgatccatggcttcggcctggccagccagtatttcttcagccagccgctggccgagctcaagctcgaccaggtggcgctgctggtcggcatggtcaagggaccgtcctacttcaacccgcggcgttacccggatcgtgcgctggcgcggcgcaacctggtgctcgatgtgctcgccgagcagggcgtggcgacccagcaggaagtcgacgccgccaagcagcgcccgctcggcgtgacccggcagggcagcatggccgacagctcctatccggccttcctcgacctggtcaagcgccagttgcgccaggactaccgcgacgaggacctgaccgaggaagggctgcgcatcttcaccagcttcgatccgatcctgcaggagaaggccgagacctccgtcaacgaaacgctcaagcgcctcagtgggcgcaagggagtcgaccaggtcgaggcggcgatggtcgtgaccaatccggaaaccggcgagatccaggccctgatcggcagtcgcgacccgcgcttcgccggcttcaaccgggccctggacgcggtgcggccgatcggttcgctgatcaagccggcggtctacctgaccgcactcgagcggccgagcaagtacaccctgaccacctgggtgcaggacgaacccttcgcggtgaaaggccaggacggccaggtctggcgaccgcagaactacgaccggcgctcgcatggcacgatcttcctgtaccagggcctggcaaactcctacaacctgtccaccgccaagctcggcctcgacgtcggtgtgcccaacgtgctgcagaccgtcgcccggctgggcatcaaccgtgactggccagcctatccgtcgatgctgctgggcgccggttcgctcagtccgatggaggtcgccaccatgtaccagaccatcgccagcggcggcttcaacacgccgttgcgggggatccgcagcgtcctcactgccgacggccagccgctcaagcgctatccgttccaggtcgaacagcgcttcgactcgggcgccgtctacctggtgcagaacgccatgcagcgggtcatgcgcgaaggcaccgggcggtcggtgtacagtcaattgccgtcgtcgctgaccctcgccggcaagaccggcaccagcaacgactcgcgcgatagctggttctccggtttcggcggcgacctccaggctgtggtctggctcggtcgcgacgacaacggcaagacgccgcttaccggcgccaccggtgccttgcaggtgtgggccagcttcatgcgcaaggcgcatccgcaatcgctggaaatgccgatgccggagaacgtggtgatggcctgggtcgacgcgcagaccgggcagggctcggcggcggattgcccgaatgccgtacagatgccctatattcgtggcagcgagcccgcccagggcccaggctgcgggagccagaaccccgccggcgaggtgatggactgggtacgaggctggctgaattga

SEQ ID NO: 50233 - protein, 774 aa, Pseudomonas aeruginosa UCBPP-PA14
MTRPRSPRSRNSKARPAPGLNKWLGWALKLGLVGLVLLAGFAIYLDAVVQEKFSGRRWTIPAKVYARPLELFNGLKLSREDFLRELDALGYRREPSVSGPGTVSVAASAVELNTRGFQFYEGAEPAQRVRVRFNGNYVSGLSQANGKELAVARLEPLLIGGLYPAHHEDRILVKLDQVPTYLIDTLVAVEDRDFWNHHGVSLKSVARAVWVNTTAGQLRQGGSTLTQQLVKNFFLSNERSLSRKINEAMMAVLLELHYDKRDILESYLNEVFLGQDGQRAIHGFGLASQYFFSQPLAELKLDQVALLVGMVKGPSYFNPRRYPDRALARRNLVLDVLAEQGVATQQEVDAAKQRPLGVTRQGSMADSSYPAFLDLVKRQLRQDYRDEDLTEEGLRIFTSFDPILQEKAETSVNETLKRLSGRKGVDQVEAAMVVTNPETGEIQALIGSRDPRFAGFNRALDAVRPIGSLIKPAVYLTALERPSKYTLTTWVQDEPFAVKGQDGQVWRPQNYDRRSHGTIFLYQGLANSYNLSTAKLGLDVGVPNVLQTVARLGINRDWPAYPSMLLGAGSLSPMEVATMYQTIASGGFNTPLRGIRSVLTADGQPLKRYPFQVEQRFDSGAVYLVQNAMQRVMREGTGRSVYSQLPSSLTLAGKTGTSNDSRDSWFSGFGGDLQAVVWLGRDDNGKTPLTGATGALQVWASFMRKAHPQSLEMPMPENVVMAWVDAQTGQGSAADCPNAVQMPYIRGSEPAQGPGCGSQNPAGEVMDWVRGWLN

SEQ ID NO: 50234 - DNA, 2259 bp, Fusobacterium nucleatum subsp. vincentii ATCC 49256
  CDS (1)..(2259)
atgaaaaaaatacttattcttttattaaaacttataggagcattatttattgtaggagcaataggagtttttgcaataattataaggtacagattggaattaccgaatatgcaaagtatggttgaggactataaacctcaaatggcgacaataatttatgacaaaaataataatgttgtggataccttatctgttgagtcaagggaaattgctaaacttgaagatatttctccctatgtaaaagatgcttttttatctattgaagataaacaattttattctcatcatggtttaaattttagagggataacaagagcagttattacaacttttttaaaaggaagaccaacacaaggtggaagttctataactcaacaattagctaaaaatgcttttttaacacctgaaagaacattttcaagaaaggtaaaagaagcaattttaacttatcaaatagaaagaacttacacaaaagatgaaatcttagaaagatacttaaatgaaatatactttggttcaggttcttatggtataagaaatgcagcagaacaatatttcaaaaaagatgttaaagacttaaatgttgcagaagctgctttacttgctggtatcccaaatagacctacaaagtatgatccaaatagaaatttggaaaatgctttacatagacaaaaaattattttaaaagaaatgtatgatgatggaagaattacaaaagagcaatatgatgaagccttagcatataaatttgagttagaaaatgaagataatataaaaaatgttcctaaaaatacttcaataatttataatagaagaactaaaaatacatataaaaatcctgagcttacaacgatagttgaagattacttagcagaaatttatgatgaagaacaaatttatacttctggtttaaaaatttacacaactattgacttagattatcaaaaagtagctaaggaaacttttaatagctatccatattttaaaaataaagaaataaatggagctatgattactcttgatccattcactggtggaatagtatcaatagttggtggaaaaaattttaaagctggtaattttgatagagcaactatggcaagaagacagttaggatcatcatttaaaccatttgtttatttggaagctttggaaaatggttttacaccttattctgttgtagtaaatgactttgttgcttttggaaaatgggcacctaaaaattttgatggcagatacagttataattctactcttgtaaattcattgaatttatctctaaatgtcccagcagtaaaattattagatgcagtaactgttgatacttttaaagaagctattggagataatataaaattatcatcagaagttaaagatttaactgctgcacttggttcagtagatagtacaccagtaaatgttgcagctaacttctctatctttgtaaatggtggttatatagtaaaacctaatattataagagaaattagagataatcaagacatacttatttatgttgcagaaatagaaaaaacaaaagtttttgatagtgttgatgtaagtgtaataacagctatgttaaagacagttgtaagtaatggtactgcttcaaaagcaagagttgttgataaaacaggtaaacctatacaacaaggtggaaaaacaggaacaacaaatgaacacagaacagcttggtttgttggaattactcctgaatatgttactgcttgttatataggtagagatgataataaacctatgtatggtaagatgacaggaggaagtgctgttgcacctatgtgggcaaaatattatcaaactcttataaataaaggattatatactcctggaaaatttgaatttttagaaaactatttagaaactggtgatttagtaaaacaaaatattgatatatattcaggtttattagatggtcctaatagtaaagaatttactgtaagaaaaggtagacttcaagttgaaagtgcaggtaaatataaaaatggtattgcctctgtatttggtttagatggaaatgtaacaagtggagcaggtattgatatgtctgagggaatgataattgatactggtagtgaagaaggtacagttacagaaggaagtacaggtgaggaaactactcaaactcctcatacaaatacacctactacttcaacaggaggaaatactccacctgttcaaaacaataattctaataataaagatggagatagcctaacaaatagacttttaggagattaa

SEQ ID NO: 50235 - protein, 752 aa, Fusobacterium nucleatum subsp. vincentii ATCC 49256
MKKILILLLKLIGALFIVGAIGVFAIIIRYRLELPNMQSMVEDYKPQMATIIYDKNNNVVDTLSVESREIAKLEDISPYVKDAFLSIEDKQFYSHHGLNFRGITRAVITTFLKGRPTQGGSSITQQLAKNAFLTPERTFSRKVKEAILTYQIERTYTKDEILERYLNEIYFGSGSYGIRNAAEQYFKKDVKDLNVAEAALLAGIPNRPTKYDPNRNLENALHRQKIILKEMYDDGRITKEQYDEALAYKFELENEDNIKNVPKNTSIIYNRRTKNTYKNPELTTIVEDYLAEIYDEEQIYTSGLKIYTTIDLDYQKVAKETFNSYPYFKNKEINGAMITLDPFTGGIVSIVGGKNFKAGNFDRATMARRQLGSSFKPFVYLEALENGFTPYSVVVNDFVAFGKWAPKNFDGRYSYNSTLVNSLNLSLNVPAVKLLDAVTVDTFKEAIGDNIKLSSEVKDLTAALGSVDSTPVNVAANFSIFVNGGYIVKPNIIREIRDNQDILIYVAEIEKTKVFDSVDVSVITAMLKTVVSNGTASKARVVDKTGKPIQQGGKTGTTNEHRTAWFVGITPEYVTACYIGRDDNKPMYGKMTGGSAVAPMWAKYYQTLINKGLYTPGKFEFLENYLETGDLVKQNIDIYSGLLDGPNSKEFTVRKGRLQVESAGKYKNGIASVFGLDGNVTSGAGIDMSEGMIIDTGSEEGTVTEGSTGEETTQTPHTNTPTTSTGGNTPPVQNNNSNNKDGDSLTNRLLGD

SEQ ID NO: 50236 - DNA, 2484 bp, Psychrobacter sp. 273-4
  CDS (1)..(2484)
atgcaaaaatctcattctaagcaaccacagtcctctaagcctgctatcaatacgctaccttcccagcagcgcggcatggtgtttagtagtattttattaattattgtcatcgctggcatggtgctattggcactgtatttggtcaaacttgatcgtactattacccacaagtttgagggtaaacgctgggatattcctgccaaagtttattcgcagccgcttgaattgtataaaggcgccaatatcgataaagacactatgaagacgtggtttgagttgctcaattatcaaagcgataaagcctatgatcgcaccggcacttatcataaatcgggtaacacctattttattcatacacgtggttttacttatagcgccaacgatatagaccaagaacaagtcatcaaaatgaccattgctggtaataaaattgagtcggtacaaagcaccataccggcgaaaacaggcattattcgtcttgagccggtcaatatcggcggtatttaccctgatagcaatgaagaccgcatggttgtctcgttagatcaagtaccgcagccgcttattgatgcgctgatagcgacagaagatcgtggtttttatgagcataaaggggtatcgatacgcggtatcgcccgtgcggtcatcaataacttctctggcggttcgcgccaaggtggctcgaccatcacccagcagctgatcaaaaacttttatctcaattccgaccgtacgatgaagcgcaaagccaatgaagccttgatggctgtactacttgagctgcattatagtaaagatgagattttgcaggcctatctcaacgagatttatttgggtcaaaacggcaaacgctctattaatggttttgggttggcatcacagttttattttgataagccgctcaatgagctgcgcctagatcagcaagcactgcttgtcggtatggcaaaaggaccgagcgtttataacccgcgtcgtcatccaaacgattcaaaagcacgccgtgatgtggtgcttagtaatatgttggctgttggcacgctcagtcaagaagactatgatacagcattaaaaaactcacttggggtggttgataagcctgttgaaggcaaaagccaattccctgattttttagacatcgtcaaacgcgaattaaataaagtttattactctgatgacctcaaaaacgaaggtctgattatcatcagtaccatggaccctattgcccagttggcagcggacaaagcagttgagagaaaacttggcgagctacgccgtagtggcagtaaaaccaaggacttacaaggggctctagtcagtgctaaccctgaaactggtgagctggtttctgtcgtgggtagcggtagcgaatttactggctttaaccgtgcggtcgatgccaaacgccaagtaggttcattattgaagccgattatttatatgaccgctctcgaaagtggtcgctataatttagcaagttcggttgatgattctcccattacggtcagtctaagtgacggtaccgagtggaatcctaaaaactatgacaatcgtgaccatggctacatcccctttaccacggcgctatcgcagtcttataaccatagcgctgtacgcttagggatggagtttggggtcgacacctttgctaaacaattaaaacgcatgggtgttaaagaaaaagtaccaccttatccttcagcattattgggctcagtcaacctaagcccaatggatatgcttggggtctatcaagtttttgcgacgggcggtttccgtacccctatccacagtatccgtagtgtgattgatgatcgcggtagtatcctacagcgtacgggattaaatactcagcgcagcattccgcctgagaccaactttttgattaactatgctttacaagacgtcgttaaaaacggtacggctagacgcgtacaatcgcttggtagcaatctaaaccttgccggcaaaacaggtactaccaatgattaccgtgatgcgtggtttgccggttatagtggcaactatgtcagtgtggtttgggttggacgtgatgacaataaacctattgggcttagtggcggtagcggcgctttaccagtttgggtcgattatatgaatcgtctaaaattgacacctgttgcgctgcctgagccagaaggtattgaatggctgtggttagagaacaactcaggtaagctgtcaaatgagcgctgtgccagcgcacgctacttgcctgtaatgtcagcatatttaccacaagaagccagcagctgtgctatcggcttatatcaacaagaacgtatgcgtgagcaaatgcagtggcaaaatcagcaaggcaatatcaataagcaacgtcgccatgaaggattagacattccaaatggtgaagccattaataatgacagcaatgatgccgagcaagatggggatacatccaatcgtgcagatacttggtacgaccgtgccgttgaatggttttag

SEQ ID NO: 50237 - protein, 827 aa, Psychrobacter sp. 273-4
MQKSHSKQPQSSKPAINTLPSQQRGMVFSSILLIIVIAGMVLLALYLVKLDRTITHKFEGKRWDIPAKVYSQPLELYKGANIDKDTMKTWFELLNYQSDKAYDRTGTYHKSGNTYFIHTRGFTYSANDIDQEQVIKMTIAGNKIESVQSTIPAKTGIIRLEPVNIGGIYPDSNEDRMVVSLDQVPQPLIDALIATEDRGFYEHKGVSIRGIARAVINNFSGGSRQGGSTITQQLIKNFYLNSDRTMKRKANEALMAVLLELHYSKDEILQAYLNEIYLGQNGKRSINGFGLASQFYFDKPLNELRLDQQALLVGMAKGPSVYNPRRHPNDSKARRDVVLSNMLAVGTLSQEDYDTALKNSLGVVDKPVEGKSQFPDFLDIVKRELNKVYYSDDLKNEGLIIISTMDPIAQLAADKAVERKLGELRRSGSKTKDLQGALVSANPETGELVSVVGSGSEFTGFNRAVDAKRQVGSLLKPIIYMTALESGRYNLASSVDDSPITVSLSDGTEWNPKNYDNRDHGYIPFTTALSQSYNHSAVRLGMEFGVDTFAKQLKRMGVKEKVPPYPSALLGSVNLSPMDMLGVYQVFATGGFRTPIHSIRSVIDDRGSILQRTGLNTQRSIPPETNFLINYALQDVVKNGTARRVQSLGSNLNLAGKTGTTNDYRDAWFAGYSGNYVSVVWVGRDDNKPIGLSGGSGALPVWVDYMNRLKLTPVALPEPEGIEWLWLENNSGKLSNERCASARYLPVMSAYLPQEASSCAIGLYQQERMREQMQWQNQQGNINKQRRHEGLDIPNGEAINNDSNDAEQDGDTSNRADTWYDRAVEWF

SEQ ID NO: 50238 - DNA, 2595 bp, Haemophilus influenzae R2846
  CDS (1)..(2595)
atgcggatcgcaaaattaatattaaacaccctattaactttatgtattttaggtttagtagcaggcggaatgttgtatttccacctaaaatctgaattgccctcagtcgaagcattaaaaaccgttgaattacagcaaccaatgcagatttatacggcagacggtaaattaattggcgaagtgggtgagcaacgccgtattccagtgaaattagccgatgtgccacaacgcttaattgacgcatttttagcgacggaagacagtcgtttttacgatcatcacggattagaccctattggcattgcccgtgcattatttgtcgcagtgagtaatggcggtgcatcacaaggcgcaagtacgattactcaacaattagcgcgtaactttttcttaacctcagaaaaaaccattattcgtaaagctcgtgaagccgtgcttgcggtagaaatcgaaaataccctcaacaaacaagaaatcttagagctttatttaaacaaaatctttttaggctatcgttcttatggtgttgcagcggcagcacaaacctatttcggtaaatcattgaatgaattgaccttatcggaaatggctattattgctggtttacctaaagcaccttcaacaatgaatccgctttattcgctaaaacgttcagaagaacgccgcaatgtggtgctaagccgtatgttagatgaaaaatacatcagcaaagaagaatatgatgctgcattgaaagagccgattgtggcgagctatcacggcgcaaaatttgaatttcgagccgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattacgatatgcgtcacggttatcgcggtggcgcgccattatggcaaaaaaatgaagcagcttgggacaatgatcgcattgtcggttttctacgcaaactacctgattcagagccatttattcctgcggcagtgattggaatagtgaaaggcggtgctgaaatattgcttgcctctggagaaaaaatgaccttatcaagcaatgcaatgcgttggacaggcagaagcaatcctgtgaaagtcggcgagcaaatttggattcgtcagcgtgctaatggggaatggcaattaggacaaattccctcagcaaattcagcattagtttctcttaattcagataatggcgcgattgaagcagtggtgggtggctttagctatgaacaaagtaaattcaatcgagccacacaatctttagttcaagtgggttcttctattaaaccatttatttacgcggcagcattagaaaaaggcttaacactttcaagcgtattacaagacagcccgatttctattcaaaaaccgggacaaaaaatgtggcaaccgaaaaactcgcctgatcgttatgatggcccgatgcgtttacgcgtaggattaggtcaatccaaaaatatgattgctattcgtgtgatccaaacggcaggtattgatttcacagcagaatttttacaacgttttggttttaaacgtgatcaatattttgcaagtgaagccttagcacttggcgcggcctctttcacgccattagaaatggcgcgagcttatgccgtgtttgataatggtggcttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtacctgaactgccagaattacagtcaaatttcaccgcacttaaggaagatgcaattgatttaatggccgcagcaaaaaatgcttcgtcgaaaatagaatatgcaccacgtgtcattagtggcgaacttgcttttctcattcgtagtgccttaaatacagcaatttatggcgaacaaggtttagactggaaaggcaccagttggcgtatcgcacaaagcattaaacgtagcgatataggcggtaaaacaggtactaccaacagttcaaaagtggcttggtatgcaggatttggtgcaaacttagtcactacaacttatgtcgggtttgatgataacaaacgagtacttgggcgtggagaagcaggtgcaaaaacagccatgcctgcttggatcacttatatgaaaacggctttaagtgataagccagaacgtaaattgccactgccgccaaaaattgtggaaaaaagcattgatactttgacaggtttgctttctccaaacggtggacgcaaagaatattttatcgtgggaacagaaccaactcgaacctatctttcggaaatgcaagagcgtggttattacgttcctacagagttacagcaacgcttaaataatgaaggcaatacgccagcgacgcaaccacaagaactcttctaa

SEQ ID NO: 50239 - protein, 864 aa, Haemophilus influenzae R2846
MRIAKLILNTLLTLCILGLVAGGMLYFHLKSELPSVEALKTVELQQPMQIYTADGKLIGEVGEQRRIPVKLADVPQRLIDAFLATEDSRFYDHHGLDPIGIARALFVAVSNGGASQGASTITQQLARNFFLTSEKTIIRKAREAVLAVEIENTLNKQEILELYLNKIFLGYRSYGVAAAAQTYFGKSLNELTLSEMAIIAGLPKAPSTMNPLYSLKRSEERRNVVLSRMLDEKYISKEEYDAALKEPIVASYHGAKFEFRADYVTEMVRQEMVRRFGEENAYTSGYKVFTTVLSKDQAEAQKAVRNNLIDYDMRHGYRGGAPLWQKNEAAWDNDRIVGFLRKLPDSEPFIPAAVIGIVKGGAEILLASGEKMTLSSNAMRWTGRSNPVKVGEQIWIRQRANGEWQLGQIPSANSALVSLNSDNGAIEAVVGGFSYEQSKFNRATQSLVQVGSSIKPFIYAAALEKGLTLSSVLQDSPISIQKPGQKMWQPKNSPDRYDGPMRLRVGLGQSKNMIAIRVIQTAGIDFTAEFLQRFGFKRDQYFASEALALGAASFTPLEMARAYAVFDNGGFLIEPYIIEKIQDNTGKDLFIANPKIACIECNDIPVIYGETKDKINGFANIPLGESALKPTDDSTNGEELDQQPETVPELPELQSNFTALKEDAIDLMAAAKNASSKIEYAPRVISGELAFLIRSALNTAIYGEQGLDWKGTSWRIAQSIKRSDIGGKTGTTNSSKVAWYAGFGANLVTTTYVGFDDNKRVLGRGEAGAKTAMPAWITYMKTALSDKPERKLPLPPKIVEKSIDTLTGLLSPNGGRKEYFIVGTEPTRTYLSEMQERGYYVPTELQQRLNNEGNTPATQPQELF

SEQ ID NO: 50240 - DNA, 2259 bp, Anabaena variabilis ATCC 29413
  CDS (1)..(2259)
atgcggcacagtagtaaggtgatcctagctgtgctgttaatatgcctattaatccgcttatcaccttattttgcgccgattcgtgccgtagatattgcccaaaatcaactagcaatgcaatttagcgatcgcaatgggctaccattaggaacaatactcacccgtgaccaagagcatacatcagtagtacccctaaatcagatttccccccagtttatccaagcaattttagccgccgaagatggtagcttttaccatcatggggctttggatttgcaagcaattgtccgcgccatcaaagaagccatccacgccaaaaaaattgtttccggcgcttccacaattaccatgcagttagcgcggatgttagaaccagtcccccgccacttgtcagggaaaatgcaggaaatttggctagcgtggcggttagcagccgggatgagtaaggatgaaatcctctctgcatatattaatcgcctaccaatgggagggaatatatatggtgtagaagcagcagcccgcacttatttttccataccagccagtgagttaaatcttgcccaggctagtttgttagccgccattcccaataatcccacctactttaacccttacgaacattgggaacgtctgaagcaacgacaaaaatacgtcctcaatcggatggtacaggaagggtatgtgagcaaggacatagcatatcgcacatcctcagaaaaagttgtgtttcagtccaaccagcgaggaattatcgccgcaccgcattttttattttggttagttaatcaaattcctcccagtcctgctgacacaaatcaatcagttatccacacaactatcaatcgtcctttgcagcaattcgtcgaagcacaagtacagcaggtaatttctactctttttgccaataacgttcatgacgcagccgcactagtaatagataaccacactggggaagttttagcttacgtcggttcaccggattactttaatcaagcccaactgggacgcaacgacggagttcaagccctacgtcaaccaggttctactctgaaaccctttgtctatgaattagccttagaaaagcggttaattcgcccaaatactattttggcagatgtccctacccattacgccatccccggcgcacaactctacagcccaacggattatacggaaaacttccttgggccagtgcgggtacgcatcgccttagccaattccctcaatgtaccagccgtgcgcgtcttggaaaaagtgggtgtgccaactttcctagaacggctgcatcaactgggatttgtccacctgaagcaaaccccagaatactatggtttaggtttaacccttggtagtggtgaagtcagcttgtgggaactagcccaagcctacctaacgatagcaagacaaggacaacccacccccttaatcaccaccctttcccagtccccagtcccccatacccaacccccaaaccccacaatctggcaattaatcactaacatcctcagcgacagccatgctcgtgccacagctttcggtgtagattcagtattaaacttacccttccctgtggctgtgaaaactggtacatcttccaactaccgtgacacttggacagtcggctttaccactgattacaccgtcgctacctgggtaggtaactttaacggtgaacccatgcgccaagtttccggtgtcacgggtgcagcccccttgtggaatcggattatgttacatctgcacgaacatcaagaaccagctagttttcccaccccaacaggtttattgcaactaccaatctgtgcagtttccgggttacgtcccacaccagactgtacttccgtagtgcaagaatatttctatcccgaagataaaattagctacgaaagggacactcagtttactttaccaccagaatataacgagtggttagccaagcaacagcgatcgcagtttaccaccagcagcctgagaattttatctcctcatgacggcgatttattcttactgtatccaggtgaagaagcacaacaaaaattagaatttaagttagtaggaagtaagtctacacctatagagtggtggctcaacggtgaaaagttgaatacccagtcagctaattctttattttggtcgctgcgtcctggtaactggactttggaggcgagaagcggtgaaatgagtgataaggtaaaatttcaggtgaaattggccagtattaaaccgacacgtcggggtttttcaattggtaattattag

SEQ ID NO: 50241 - protein, 752 aa, Anabaena variabilis ATCC 29413
MRHSSKVILAVLLICLLIRLSPYFAPIRAVDIAQNQLAMQFSDRNGLPLGTILTRDQEHTSVVPLNQISPQFIQAILAAEDGSFYHHGALDLQAIVRAIKEAIHAKKIVSGASTITMQLARMLEPVPRHLSGKMQEIWLAWRLAAGMSKDEILSAYINRLPMGGNIYGVEAAARTYFSIPASELNLAQASLLAAIPNNPTYFNPYEHWERLKQRQKYVLNRMVQEGYVSKDIAYRTSSEKVVFQSNQRGIIAAPHFLFWLVNQIPPSPADTNQSVIHTTINRPLQQFVEAQVQQVISTLFANNVHDAAALVIDNHTGEVLAYVGSPDYFNQAQLGRNDGVQALRQPGSTLKPFVYELALEKRLIRPNTILADVPTHYAIPGAQLYSPTDYTENFLGPVRVRIALANSLNVPAVRVLEKVGVPTFLERLHQLGFVHLKQTPEYYGLGLTLGSGEVSLWELAQAYLTIARQGQPTPLITTLSQSPVPHTQPPNPTIWQLITNILSDSHARATAFGVDSVLNLPFPVAVKTGTSSNYRDTWTVGFTTDYTVATWVGNFNGEPMRQVSGVTGAAPLWNRIMLHLHEHQEPASFPTPTGLLQLPICAVSGLRPTPDCTSVVQEYFYPEDKISYERDTQFTLPPEYNEWLAKQQRSQFTTSSLRILSPHDGDLFLLYPGEEAQQKLEFKLVGSKSTPIEWWLNGEKLNTQSANSLFWSLRPGNWTLEARSGEMSDKVKFQVKLASIKPTRRGFSIGNY

SEQ ID NO: 50242 - DNA, 2271 bp, Anabaena variabilis ATCC 29413
  CDS (1)..(2271)
atgaattctccccaaccccctcacaagccacaaactttacttggtcaactgacgcaagcagtcaatacaattcaagctagggttgacttttccaagctggcgctcaagcctaatgccaaggtaccggaactctgggtgcaggatgcgggggcggataaagcagaggtgtatcccctactaggcgatcgctatgttctcggtcgtagctctaaatccagcgatatagtgattcgcaacccagtagttagccaaattcatttgtccttatcgcgggattctagccagcgtactccggttttcattattaaagacgaaaattctactaacggtatctatcgcggtaagcggcgcgttcataccctagaactgcgccacggcgatattttgaccttggggccgccagaattagctgcctctgtgcgcctacaatacgtcgatccgccaccctggtacgtcaaggcggcgacttgggcaggctacggcgtaggcggtgctagcgccttattagcattggttattggcgttgagtggctaaaattctctgtcaggcctttaccaacaaccactcgcgctccagtagttgtttatgcccgtgatggtagtaccccattacgtgagcctcggacggtttctcatgtagacatgaagcggttagaagacttcggcccttatttgtcggcggcggtggtcgcttctgaagatagccgctttaactggcattttggggttgatcctttggggattttacgagcagtattaatcaatactcgtagtggtgatgttcaacaaggagccagtactattacccaacaagtcgcccgtagcttgtttcgtgattacgtcggcagacaagactctttgggacggaaattacgagaggcgatcgtttctttgaagctagaagccttttacagcaaagatgaagttttgctgatgtacttaaatcgggtgtttttgggggcagatacctccgggtttgaagacgcagcacaattttattttgataaaccagcgaaagaattaactttggcggaagctgctactttagtgggaattttaccagcgcccaatgcttttgatttttgtggcagtggacccaataaactagaagccgccgactatcgcaatcgcgtggtgaagcggatgttggaaatgggtaaggttacgtcagaagaagcgaaccgagccagaagatccactgtccaagttagccccaaggtttgtgaacaacaagccaaaacaattgccccctatttttataactatgtgttccaagaactagaagcaattttaggggagggagccgccagggagggtaattacatcattgaaacccaacttgatccagccatccaaactcaagcagaaacagctttgcggaattcagttagtacggccggttcaacttttcgcttttctcaaggggcaatggtgaccctagatagtagaactggtagtattttggcaatggtagggggaactgattatcgaactagccagttcaatcgggctgtacaagctaaaagacaacctggttctaccttcaaaatttttgcttatacccaagctctgctacaaggaataccagcatctaggacatattcttgcgctcctttgacttggcagggatttacttacaggccttgtcgttctggtgctgatggtagtttagatattgctacgggtttggctttgtcggaaaatcccattgctttgagaattgccagagaagttgggctagataaggtagtatcaatggcgcaacgtttaggggtgaagtcccaacttgaggcagtaccgggtttagttttgggtcagagtgtagttaatgttttggaaatgacgggagcttttggggcgattggtaatcgtggtgtgtggaatccaccccatgccattaatagaattttagacagtagcgactgtagcgatcgcaatgattttaaaacctgtcgtgtaatttattcctttgatagcgatcgcgaagctaacaagcgagttttaccacaacccatagccgaccaaatgaccgatttaatgcaaggtgtcatcaccagaggtacaggacgtagcgccgccattggtttaggggaagcaggtaaaacgggtacaaccgacaaaaacgttgacttgtggttcattggctttattcccaaccgtcgcttagtcacaggtatttggctaggaaacgataataattcccctacctctggtagcagcgctcaagccgcccagttgtggggaaattatatgcgaagaattacaagatga

SEQ ID NO: 50243 - protein, 756 aa, Anabaena variabilis ATCC 29413
MNSPQPPHKPQTLLGQLTQAVNTIQARVDFSKLALKPNAKVPELWVQDAGADKAEVYPLLGDRYVLGRSSKSSDIVIRNPVVSQIHLSLSRDSSQRTPVFIIKDENSTNGIYRGKRRVHTLELRHGDILTLGPPELAASVRLQYVDPPPWYVKAATWAGYGVGGASALLALVIGVEWLKFSVRPLPTTTRAPVVVYARDGSTPLREPRTVSHVDMKRLEDFGPYLSAAVVASEDSRFNWHFGVDPLGILRAVLINTRSGDVQQGASTITQQVARSLFRDYVGRQDSLGRKLREAIVSLKLEAFYSKDEVLLMYLNRVFLGADTSGFEDAAQFYFDKPAKELTLAEAATLVGILPAPNAFDFCGSGPNKLEAADYRNRVVKRMLEMGKVTSEEANRARRSTVQVSPKVCEQQAKTIAPYFYNYVFQELEAILGEGAAREGNYIIETQLDPAIQTQAETALRNSVSTAGSTFRFSQGAMVTLDSRTGSILAMVGGTDYRTSQFNRAVQAKRQPGSTFKIFAYTQALLQGIPASRTYSCAPLTWQGFTYRPCRSGADGSLDIATGLALSENPIALRIAREVGLDKVVSMAQRLGVKSQLEAVPGLVLGQSVVNVLEMTGAFGAIGNRGVWNPPHAINRILDSSDCSDRNDFKTCRVIYSFDSDREANKRVLPQPIADQMTDLMQGVITRGTGRSAAIGLGEAGKTGTTDKNVDLWFIGFIPNRRLVTGIWLGNDNNSPTSGSSAQAAQLWGNYMRRITR

SEQ ID NO: 50244 - DNA, 2139 bp, Synechococcus elongatus PCC 7942
  CDS (1)..(2139)
atgtcgctggggctgaaatcgcgcggcggcgatggattcagcagctccctaatcccaaagaggtctagcttcacgcgaccgggcacgatcaccattctctcggccgacaataccgttctgcagaaaattgggccggccacgcgcgacaaggtgcccttcaagcagattcccctgcgtctacgtcaggctttcctcgcggctgaggatcggcgcttctacgaacatagcggtatcgatctgttcgggattgcccgcgccagcgtcacaaacctgctcagcggtcaggtgcaggagggtgctagtaccatcacccagcagctggcccgcattgtttttctcagccaagagcgcagtctgcaacgcaagctcaacgaagcgctgatggcgcaaaagctagagcaggagttgaccaaggaccaaatccttgagcagtatctcaatttggtctatctcggggcaggggcctacggggttgctgatgctgcttggacttacttcagcaagccagtccaagacctcagcctaggagaaatggcaacgctggcggggctaccccccgcgcccacagcctactcgcctttggtctccttggaagtggctcaagagcggcgtaatagtgtgctgagccgcatgcaagaggtgggcttcatcaccccatctgaggcagaagctgctcgccgcgaaccccttgcgctcaagcctgcagcaccgaaatatgctcaaagtctggcgccctactttaccgactacgttcgccaggaactgccacgctttgttgcgccggatgtcttggagtacggcggcctgacgctcaagacgaccttgaactatcgctggcaacaagcggcggaccaggctatccaaaactcgacctacggcagtttgcagggggctctcgtcagtatcgatcctcgcgatggggcaattcgggcgatggtgggcggggtggatttcaatcgcagccagttcaaccgcgcgacccaggcctatcgtcagccgggttccactttcaagatgtttgtctatgcggcggcgatcgcttcaggaatgtcgccctcccaggtctacttggatgccgcgatcaatttggggggctataaaccgcaaaactttagccgtagctttagtggctcgatcagtctgacccaagcgttgactaattccgtcaatattgtcgcgatcaaggtgctgcgggatgttggcattgacaatgtcattcgggtggcccgccaaatgggaattcgggcggacttggcgcgctactatcccttggcattaggagcctcagacgtcacgctgctggagatcaccagtgcttacggcactctggccaatcaggggaaatatctgacaccccacccgatcgctgaaatcatcgatcatcgcggtcgagtcctctaccaagacaaacagatcaagccagtgcaagccctcgatcctgggtctgctgcgatcgtgacatccatgctggagcgcgttgtcacctctggaacgggggctgctgcttacctgcccgatcgcgcagtggcagggaaaacaggcacgaccgaacaagctcgcgacctctggtttattggctacatcccgcagttggtgaccggggtttggctgggctacgacaactttgccccgactggcagtgggagtagtgcagctgcggtggcttggtatcgctttatggtcgaggccattaaagacctgccccccgaaaaatttccgccgctgccgaaccccgatcaacggaaaccgctctttaaagctcagttcacaagtggcagtgacctaggggggatcgatcgtggacccggccgctatgactacggcgctggcattgagttggcggactcccccagttttgctggcagtctgcccgccgcaccagcctccaatgctggctcgagccgttcccgcgatcccgaaccggaatatagcagtgagccggcggcggaagaaccccgctacgaagatgctccccctgaggcaccggctgaatcttttgagccgggacccagtgccgtcgaagcagaacccgctcccccagcacccgttgaaccgcaggcaccggtgccccctccacctgaacccactgcaccacccctccccgtggagcctacggcacctcagcctcaggccccctag

SEQ ID NO: 50245 - protein, 712 aa, Synechococcus elongatus PCC 7942
MSLGLKSRGGDGFSSSLIPKRSSFTRPGTITILSADNTVLQKIGPATRDKVPFKQIPLRLRQAFLAAEDRRFYEHSGIDLFGIARASVTNLLSGQVQEGASTITQQLARIVFLSQERSLQRKLNEALMAQKLEQELTKDQILEQYLNLVYLGAGAYGVADAAWTYFSKPVQDLSLGEMATLAGLPPAPTAYSPLVSLEVAQERRNSVLSRMQEVGFITPSEAEAARREPLALKPAAPKYAQSLAPYFTDYVRQELPRFVAPDVLEYGGLTLKTTLNYRWQQAADQAIQNSTYGSLQGALVSIDPRDGAIRAMVGGVDFNRSQFNRATQAYRQPGSTFKMFVYAAAIASGMSPSQVYLDAAINLGGYKPQNFSRSFSGSISLTQALTNSVNIVAIKVLRDVGIDNVIRVARQMGIRADLARYYPLALGASDVTLLEITSAYGTLANQGKYLTPHPIAEIIDHRGRVLYQDKQIKPVQALDPGSAAIVTSMLERVVTSGTGAAAYLPDRAVAGKTGTTEQARDLWFIGYIPQLVTGVWLGYDNFAPTGSGSSAAAVAWYRFMVEAIKDLPPEKFPPLPNPDQRKPLFKAQFTSGSDLGGIDRGPGRYDYGAGIELADSPSFAGSLPAAPASNAGSSRSRDPEPEYSSEPAAEEPRYEDAPPEAPAESFEPGPSAVEAEPAPPAPVEPQAPVPPPPEPTAPPLPVEPTAPQPQAP

SEQ ID NO: 50246 - DNA, 2223 bp, Synechococcus elongatus PCC 7942
  CDS (1)..(2223)
atgagcgatcgcccgcagccggcacccaccgtcctgaaacgcctgacccaattggcaacgcaggttcagcgacgggccaagtttgataatctcaacctgcgtgactctgactcagttccccaattgacggtctgtcagggagaccgccggcagtcttatccgctgcttggggactattaccgcctgggccgaggccgtgactgtgacatcccgattgatagcccgatcgtcagcaagcttcacctcagcctcggtcgctcgggcaaagagcgcggtgactttgtcctgcaagacgaaaactcgaccaacggcgtcttttggcggggccgccgtgtcgatcgcttggaattacagcatggcgatcgcatctacctggggccaccagagctgaccgatcgcgttgagctgctctatgaaaacgctcctcctctctggcaggactggctgaaacgaggggtgactatcactacagctgtggtcggagcgatcgcgatcggcattaccctcgaggccagccgagtctccgtgcgatcgctggggacggtgcaaggaccgatcgctgcctatgccgctgatggcgagcccctacaaactctgcgcagtagtagccacgtcgaattaccggccctctcagatttttcgcccgttctccccaaagccctgcttgcctccgaagacagtcgcttctactggcatctgggtatcgatccctacggcacggcgcgtgcgattctgactaacttccgcagtggcgaagttcgcgaaggcgccagcaccctcacccagcagattgctcgcagcctatttagcgactacgtcgggcgtgaggactcgattggtcgcaaagtccgcgaagcgatcctggcgctgaagctggagtttttctacagcaaggatgagctgctgcgcacctacctcaaccgggtttaccttggggtcggctatggctttgaagacgctgcccagatttactttggcaagtctgcccgtgatctctcgacctccgaagcggcgctgttggtgggactcttgccctcccccaatggatttagcccctgcaccaacctcgctgctgcccagcgccaaaaaaatggtgtgattgaacggatgcagtccctcggtttgatcagcgaagaggaggcccgcacggcgcggcgatcgccggtgacaattaagccggaggcttgccaaaccagcagccgagtcaccgccccctattactacggcgccgtggttgaggaactggctcaattagtgggtgacacagtcgttgaagaaggcaactttgccgttgagaccagcctcaatcctgcgatgcaaactgcggctgaacaatctctgcagtcgctcttggcacaaacagccggtgtcaaacaaggggcgatcgtcacgattgacagtcgtaatggcgaaatccgagccctcgtcggtggggtcgattaccaagcgagtcagttcgatcgcgccacccaggcctatcgtcagccgggttcgaccttcaaagtctttgcctatgcagcagccctagaacaaggcatttcggccggacgaccctacgattgctcgcctcttgtctggcaaggtcagcaatttcggggctgtgaacgcagcagtggcagcattgacctcgcccgcgccttggctcaatccgaaaatgcggtggctctgcgcgtcgcccgcgaggtggggctggatgccgttgtgcagatggcccgcaagtttggcattaaagcggatctacaacccgtccccggcctggtattggggcaaagtgaggtgacattgctggaaatgaccagcgcctttgctgcgatcgccaacgaagggcgttggaacccgccccatgccatccgccgcatctacgacagcagccgttgcaccactgcggagcaacgtcggagttgcacccttacctttgatgtccagcagcaaccccgccgcgatcgcgttgtgatttcagccgcgacggctgcgaccctaacggccatgctgcaacaggcggtgagtagtgggactggcggagccgctgcgatcggctatggagcagcgggcaaaactggtacgacgaatgatggcgttgatctttggtttgtgggctttgtgccctctcgccacctggtcactggcgtttggctcggcaacgacgacaaccagccgaccggtaacagtagcagcttggcagcccagctttggggcgactacatggcccgaatactgcgctga

SEQ ID NO: 50247 - protein, 740 aa, Synechococcus elongatus PCC 7942
MSDRPQPAPTVLKRLTQLATQVQRRAKFDNLNLRDSDSVPQLTVCQGDRRQSYPLLGDYYRLGRGRDCDIPIDSPIVSKLHLSLGRSGKERGDFVLQDENSTNGVFWRGRRVDRLELQHGDRIYLGPPELTDRVELLYENAPPLWQDWLKRGVTITTAVVGAIAIGITLEASRVSVRSLGTVQGPIAAYAADGEPLQTLRSSSHVELPALSDFSPVLPKALLASEDSRFYWHLGIDPYGTARAILTNFRSGEVREGASTLTQQIARSLFSDYVGREDSIGRKVREAILALKLEFFYSKDELLRTYLNRVYLGVGYGFEDAAQIYFGKSARDLSTSEAALLVGLLPSPNGFSPCTNLAAAQRQKNGVIERMQSLGLISEEEARTARRSPVTIKPEACQTSSRVTAPYYYGAVVEELAQLVGDTVVEEGNFAVETSLNPAMQTAAEQSLQSLLAQTAGVKQGAIVTIDSRNGEIRALVGGVDYQASQFDRATQAYRQPGSTFKVFAYAAALEQGISAGRPYDCSPLVWQGQQFRGCERSSGSIDLARALAQSENAVALRVAREVGLDAVVQMARKFGIKADLQPVPGLVLGQSEVTLLEMTSAFAAIANEGRWNPPHAIRRIYDSSRCTTAEQRRSCTLTFDVQQQPRRDRVVISAATAATLTAMLQQAVSSGTGGAAAIGYGAAGKTGTTNDGVDLWFVGFVPSRHLVTGVWLGNDDNQPTGNSSSLAAQLWGDYMARILR

SEQ ID NO: 50248 - DNA, 2376 bp, Ralstonia eutropha JMP134
  CDS (1)..(2376)
atggccacagcacaaccgaagccgtccctcccagcccgccgctcgctctgggcgcgcatcacgttctgggtagtggggctgatcgtcgccggcatcgtggcggtcgcgctgctgctcggctacgcgctgctcgtggccgcgccaaacctgccgtcgctggacaccatcacggactatcgcccgaagatcccgctgcgcatcttcactgctgacaatgtcctgatcggcgagttcggtgaagagcgccgcaacttcgtgccgatcgcggagattcccgacgtcatgaagaaggcggtgctggcgatcgaagacgaccgcttctacgagcacggcggcgtcgacttcgtcggcgtgatgcgcgcgggcctggcgaacctgcgcggcgggctgtcgcagggcgcatccacgatcaccatgcaggtcgcgcgcaacttcttcctgtccagcgagaagacctacacgcgcaagatctacgaaatgatgctcgcgtacaagatcgaggcgaacctgagcaaggaccagatcctcgagctgtacatgaaccagatctacctgggccagcgcgcctatggcttcgatagtgccgcgcgcgtctacttcggcaagtccgtgcgcgacgtgacgccggccgaagcggccatgctggccggcctgcccaaggcgccgtcggcgtacaacccggtggtgaacccgcgccgtgccaaagtccgccaggaatacatcctgcagcgcatgcgcgacctgcgctacatcacgccggaacaatacgacgccgccctccgcgaagccccgaaggtgcgcagcgagggcaacgagttctccacgcacgcggagtacgtggcggaaatcgtgcgccagctgatgtacgcgcaataccgcgaggaaacctacacgcgtggcctgacggtctacaccacgctgaccaagcctgaccaggacgctgcctacgaggccgtgcgctcgggcatcatgaactacgagcgcaagcacggctatcgcggcccggaagcgttcatcgacctgccgtccgaccaggccgaacgcgaacaggctatcgacgatgcactcgtcgaacatcccggcagcgacgacctgcgctcggccgtggtgaccaccgtgtcgccacgccaggtgaaggccacgctgctgtccggcgaagtggccacgatcgaaggatcggcgctgcgtttcattgccccgtcgctgtcggccaacgcccagcccaagaccaagatccgccccggcgcgattatccgcgtgacgcaggacgacaagggcgactggacggtcacccagttgccagaagtgtcggcggcgtttgtctcgatcaacccgcaggatggcgagatccgctcgatggtcgggggctttgacttcaaccgcaacaagttcaaccacgtgacgcaggcctggcgccagcccggttccagcttcaagccgttcatctactcggcagcgctggaaaaaggcttctcgccggccaccgtgatcaatgatgcgccgctgacgatcggcccggacaccggcggccaagtgtgggagccgaagaactacgacggcaagttcgagggcccgatgaccatgcgccgcgcgctggccaagtcgaagaacctggtctcggtgcgcatcctgcgggcaatcggtacgcagtacgcgcaggactacatcactcgcttcggcttcgaggcggagaagcaccccgcctacctgccgatggcgctgggcgccggtagcgtcacgccgctgcagatggccggcgcctattcggtgttcgccaacggcggctaccgcatcaacccgtacctgatccagaaggttgtcgatgcgcgcggcaaggtgctttccgaaacccagccgcagcgcgccggcagcgacgccgtgcgcgtgctcgacgcacgcacggcgtttatcgccgacaccatgttgcgcgatgtggtgcgcatggggacggccaaccccgccaagcagcgcctgggccgcaatgacctggccggcaagaccggtaccaccaacgatgccgtcgatgcgtggttcgcgggctacacgcccaacctggttgcgatcgcctggatgggttacgaccagcccaagagcctgggcgtgcgcgagaccggcggcggactggccctgccgatctgggttggctacatgggcaagatgctcaagggcgtgccggaaagcccggaacggcccgcaccggaaggcgtggtcatggccggcggcgactggaccttcgaagagaacgcgagcggcgctggcgtggcatcggtcggcctgggcgacccgtggccgggcaagccggaagaaagcacgcgtccgccagccgatgtggaagcggagaaaaagaagatcctggaaatgttcggcgggggctga

SEQ ID NO: 50249 - protein, 791 aa, Ralstonia eutropha JMP134
MATAQPKPSLPARRSLWARITFWVVGLIVAGIVAVALLLGYALLVAAPNLPSLDTITDYRPKIPLRIFTADNVLIGEFGEERRNFVPIAEIPDVMKKAVLAIEDDRFYEHGGVDFVGVMRAGLANLRGGLSQGASTITMQVARNFFLSSEKTYTRKIYEMMLAYKIEANLSKDQILELYMNQIYLGQRAYGFDSAARVYFGKSVRDVTPAEAAMLAGLPKAPSAYNPVVNPRRAKVRQEYILQRMRDLRYITPEQYDAALREAPKVRSEGNEFSTHAEYVAEIVRQLMYAQYREETYTRGLTVYTTLTKPDQDAAYEAVRSGIMNYERKHGYRGPEAFIDLPSDQAEREQAIDDALVEHPGSDDLRSAVVTTVSPRQVKATLLSGEVATIEGSALRFIAPSLSANAQPKTKIRPGAIIRVTQDDKGDWTVTQLPEVSAAFVSINPQDGEIRSMVGGFDFNRNKFNHVTQAWRQPGSSFKPFIYSAALEKGFSPATVINDAPLTIGPDTGGQVWEPKNYDGKFEGPMTMRRALAKSKNLVSVRILRAIGTQYAQDYITRFGFEAEKHPAYLPMALGAGSVTPLQMAGAYSVFANGGYRINPYLIQKVVDARGKVLSETQPQRAGSDAVRVLDARTAFIADTMLRDVVRMGTANPAKQRLGRNDLAGKTGTTNDAVDAWFAGYTPNLVAIAWMGYDQPKSLGVRETGGGLALPIWVGYMGKMLKGVPESPERPAPEGVVMAGGDWTFEENASGAGVASVGLGDPWPGKPEESTRPPADVEAEKKKILEMFGGG

SEQ ID NO: 50250 - DNA, 2376 bp, Methylobacillus flagellatus KT
  CDS (1)..(2376)
atgctcccgaaaaaatggtggcagttcctgatcctcgccggcatcatcctgggattggtggcaactgcactggtagcgctggctgccacattgatctaccccgaactgccttcccttgaagccctcaccgactacaagcccaaggtgccaatgcgcgtctattccgaggacggccacttgataggcgagttcggcgaggagcgccgcgccttcattagtatcgacgagacgccgcaggcgctgaaacaggccatccttgccgccgaagacgaacgtttctaccagcacggaggtatagacacactgggcatcctgcgcgcgaccgtgtccaacgtgacctctggccgcttcaaggagggcgcaagcacgatcaccatgcaggttgcccgcaatttcttcctttccagcgagaagaccgccactcgtaaactcagcgaggcattgctctcgatcaagatcgagcacaacctgaccaaggaccagatcctggagctttatatcaaccagatctacctgggccaccgctcgtacggctttgcagccgcttcacaggtgtattacggcaaaccactggatcagctcagtattgcggaggtcgccatgctggccggcctgcccaaggcaccgtcccgatacaatcccttcgccaatcccaagcgcgctgaagcgcgccagcgctatgtgctgcgccgcatgaaggaattgcgtttcatcgaccagcagcaatatgaagctgcgctggccgagccgcaccgtttccgaaagtcccgcaaaatacgcgatctctcagcagactatgtggctgaaatcgtgcggcaagccatgtacgagcgatacaaggatgagatctacagtagtggcctcaagatctacaccacgatccgcaagagcaaccaggaggccgccaaccgcgccatcctccagggaatcatcgactatgaccgccgtcatggctaccgcggcccagagagaaccgtgacgcccggcgccaatgaccaaggcaacggcaactggctggataatgccatggacgacctggaaacattccagggcatgatcccggccgtcgtgaccaatgtcacgcccaaggccgtcagcgtccatgcaaaggatggtagtaatatcgagatcagcggcgacgggctggctttcgtacagaaacagctggcagaaaaagatgctgccaagcgtaccatcaagccaggcgccgtcatccgcatcatgcgtcagggagaaagctggcacatcgtgcagttgccgcaggcagaggcggcattggtggcgatggacccggaaaccggtgcggtacgggcactggtcggtggcttcgacttcaaccgcaacaaattcaaccatgtgacacaggcatggcgccagcccggctccagcttcaaacccttcatctattcggcatcgctggaaaaagggttcacaccagccagcatgattgaggacgagcccatttccgtatcggcgcgagaaaccggcagcggctccacatgggagcccaagaactatgaccgcaagtacgatggtccgatgcgcatgcgcaccgccctgatcaaatccaagaatatggtttccattcgcatccttgaaggcataggcgtcaattacgcgcaggattacatcactcgcttcggcttttcgcccaaggaccaccccccttatctcgcgatggcattgggtgccggctcggtcaccgcctggcagatggccggggcttattccgtatttgccaacggcggctatcgcgtcaagccatacatcatcgacaaggtcgtcgacagccgcgggaatgtgcttgaacaatccaagcccttgctcgccggccagggcgctgcgcgtgtgattgacggccgcaatgccttcatcatgaattcgatgctgcaggatgtagttagactgggaacggccacgcgagcgcgcagcctgggccggtcagacctggcggggaaaaccggcacgaccaacaaccagatcgacgcctggtttgccggctacagcccgaagcatgtcgcgatcacctggatggggtatgacaagcccaagtcactgggcagcctggaaaccggcggcaaggcagcgctaccgatctggatagactatatgcgttccgcactgaaaggcgtgccggaagtcactccggaaatgcctgccggtgtcagcgccatccgcatcgacccagccacaggcatgcgggtcaagggagacgaggaaggcatcgtggaatatttctatcatgagtttcctccgcccgagcctgaggagtccatcttttccattattcccggtttcccgattcccggccatgggtcgcccccacccatggaaaaacaggacaatgcgccaccagggccagatcagttgttttag

SEQ ID NO: 50251 - protein, 791 aa, Methylobacillus flagellatus KT
MLPKKWWQFLILAGIILGLVATALVALAATLIYPELPSLEALTDYKPKVPMRVYSEDGHLIGEFGEERRAFISIDETPQALKQAILAAEDERFYQHGGIDTLGILRATVSNVTSGRFKEGASTITMQVARNFFLSSEKTATRKLSEALLSIKIEHNLTKDQILELYINQIYLGHRSYGFAAASQVYYGKPLDQLSIAEVAMLAGLPKAPSRYNPFANPKRAEARQRYVLRRMKELRFIDQQQYEAALAEPHRFRKSRKIRDLSADYVAEIVRQAMYERYKDEIYSSGLKIYTTIRKSNQEAANRAILQGIIDYDRRHGYRGPERTVTPGANDQGNGNWLDNAMDDLETFQGMIPAVVTNVTPKAVSVHAKDGSNIEISGDGLAFVQKQLAEKDAAKRTIKPGAVIRIMRQGESWHIVQLPQAEAALVAMDPETGAVRALVGGFDFNRNKFNHVTQAWRQPGSSFKPFIYSASLEKGFTPASMIEDEPISVSARETGSGSTWEPKNYDRKYDGPMRMRTALIKSKNMVSIRILEGIGVNYAQDYITRFGFSPKDHPPYLAMALGAGSVTAWQMAGAYSVFANGGYRVKPYIIDKVVDSRGNVLEQSKPLLAGQGAARVIDGRNAFIMNSMLQDVVRLGTATRARSLGRSDLAGKTGTTNNQIDAWFAGYSPKHVAITWMGYDKPKSLGSLETGGKAALPIWIDYMRSALKGVPEVTPEMPAGVSAIRIDPATGMRVKGDEEGIVEYFYHEFPPPEPEESIFSIIPGFPIPGHGSPPPMEKQDNAPPGPDQLF

SEQ ID NO: 50252 - DNA, 2223 bp, Crocosphaera watsonii WH 8501
  CDS (1)..(2223)
atgagtcaaaagcaacccataagccaactgttaacccaagtagtacaaaacttgatgaagtccaacccaaagaaaaaggtgttaaaaaaaggggcaaaagtacccgagatcagggtgaaagaaagcccaaaagataaactaataaaatatcctttaatcggcgatcgccatatcattggtagaagttccagcaacacagacatcaaggtactaaaccctattgtcagtcaagttcattgttctttgcatcgggatcaaaagaacccccaccacttcatcatcaaagacgaaaactccaccaatgggatctatttaaaaaaacgaagagttaataatttatttctacgtcatggggatacccttacctttggaccaccagaattaaacgacattgctaccctaacctactataacccacccccaaaatgggcacaagtgttaaagtatgggttctatggcatgggatctttgattaccttgggagtagcttggttgttgtgggaaaccagcaaaattaaggttcatcccctacctaaaggagtaccggggccagtggttgtttacgccagggatagacaaactcctctgagtaccctcaacgacgatccgcaccaagaagttaagaatttaaaggacttttcaccccatttgcccaacgcactcatagcctcggaagatactcgcttctactggcatattggcgtagatccctacggtatttttagggcgatagtagtcaatttgcaagacgatggtatcagtcaaggggccagtaccctcacccaacaagtggcccgtagtttattcccagaggtaggaagggaaaacaccgctcaacgtaagattagagagatgatcgtcgctttaaaattagaagcagtttatagtaaagactttctgctaaaaacctatcttaaccgtgtttatctcggtgtgggtaagtatgggtttgaggatgcagcacaattttactttgataagtcagccacagaagttgatattgctgaggcagcaaccctagtggccatgttacccgcccccaacttatatcaccctgtacaagattataacacctcagtacagttaagaaatagagttatcgatcgcatggcagccttgagaatgatctcccccgaagaagcagcccgggccaggcgatctatcattgatctcagtccccaagccagaaaagccctagccaataataaagccccctatttttataatcacgtccgtcaggagctacggcagttattagggacagaaatagccaaagaaggtaactttattgtcgaaacagggttagatttaaacaaacaggcattggctgaaaaaaagttacaacaagcggttaaaactcagggaaaaaccgacggtttttctaacggggccatggttactctagatacccgtacaggggaaatattagccttagtgggaggcgtggactacaaacaaagtcagttcaaccgagttacccaagccaaacgccaacctggatcaacctttaaactatttgcctacgcggcagccctggaaaaaggtatttccccccaaaaaacctatagttgtggtggtattagatggcaaggccaagcttataaaccctgtgaacgcagtagcggcgaaacggatatgtatggagcgatggcacagtcagaaaataccatcgctttgcaagtagctagagaagcagggttaaacagtgtggttaatgtagcccaacggttgggggttaagtccaaattacaagccgtcccaggcttggttttagggcagagtgagaccactgttttagaaatgaccggggcctatgctgctgtggctaacgatggtgtatggaaccgtccccacgccattcgtcgcattttagacggaggagactgcaccaataacaatgattggcgtacctgtcgagaaatctataatttccaaaccgataacagtgccagacaacaggccctatctccccaagtttcccgaaccatgacccgtatgttaaaaaccgttatttctaatggcactggccgtgcagctagtgttggcttaggggaagcaggaaaaaccggaaccacagacagggctgttgatttatggtttattggttatattccccgaaaaaacctagctacaggtatctggttaggtaatgataataactcagctacgaaaggcagtagtgggcaagctgctgccctgtggggtagctatcatcgaccgtag

SEQ ID NO: 50253 - protein, 740 aa, Crocosphaera watsonii WH 8501
MSQKQPISQLLTQVVQNLMKSNPKKKVLKKGAKVPEIRVKESPKDKLIKYPLIGDRHIIGRSSSNTDIKVLNPIVSQVHCSLHRDQKNPHHFIIKDENSTNGIYLKKRRVNNLFLRHGDTLTFGPPELNDIATLTYYNPPPKWAQVLKYGFYGMGSLITLGVAWLLWETSKIKVHPLPKGVPGPVVVYARDRQTPLSTLNDDPHQEVKNLKDFSPHLPNALIASEDTRFYWHIGVDPYGIFRAIVVNLQDDGISQGASTLTQQVARSLFPEVGRENTAQRKIREMIVALKLEAVYSKDFLLKTYLNRVYLGVGKYGFEDAAQFYFDKSATEVDIAEAATLVAMLPAPNLYHPVQDYNTSVQLRNRVIDRMAALRMISPEEAARARRSIIDLSPQARKALANNKAPYFYNHVRQELRQLLGTEIAKEGNFIVETGLDLNKQALAEKKLQQAVKTQGKTDGFSNGAMVTLDTRTGEILALVGGVDYKQSQFNRVTQAKRQPGSTFKLFAYAAALEKGISPQKTYSCGGIRWQGQAYKPCERSSGETDMYGAMAQSENTIALQVAREAGLNSVVNVAQRLGVKSKLQAVPGLVLGQSETTVLEMTGAYAAVANDGVWNRPHAIRRILDGGDCTNNNDWRTCREIYNFQTDNSARQQALSPQVSRTMTRMLKTVISNGTGRAASVGLGEAGKTGTTDRAVDLWFIGYIPRKNLATGIWLGNDNNSATKGSSGQAAALWGSYHRP

SEQ ID NO: 50254 - DNA, 1842 bp, Crocosphaera watsonii WH 8501
  CDS (1)..(1842)
atgagtctcttagcaagttccgtcgtcgccggagggctagtgggtttagccataagcttccgtaaacttcctgatgtccggagccttaataactattccccatcagaaaccagttacgtctacgatatcaaaggaaggctcctaactcgactacacggagaagccaaccgagaagcagtaacactggacaaaatttcccctgagttgaaacgggctgtcttagccattgaagacagccatttttatttgcaccaaggcattaaccccaacagtatcggacgggctttgtgggttaactggaaaagtgggggtgtggtagaaggggcttcaaccatcaccatgcagttagtgaaaaatatttttctaactaaggatcgaacctttacccgtaaactctcagaagctgttctcgccgttcgtgtcgaacaagtctttgaaaaagacaaaattatggaaatgtacctcaataacatctattggggtcacaataactacggggttgaaaccgcagcccaaagttacttctataaatcagcctccgaattaacgctacccgaagccgccatgatggccgggttaatacaggctcctgaaacctatagtccttttaacaactacgccaacgctaaacaacgtcagaaggtagttcttgaccgtatggccgatgtaggttggatcaccccagaagaagcccaagcagcccataaagcgcctttagaggtgggaaaacctacttcctggcaagctagtaaactaccctacgtcaccgatacggtgaagcaagagttacaagaaaccttcagcaaagaggtgatcactaaaggaggaatgcgtattcaaacctccgtagattacttcatgcagcaaagagcagaagaaaccgttaaaaaagggtataagcaactaaggggtcgaggtttaaggaccaaagatttacagattgctctagtggctgttgatccccgaacccactttatcaaagccattgttgggggagtagattacgaaaaaagtcaattaaaccgcgctactcagtcccttcgtcaacccggttcttcttttaaaccctttgtttactacgccgcctttgccagtggcaaatatggccccggttccgtggttaacgatagccctgtcagttatcgtgacggtagcggtggtagcggtgtctatagccccagaaactacgggggaggctttgccggtcctgtgaccatccaatctgctttgattagttctcgtaacgtcccggcggtggttattgggcaaaaaatcggcgttagcaaggtgattgaagtctgtcgtcgtttgggtataaatagtcccatgcaaccagtaatatctcttcctttgggtgctggtgacatgactcctctagaaatggccaacgcctacgctacctttgccagcaacggttggtattctgagccgactattattgtccgcattacagacagtcggggcaatgttttaagagataataccccaaaacctcaattagtgcttgatccttggtcaaccgcttccttaaccaccgtcttacgaggggtgatcaccagtggaaccggacgggctgctgacattggccgtcccgcagctggtaaaactggaaccacagataatgaacgaaatgtctggtttgtgggttatgttccccagttatctacggctgtatggatcggagatgacgctaaccgccctctgggtgcaagaaccacaggggggggtcatgctgcaccgatatggcgtagttttatgagcgaagtcctgaaaaatcaaccggttctacaattccatgctgcgtctaagttccctcgtcccaaggttaaagaaaaaaaatag

SEQ ID NO: 50255 - protein, 613 aa, Crocosphaera watsonii WH 8501
MSLLASSVVAGGLVGLAISFRKLPDVRSLNNYSPSETSYVYDIKGRLLTRLHGEANREAVTLDKISPELKRAVLAIEDSHFYLHQGINPNSIGRALWVNWKSGGVVEGASTITMQLVKNIFLTKDRTFTRKLSEAVLAVRVEQVFEKDKIMEMYLNNIYWGHNNYGVETAAQSYFYKSASELTLPEAAMMAGLIQAPETYSPFNNYANAKQRQKVVLDRMADVGWITPEEAQAAHKAPLEVGKPTSWQASKLPYVTDTVKQELQETFSKEVITKGGMRIQTSVDYFMQQRAEETVKKGYKQLRGRGLRTKDLQIALVAVDPRTHFIKAIVGGVDYEKSQLNRATQSLRQPGSSFKPFVYYAAFASGKYGPGSVVNDSPVSYRDGSGGSGVYSPRNYGGGFAGPVTIQSALISSRNVPAVVIGQKIGVSKVIEVCRRLGINSPMQPVISLPLGAGDMTPLEMANAYATFASNGWYSEPTIIVRITDSRGNVLRDNTPKPQLVLDPWSTASLTTVLRGVITSGTGRAADIGRPAAGKTGTTDNERNVWFVGYVPQLSTAVWIGDDANRPLGARTTGGGHAAPIWRSFMSEVLKNQPVLQFHAASKFPRPKVKEKK

SEQ ID NO: 50256 - DNA, 2694 bp, Exiguobacterium sp. 255-15
  CDS (1)..(2694)
atggaaagaagtcgtgtcgcacgtcgtgaagaaacaaagacgtcagccaagcaaacgaatcggacaaagcgtccgaaaaagaaaaaatcaggcgggaccggtggtaaaggtccgctttggaaaaaactcctattaatcgcgacaggattatttatcctgatgatgatagcagggggcggatttgcggcctatgccgtcgctactgcaccggagcttgatgagtcgaagttacgggatgccctgccgctaaaaatttatgcgagcaacaaagaagaaattaaaaagggcgggacgagccgggaatatgtctcgattaaagaagtaccggatgtcgttaaagacgcattcatctcgattgaagaccggcgtttctaccagcataacggaatcgatttccgacggttaggcggcgccatcattgctaatatcaccgatggtttcggttctgaaggagcttcaacgattacgcaacaggtcatcaaacaatcatttttaagttcagacaagaccattacccggaaagttcaggaacaatggttggcaattcgtctggagcgggactatacgaaagaacagattcttgagatgtatttgaataaaaactattacggtcaagaatcttacggaattcagacagcatcaaaagcctacttcaacaagacagtcgataagctgaactatgctgaagcagcgatgcttgcaggacttccgcaacgtccgtccgcatacgatccgattcaaggagatccgaagttgacgaaatggcgtcagacgcaagtcttgaacgcgatgttaacgaccggcgtcatcacagaaaagcaacgagataaagcagtcgatcaaccgatttcgaaattgatcaatccggcaccaaaatcgaaagacgacgcggcttacgacagtgtcatctttgacatggtgtcgcaagagttagaagatgtttttggtctagaaggtaaagatatttacggtcaaggattaaaagtgtatacgtcgatcgataagccgatgcacgattatatgaacgaagcaatcaaaaaagaccaagtcgtccagttgccggattacgcggaagcagcagcgacagcggtcaatacacaaacaggtgagattttaggaatcgtcgacgggaaaaagcccggtacgggtactgcgcgacgtaactttgctaaagaaccgcatcaacccggttcatcggcaaaaccatttttcgcatacggaccagccattgaaaatgagaaatggtcgacagctaaaatgctgacggaccaggaaacagaagtaaacggtaaaaagatcggtaactattatgacgggtaccggggcaccaacacgattcgctactggctgaagatttctgctaatacgcctgctatccagacgttccaacaaattggcggcgataccatcgaaagctttgccgctaagtccggattgggcttagaaaaagatgaatcgatttcaccggcgtatgcgattggcgggatgaaacacggattcaacacgacgcaaatggcctctgcctatgcgacgcttggtaatgggggagactacatcaaaccgcacatcatcaaaacgattgaatacagtgacggctcaaaaatcaaatcaccggtcaaaccgaaaaaagccatggaagactatacggcttacatgttaaccgacatgctacgtgatgttctaaaaccaggcgggacgttcccgagtgctgtgcttgcttttgacgcagcgggtaaaaccggaacaaccaatgcttataaagatgtctggtttgctggttatacatcagatgtctcgatcagtgtctggaccggaacaacgaagtcgggcaacaacaatggtgccggcttaagcggaccgaccaacagtacgatggcacaaaacatttggaaagattttgtcacgaaaacacgtgaccggacacctgctccgttcgaacaaccgagttctgtcctcagtatcggtgaggaactgtacgttaaagggacaaaagagccggttgtcgaaaaaaaggcagtaccagctccgactggcttacaagcatcctacaatgaagactcggagtctggtgaactgacatggagttataatgattcggcacttcggacgaacggctatgacagtgtatcgttcgaagtatcgatgaccgatcctgacggaaaacaatctgtactcggcaccagctcaacaaaccggatcgggatcaatcgacttgatccgggacggacgacatttacagtcgtcgcgaaagcatccggagaaaaatccggtcctgtatcaacgacggtaactgtggcagacgttgaagcagatcaaccgacaacggacgagccgacaacggacgagccgacaacggacgagccgacaacggacgagccgacaacagatgagccggaaacagatgaaccgacgacggatgaaccgacgacggacgaaccggcaacggacgaaccaacgacggatgaaccgacgacggatgaaccggcaacggacgagccgacaacggacgaaccaacgacggatgaaccaacaacggacgagccgacgacggatgaaccaacgacagatgaaccggctgcaagtgacggggcatctactcagtcaaaccgggggaattcgtcgaacggcaatcaaggccgaggacaagataattcgcctgctgatcaacagtccgaatcggaaacacagcaataa

SEQ ID NO: 50257 - protein, 897 aa, Exiguobacterium sp. 255-15
MERSRVARREETKTSAKQTNRTKRPKKKKSGGTGGKGPLWKKLLLIATGLFILMMIAGGGFAAYAVATAPELDESKLRDALPLKIYASNKEEIKKGGTSREYVSIKEVPDVVKDAFISIEDRRFYQHNGIDFRRLGGAIIANITDGFGSEGASTITQQVIKQSFLSSDKTITRKVQEQWLAIRLERDYTKEQILEMYLNKNYYGQESYGIQTASKAYFNKTVDKLNYAEAAMLAGLPQRPSAYDPIQGDPKLTKWRQTQVLNAMLTTGVITEKQRDKAVDQPISKLINPAPKSKDDAAYDSVIFDMVSQELEDVFGLEGKDIYGQGLKVYTSIDKPMHDYMNEAIKKDQVVQLPDYAEAAATAVNTQTGEILGIVDGKKPGTGTARRNFAKEPHQPGSSAKPFFAYGPAIENEKWSTAKMLTDQETEVNGKKIGNYYDGYRGTNTIRYWLKISANTPAIQTFQQIGGDTIESFAAKSGLGLEKDESISPAYAIGGMKHGFNTTQMASAYATLGNGGDYIKPHIIKTIEYSDGSKIKSPVKPKKAMEDYTAYMLTDMLRDVLKPGGTFPSAVLAFDAAGKTGTTNAYKDVWFAGYTSDVSISVWTGTTKSGNNNGAGLSGPTNSTMAQNIWKDFVTKTRDRTPAPFEQPSSVLSIGEELYVKGTKEPVVEKKAVPAPTGLQASYNEDSESGELTWSYNDSALRTNGYDSVSFEVSMTDPDGKQSVLGTSSTNRIGINRLDPGRTTFTVVAKASGEKSGPVSTTVTVADVEADQPTTDEPTTDEPTTDEPTTDEPTTDEPETDEPTTDEPTTDEPATDEPTTDEPTTDEPATDEPTTDEPTTDEPTTDEPTTDEPTTDEPAASDGASTQSNRGNSSNGNQGRGQDNSPADQQSESETQQ

SEQ ID NO: 50258 - DNA, 1707 bp, Exiguobacterium sp. 255-15
  CDS (1)..(1707)
atgcgtaatcagttggatcttgcacaggatttgttcagttgggctgatcaaaaaacgactgaacgccctcttgcttcctatcaaccgattactgtcacgtatcaaaaagagcgcctcgaactctatgacggacttcgccggaacgatttaaaggcaagtgctctgccgccaaaggtagcacaggctttcatcgcgattgaagaccagcgattttatcagcatgacggttatgatatcaccggtattttgcgagcgtttacagaaaatcagtccggtgataacaaaggtcaaggcggaagtacgatcacccaacaattggcacggatgacttatctttccaccgagaaaacctatactagaaaaataaaagaaatcttaattgcaatggaacttgagcaaaaatattctaaaaaagagcttttaaccgcatacgtcaatcaagcgtatttcgcgaataatatttacggtatcgagctcgcagccacatcgtatctcggaaaacatgcggaagatttgagttgggctgaagtcagttatttggctgcgattccaaataatccgtctctttacaatccattgcggtttccaaaaaacacgggcaaacgtcaacagcgtatcttaaaagcgttgcaacagacacaggacattccaaataaagtccgaaaacagtccatcaacgtttcgttcaataagccgatcatccgttatcctgattacatcgatgccagtgtatcggaagcaatccgccagacagctgacttaaaaaatttgaacatgtcacaggctgagcagtatttacatcaacacggtgccgtcatccagacatatcttgatcctacagagcagacgcgggccaaacaagcgattcaacgactccctcatccgattgaaggtgcttacgtcggaatcgacggggatacacgcggtgtgacggcactggtcggtaataaatccaatgtaccgggtcagctcaatcgggcggttcaatcttatcgtcagcccggctccaccttaaagccgttgcttgtttatggtccttacctcgaaaagaccaaaaaaacgttaacgagtcgactagatggaagtcctgtttgttttgacggatactgtccgcaaaacagcagcaaccggattcttggcagcgtgacgattgccgatgcgattgcatactcctacaatacaccggccttacgtgctttttctgtttcgttcaacgagggattaaagaccatccgaccgtttcgattcagtcagtggaccgaagaagataattcatacaacagtgcgctcggcgggctaaaatacggtgtcagtccacttgaactcaccaatgcctacaccacccttgtcaatgatggactgtacagtccctcctcgatgatccgcaccatcacgacggatcagggaaccctttaccgtcatgtgatgtcaacggaccggatttggtcgagtcgaacaaaccagttactgcgtaaagggctccataacgtcatgacatacggtacagggcggttgggttacgatcacgccccggcttatatcggaggcaagacaggtacgacgaacgacaataaggacatgtggtttgtcggtatgaaaaatcaacatgtcggcggaatctggattggggcggacatcccccgtgccttcccgagtgaagccaacagtacgttacaagtcaggacatgggcttcgatcgtccagtga

SEQ ID NO: 50259 - protein, 568 aa, Exiguobacterium sp. 255-15
MRNQLDLAQDLFSWADQKTTERPLASYQPITVTYQKERLELYDGLRRNDLKASALPPKVAQAFIAIEDQRFYQHDGYDITGILRAFTENQSGDNKGQGGSTITQQLARMTYLSTEKTYTRKIKEILIAMELEQKYSKKELLTAYVNQAYFANNIYGIELAATSYLGKHAEDLSWAEVSYLAAIPNNPSLYNPLRFPKNTGKRQQRILKALQQTQDIPNKVRKQSINVSFNKPIIRYPDYIDASVSEAIRQTADLKNLNMSQAEQYLHQHGAVIQTYLDPTEQTRAKQAIQRLPHPIEGAYVGIDGDTRGVTALVGNKSNVPGQLNRAVQSYRQPGSTLKPLLVYGPYLEKTKKTLTSRLDGSPVCFDGYCPQNSSNRILGSVTIADAIAYSYNTPALRAFSVSFNEGLKTIRPFRFSQWTEEDNSYNSALGGLKYGVSPLELTNAYTTLVNDGLYSPSSMIRTITTDQGTLYRHVMSTDRIWSSRTNQLLRKGLHNVMTYGTGRLGYDHAPAYIGGKTGTTNDNKDMWFVGMKNQHVGGIWIGADIPRAFPSEANSTLQVRTWASIVQ

SEQ ID NO: 50260 - DNA, 2037 bp, Rubrobacter xylanophilus DSM 9941
  CDS (1)..(2037)
atgaacccccgcttcgagacgggcacggagagcaagggacggcgtccgggagggctgctggcgctgctcagggctgcctttaacgccgcgctcctcgcggtcgcggcggcgctcgtgctgctgctcggcgcctacgtctacgcgctggagcgctacggcgaggggatctcccggcgctacccggcgctccccgaggactcctacgtctacagcgcggacggcgagcgggtcggcgtgatcccggcctcccagcgccggaggaccgtccccttcgaggagctcggcccctacctgccgcgggccgtggtcgccgtggaggaccggcgcttctacgagcacgccggggtggacccggagggcgtgctccgggccgcctggaccgacctgagggcctgggaggtgcaggagggcggctccaccatcaccgagcagctcgtcaagaacctctacatcccggaggaggagcgtttcgaggtctccttctggcggcggctcctgcaggcgtgtctggcccacgcctacgagcagcggcacaccaagcgcgagatcctcaccgcctacctgaacgccgtgtacttcgggcggggggcctacggcgccgaggcggccgcgagggcctacttcggtaagagcgcccgagagctcgacctctccgaggcggcggccctggccggcttcctgcacgccccctcctcctacggccggggcggcgaggagcgggccgaggaccgcagggacgccgtgctgcggctgatgcgcgggcagggcgtgatctccggtgcccagtacaggagggccgtctcgcgggagctgcgcttctccccgccggaggggcgggaggaccccgtctacgagccctttctggagcgggtgcggcgcgaggtcgaggagcacctcggcgaggaggcgctccggcgcggggggctcaggatccgcaccaccctcgacccccgcctgcagcgggtcgccgccgccagcgccgccgacaccctctacgcccccggggacccctcggccgccgtggtcagcgtcgagccccagagcggcgccataaaggccctctggggccgggagggggacttcaacctcgccctcgacgcccggaggcagccgggcagcgccttcaagcccgtggtcctcgcgaccgcgctcaaggagggcatctccccctacagcacctacctctccggcggcctcagcctcgagttccggggcgaggagtacgtcgtcaacaactacggctacgaggagcgcggcgagatctccctcgccgacgccatggccgtctcggacaacacggtcttcgtgcggctcgcgatggacgtggggctcgaggaggtggcccggaccgcccgcgagctcgggatacgctcccccgtggagccctacccctcgaccgccatcggggggctcggggtgggggtgagcccgctggagatggcctccgcctacgccaccttcgccggcgggggggtctaccgcgagccctacgccgtagaggagatccggcgcgaggcctacggcgggggcgagacgctctacgaccaccgggtctccggacgccgggtgctcggcggcaaccaggccgcggcggtgaccgacgtcctgcgcggggtggtggagcgggggaccgccagccgctaccgggatctcgacgccgagctggggcgcccctcggcgggcaagaccggcacctccgacgggttcgccgacgcctggtacgccggctacaccccgcagctcgccaccgcggtgtgggtcggctacccggaggggcgccgctcgatggccggggtgcacggcatagaggaggtggggggagagacgctgccgctggacatctgggcggcgtacatgcgcgaggccacccgcggcgagcccgtgtggggctttcgcgagccggactacgggaagttccgggtggtggaccgcgcctacggcggcccctccggggaggccgtagccctcgcgtcttcgctccagagcaggatacgcgccatggtcgatgaggcgttgcgggaagccttcggggggtga

SEQ ID NO: 50261 - protein, 678 aa, Rubrobacter xylanophilus DSM 9941
MNPRFETGTESKGRRPGGLLALLRAAFNAALLAVAAALVLLLGAYVYALERYGEGISRRYPALPEDSYVYSADGERVGVIPASQRRRTVPFEELGPYLPRAVVAVEDRRFYEHAGVDPEGVLRAAWTDLRAWEVQEGGSTITEQLVKNLYIPEEERFEVSFWRRLLQACLAHAYEQRHTKREILTAYLNAVYFGRGAYGAEAAARAYFGKSARELDLSEAAALAGFLHAPSSYGRGGEERAEDRRDAVLRLMRGQGVISGAQYRRAVSRELRFSPPEGREDPVYEPFLERVRREVEEHLGEEALRRGGLRIRTTLDPRLQRVAAASAADTLYAPGDPSAAVVSVEPQSGAIKALWGREGDFNLALDARRQPGSAFKPVVLATALKEGISPYSTYLSGGLSLEFRGEEYVVNNYGYEERGEISLADAMAVSDNTVFVRLAMDVGLEEVARTARELGIRSPVEPYPSTAIGGLGVGVSPLEMASAYATFAGGGVYREPYAVEEIRREAYGGGETLYDHRVSGRRVLGGNQAAAVTDVLRGVVERGTASRYRDLDAELGRPSAGKTGTSDGFADAWYAGYTPQLATAVWVGYPEGRRSMAGVHGIEEVGGETLPLDIWAAYMREATRGEPVWGFREPDYGKFRVVDRAYGGPSGEAVALASSLQSRIRAMVDEALREAFGG

SEQ ID NO: 50262 - DNA, 1959 bp, Rubrobacter xylanophilus DSM 9941
  CDS (1)..(1959)
atgctcctgctcaccgggttcgtcgcgggcgtggcgttcgccgcgggagcctacctggggctcgtcaagagcgtccgccagctggagccgccgccggtgaccgagtcccacccgacgtatatatattcggccccgctcggcgagggcgacggttccaggcgggtgatagggaccatcttccagggggagaaccggcagaccatcccgaagtcccagatgccgccgcacctgctcaacgcgctcgtcgccaaagaggacgaacgctttatgcagcatcccggcgtggacctgtggggcatcatgcgggcgctgtgggtggacatccgggccggcaggtacgtggagggggcctccaccataacccagcagtacgtgcgcaacgtctacctctcccgggagcagtccataacccgcaagataaaagaggccctcatcgccgtacagatagagacggtgaaggacaaggaggagatcctggcggactacctcaacaccgtctacttcgggaacaacgcctacggcgtggaggccgccgccgagacctacttcaacaagagcaccgaggacctcacgatagccgagtccgccaccctcgtggggctgctctggtcgccctccacgctgggggacgacaaggaggcggcaaagaagcagcgggacctggtgctcaagaagatgttcgacgccggctacataacgcggcaggactacgagagcgccctcgaggagccgatgcccgaggactggccgcaggccccgatgctcgagacggggctcaccggcccgccgctcacccgggagttcgccgagctggtgcaggacgagctgatccggcgctacggggcgaacaccgtgctcagagggggactcgacgtctacaccacgctggacctcgagcagcagatggcggcctacgaggtgctctacggccccaacgggtacctgccgtcgcccgagcaaccggacggggcgctggtctccataaaccccgagaccgggcacataaccgcgatggtcggcaacagggatcccgagtcccagttcaacctggtgacccaggcgcgccggcagccgggcagctcgttcaagcccttcgccctcatcgcggcgctggagcagggcatagacccggacacccacttcatatcggagaagaaggtctaccaggtgcccaagggcaacgggcagaccgagcgctggaaggtggagaactacgagaagatcgaaaggggctccatctccctgaaggaggcgctctgggagtcggacaacacggtgttcacggacctggtgatgaacgccgggggcaagggcctgaagaacggtcccgaagcggtcgccgacgtcgcccggcggctcggggtctcggcggacttcggggagcacccggacccctcgatcgtgctcggggcctacgaggtctcgccgctggacatggcgacggcctacgcgaccatagccaacggggggcgcagggtggagcccacgctcatagagaaggtcgtccgaaacgagggccaggagggcgaggaggtgctcttccgggccccggagcaccccctgggccggcaggtcatagacccggagatcgcccgcgaggcgatcgggatcatgatgggcgacgtgatgtggggcatcgcgggggacgcggcgctccccggccgccaggtggccggcaagacggggaccagcgagaacttcttcgactcctggtttatcgggttcacgccgcagctgacgacggcggtgtggatgggctacgccgagggcggcaagaccctggaggagctgctgagccgcgacggcgcgctctacggcacggtgggctcgccggaggagatctggcacgactacatgctgcaggcgctcgacggcgagccggtggagcgctttgagggggtggaggagcccccgcccccggaggacgaggacgccccggccgctacgcgggttccctga

SEQ ID NO: 50263 - protein, 652 aa, Rubrobacter xylanophilus DSM 9941
MLLLTGFVAGVAFAAGAYLGLVKSVRQLEPPPVTESHPTYIYSAPLGEGDGSRRVIGTIFQGENRQTIPKSQMPPHLLNALVAKEDERFMQHPGVDLWGIMRALWVDIRAGRYVEGASTITQQYVRNVYLSREQSITRKIKEALIAVQIETVKDKEEILADYLNTVYFGNNAYGVEAAAETYFNKSTEDLTIAESATLVGLLWSPSTLGDDKEAAKKQRDLVLKKMFDAGYITRQDYESALEEPMPEDWPQAPMLETGLTGPPLTREFAELVQDELIRRYGANTVLRGGLDVYTTLDLEQQMAAYEVLYGPNGYLPSPEQPDGALVSINPETGHITAMVGNRDPESQFNLVTQARRQPGSSFKPFALIAALEQGIDPDTHFISEKKVYQVPKGNGQTERWKVENYEKIERGSISLKEALWESDNTVFTDLVMNAGGKGLKNGPEAVADVARRLGVSADFGEHPDPSIVLGAYEVSPLDMATAYATIANGGRRVEPTLIEKVVRNEGQEGEEVLFRAPEHPLGRQVIDPEIAREAIGIMMGDVMWGIAGDAALPGRQVAGKTGTSENFFDSWFIGFTPQLTTAVWMGYAEGGKTLEELLSRDGALYGTVGSPEEIWHDYMLQALDGEPVERFEGVEEPPPPEDEDAPAATRVP

SEQ ID NO: 50264 - DNA, 2145 bp, Mesorhizobium sp. BNC1
  CDS (1)..(2145)
atggtagagaagcgtacgccgaagaagggaaatacaccgagggccacgatcttcctcgacatagatgcgtggatcgattccaccctctatgagctgcgtttcaaagccgccgagttctgggaagacctcaccgtcttcttccgccgcttccgcttctacggcttaaggcgcgccgtcatcgaattcttcagcgaaggggtcaccatgctggccgcgggctcggtggttatgctgggtcttgccatacccgccttccaggagacagcgggcgactggcgcgcgcaggacgattatgccgtcacctttcttgaccgctacgggcaggagatcggccagcgcggcatccgccagcgcgattccgtgccggtcgacgagatgcccgaccatgtggtcaaggctgtcctggccacggaagaccggcgcttcttcgagcatttcgggattgatttcgtcggcctgttccgcgcgctttctgagaacatgcgcgccaattccgtggtgcagggcggctccaccatcacgcagcagcttgcgaaaaacctgttcctcaccaatgagcgcacggtggagcgcaagatcaaggaagcatttctcgccgtctggctggaagccaatctgacgaaaaaagagatcctgcagctttatctcgaccgcgcttatctcggcggcggcactttcggcatctccgccgcggccgatttctatttcggcaagcaggtcaaggacctcacattgcccgaggcggccatgatcgccggcctcttcaaggctcccgcgcgctatgcgccgcatatcaatcttcccgccgcgcgcgcccgcgccaatgaggtgctcagcaatctcgtccagtcccgcttcatgacggaggggcaggtgctttcggcccggctcaatccggcgactgcggtggaccgcggcgaccgcgaggcgcccgactatttcctggattgggcgttcgaggaggtgaagaagatcgtgccggagggcgcaacccattcgctggtggcgcgcacgaccatggaccttgacctgcagcatgcggtcgaggaatcgatcgaatttcatctgcgccaatacggcaaggattacgacgtggaggaaggcgccgctatcctcatggatacggacggcgcggtacgcgcgctggtcggcgggcgggactacggccagagccagttcaaccgcgcaacgcgcgccgcgcgccagccaggttcctccttcaagccctatgtctacgcggccgccatggaagcgggtttgacgccgaagaccgttgtttccgacgcgcccatatcctggggcaactggtcgccgcagaattacgggcgcagctatgccggccgcgtcgacctcgcgacagcgctcgcaaggtcctacaacacggtccccgtccgcctggcgcgcgaccatctgggcatcgatgtcatccagaagctggtgaaagatatgggcgtggaaacgccgctcaacggccataagaccatggtgctgggcacgtccgatctgacggtgctggatcaggtgaccggatacagcgttttcgccaatggcggctttgccggcacacgtcacggcatcctggaactgcatactcacaccggcgaactcgtttacgattggcggcgcgatgcgccgccgccacgccgcgtcctttccgaaacggccgtttcgaacatgaacagcatgctggttgaggtgccggagcgcggcacggcccggcgcgcggcccttcccaatatccgctccgcggggaaaaccggcacgacccagtcctatcgcgatgcctggtatgtcggttacaccggaaattatgtcgccgccgtctggctcggcaatgacgattacaggccaaccgacaatatgaccggcggcacgctgccggccatggtctggcaacgcttcatggcctatgcccaccagaacctcgagttgaaacctattccgggcatcgaaaatccgctgcccgccaagagcgacgaggccgtggcggctgccaaaaccgagggtgtggaggccggtccgcgccggccggcgcatagcctgccgcttgccacccgcaccgtgctgaacgatctgctcgggctcttccgccaggcgccccccgtcaagcctcgccgcgtctccgaaaacctgtcggctctttga

SEQ ID NO: 50265 - protein, 714 aa, Mesorhizobium sp. BNC1
MVEKRTPKKGNTPRATIFLDIDAWIDSTLYELRFKAAEFWEDLTVFFRRFRFYGLRRAVIEFFSEGVTMLAAGSVVMLGLAIPAFQETAGDWRAQDDYAVTFLDRYGQEIGQRGIRQRDSVPVDEMPDHVVKAVLATEDRRFFEHFGIDFVGLFRALSENMRANSVVQGGSTITQQLAKNLFLTNERTVERKIKEAFLAVWLEANLTKKEILQLYLDRAYLGGGTFGISAAADFYFGKQVKDLTLPEAAMIAGLFKAPARYAPHINLPAARARANEVLSNLVQSRFMTEGQVLSARLNPATAVDRGDREAPDYFLDWAFEEVKKIVPEGATHSLVARTTMDLDLQHAVEESIEFHLRQYGKDYDVEEGAAILMDTDGAVRALVGGRDYGQSQFNRATRAARQPGSSFKPYVYAAAMEAGLTPKTVVSDAPISWGNWSPQNYGRSYAGRVDLATALARSYNTVPVRLARDHLGIDVIQKLVKDMGVETPLNGHKTMVLGTSDLTVLDQVTGYSVFANGGFAGTRHGILELHTHTGELVYDWRRDAPPPRRVLSETAVSNMNSMLVEVPERGTARRAALPNIRSAGKTGTTQSYRDAWYVGYTGNYVAAVWLGNDDYRPTDNMTGGTLPAMVWQRFMAYAHQNLELKPIPGIENPLPAKSDEAVAAAKTEGVEAGPRRPAHSLPLATRTVLNDLLGLFRQAPPVKPRRVSENLSAL

SEQ ID NO: 50266 - DNA, 2457 bp, Mesorhizobium sp. BNC1
  CDS (1)..(2457)
atgttacgtctcttaggatattttttcggcatcggcattgtctttgcgctgattgctgctgcaggtgtggcactctatgtcggagatctgtcgaaagacctgcctgattacgaagtgctggcaaagtatgaaccgccggtgatgacccgcgttcatgcgtccgacggttcgctgatggcggaattcgcccgcgagcggcgcctttaccttccgatcaaggccattccggaccgtgtaaaggccgcatttctttcggctgaggacaagagcttctattcccaccctggcgttgatccggcgggtctggtcagcgctgtgttcaccaatctgcagaatatcggtaccgggcgcaggccggtcggtgcatccacgatcacgcagcaggtggcaaagaatttcctgctgagctctgaccagacgatcgagcggaagattaaggagatgattctcgccttccgtatcgagcaagcctactccaaggatcgcatcctggagctttatttgaatgagatcttcttcggtcttggcgcatacggaatcgccggcgcggcattggcctattacgacaagcctgtttcagaactcagcatagcggaagccgcatacctcgcctcgctgcccaaagggccttcgaactaccatcctttccgtcataccgatcgcgccctcgagcgccgcaattgggtaatcgatcggatgcacgcgaacggctacatcaccgccaaggaagccgcggaggcgaaggccaccggcctcgacgtgaagccgcgcgaacgtggcaattatctcgccggctctgaatatttcaccgaggaagtccggcgtgagcttatcgcgcgctatggagaggacgccctttatgatggcggcctctatgtacgcactacgctcgatccaaagctgcagcttctcgctgagaaagccttgcgccacggcctgatgaagtacgataccctgcggggctaccgcgggccggtgaagcatatcgatatctccggcgattggggcgaaccgctggccgaagtgcccggtctgcgtgacgtatccgagtgggctttggccgttgtccttgaagcttccggcaacgatgtgaagatcgggatacagcccaagcgcgagatctccggcgagctgtcgaaggagcgggaaaccggaacaatcgacactggcgatatcggctgggtgctccgtcacgtggtcgatgggaagctcctcaaggcaaagtcgctggaagacgtgttcgagccgggcgatgtgatctatgtcgagcgcaaaagcgagggacaggatacgtggctggttcggcaggtgccggcaatcggcggcgcgctggttgccatggatccgcacaccggccgcgtgcttgcaatggcgggaggcttctcttacgcggcctccgagttcaaccgcgccacgcaggcctaccgccagcccggctcctccttcaagcccatcatatatgccgcggcactcgacaacggatacacgcccgcgacggtgatcatggacgcgccgctcaccatccatgtcggaaaccaggtctgggagccgaagaactatggcggcgatttcgccggcccctccacgctgcgcacaggcatcgagcgctcgcgtaacctgatgacggttcggctagcgcaggatatgggaatggatcttgtcgccgaatatgcggagcgtttcggcatctatgacgacatgccggagcacatcgccatgtcgctgggctcgggcgagacgacggtgatgcgcatggtctcggcctatgcggtcatggccaatggcggcaagttcatccagccctcgctcgtcgatcgcatccaagaccgctacggcaggaccgtctacaaacacgacacgcgcgagtgcgagggctgtgccgccgatgcttggaaaaatcagcccgaagccgagctgatcgacaatcgcgagcaggtgcttgacccgatgaccgcgtaccagatcacctccatcatgcagggcgtggtgcagcgcggcacggcaagcagcctggcggagctcggccgccccattgcgggcaaaaccggtacgacgaacgacgagaaggatgcctggttcattggctatacgccggacatggtcgtaggcgttttcatgggatacgatcagccgaagcccatgggcaagggttccaccggcagcggcctggcggcaccggtcttcaaggaattcatggcggatgccctgaaggacatgcgtcccgtggacttccaggttcccgaaggcatgcagctcatcgccatcgaccggaagaccggcatgcgggctcaggaaggtgcgcccggcaccatcctggaagccttcaagcccggcaccggcccggcggacagctattgggtcatcggcatggagagctcccaggtgagcaccggcgcgagcaatatctcgcccgaggcaaaccgggcgatcacctccggggcaggcggcctcttttag

SEQ ID NO: 50267 - protein, 818 aa, Mesorhizobium sp. BNC1
MLRLLGYFFGIGIVFALIAAAGVALYVGDLSKDLPDYEVLAKYEPPVMTRVHASDGSLMAEFARERRLYLPIKAIPDRVKAAFLSAEDKSFYSHPGVDPAGLVSAVFTNLQNIGTGRRPVGASTITQQVAKNFLLSSDQTIERKIKEMILAFRIEQAYSKDRILELYLNEIFFGLGAYGIAGAALAYYDKPVSELSIAEAAYLASLPKGPSNYHPFRHTDRALERRNWVIDRMHANGYITAKEAAEAKATGLDVKPRERGNYLAGSEYFTEEVRRELIARYGEDALYDGGLYVRTTLDPKLQLLAEKALRHGLMKYDTLRGYRGPVKHIDISGDWGEPLAEVPGLRDVSEWALAVVLEASGNDVKIGIQPKREISGELSKERETGTIDTGDIGWVLRHVVDGKLLKAKSLEDVFEPGDVIYVERKSEGQDTWLVRQVPAIGGALVAMDPHTGRVLAMAGGFSYAASEFNRATQAYRQPGSSFKPIIYAAALDNGYTPATVIMDAPLTIHVGNQVWEPKNYGGDFAGPSTLRTGIERSRNLMTVRLAQDMGMDLVAEYAERFGIYDDMPEHIAMSLGSGETTVMRMVSAYAVMANGGKFIQPSLVDRIQDRYGRTVYKHDTRECEGCAADAWKNQPEAELIDNREQVLDPMTAYQITSIMQGVVQRGTASSLAELGRPIAGKTGTTNDEKDAWFIGYTPDMVVGVFMGYDQPKPMGKGSTGSGLAAPVFKEFMADALKDMRPVDFQVPEGMQLIAIDRKTGMRAQEGAPGTILEAFKPGTGPADSYWVIGMESSQVSTGASNISPEANRAITSGAGGLF

SEQ ID NO: 50268 - DNA, 2040 bp, Mesorhizobium sp. BNC1
  CDS (1)..(2040)
atgaccgcggccacgatcgccggcgccttcaccctccatcacctcgatcaagcctatccgcccccgcttgaaaacaccggcgcgctttcacaggaagtggtggaccggaaaggagcgctcttgcgtgtctatgcagcgcccgatgggcgctggcggctgaaggcggagatcgaacagctcgacccgcaattcatcaagatgctggtcgcctatgaggaccggcgcttctggtcgcattccggcgttgatccaatcgcccttgctcgcgcggccatgcagctggtgctcaacggccgcgtcgtctccggtggctccacattatccatgcagcttgcacggctgatcgagccgcgggaggagcgcagcttttcagcaaaattccgccagatcgcccgagcgctacagatcgagtggcgactgtcaaaacgcgagatcctgaaccgctatctgacgctcgcgccctatgggggcaacctggagggcgtgcgcgccgcgagccttgcctggtttggcaaggagccgcagaaactcacactttccgaggctgccctgcttgtcgccctgccgcaatcgcccgaggcgcggcggcccgaccgccatccagataccgcgaaatcggcgcgcgaccgggtgctggcccgcatggccaaggccggcattattgccgagggagaggtggagcgcgcctcgcgcgggaaggtggcggcgcagcgcctgcccatgcccgcctttgccgcgcatcttgccgacaccgtgatccgtgcaacacccggggagctgcgccggccgctgctgcttgaccgcggtgtgcaggccgcgctggaggaagtggcgcgtgaaggcgcgcggcggctcggccgcaaggtgtcagtggcgatggtcatggccgacgcccgaacgggcgacgtgctcgcgcgcgtcggatcggccggttatttcgattcaagccgggcaggctggatcgatatgagcgtggccgagcggtcccccggctcgacgctaaagccttttatctacgcgcttgcgatcgaagacggcctcgtcatgcaggagacgatgatcgaggaccgcccaggcaatttccacggctaccgcccgcgcaatttcgacatggagtatcagggcgatgtcacggtccggcaggcattgcagatgtcgctcaatgtgccggcgatccggctgcttgatgcggttggcaccgcccggcttatctcccggctcaagcgcgccggcgtgcaacttgcgcttccaaaggggcaggcgccggggctcgccatcggacttggaggcgcagggctgacgctcgagaagctggtgcaagcctacaccgcgcttgccaatcgcggcgaggccaggatgctgcgctattcgaccgaggacgaagagacggcctctacggaggtgctgacaccagcggccgcctggcagattgccgatatgctctcgggcgtggtcccgccgcaaggcgcgccgcgcctcggcatcgcctataagaccggcacctcctacggctatcgcgacgcctgggcggtgggttacgatggccgacacgtgctgggcgtgtgggttggaaggccggacggaggatcggtgccgggtcttaccggctatcttgccgcggcgccgatcctgtttgaagctttctcccgctccggtgtcgggattacgccgtttccgccccggcctgcaggggcggtacggcttaccgcggcagaattgccgatgccgcttcgccggttctcctccacgttttcagcggcgcagacgggagcccccacggaacccgcaccggaaatcgtctttccgccagaaggcgcacgcatcgatgtcggtctttccgagaaccgcaatgcgggaatccttgccctcaaaatcattggagggcgggcgccgttcaggtggcttgccaatggcaagccgcttgcggaaacctttcgccggcgcaccgcctcatgggcgcctgatgggggcggcgcttccacgctcaccgtcatcgacgcggcagggcgcaccgccagcgtcagcgttttcctggagtag

SEQ ID NO: 50269 - protein, 679 aa, Mesorhizobium sp. BNC1
MTAATIAGAFTLHHLDQAYPPPLENTGALSQEVVDRKGALLRVYAAPDGRWRLKAEIEQLDPQFIKMLVAYEDRRFWSHSGVDPIALARAAMQLVLNGRVVSGGSTLSMQLARLIEPREERSFSAKFRQIARALQIEWRLSKREILNRYLTLAPYGGNLEGVRAASLAWFGKEPQKLTLSEAALLVALPQSPEARRPDRHPDTAKSARDRVLARMAKAGIIAEGEVERASRGKVAAQRLPMPAFAAHLADTVIRATPGELRRPLLLDRGVQAALEEVAREGARRLGRKVSVAMVMADARTGDVLARVGSAGYFDSSRAGWIDMSVAERSPGSTLKPFIYALAIEDGLVMQETMIEDRPGNFHGYRPRNFDMEYQGDVTVRQALQMSLNVPAIRLLDAVGTARLISRLKRAGVQLALPKGQAPGLAIGLGGAGLTLEKLVQAYTALANRGEARMLRYSTEDEETASTEVLTPAAAWQIADMLSGVVPPQGAPRLGIAYKTGTSYGYRDAWAVGYDGRHVLGVWVGRPDGGSVPGLTGYLAAAPILFEAFSRSGVGITPFPPRPAGAVRLTAAELPMPLRRFSSTFSAAQTGAPTEPAPEIVFPPEGARIDVGLSENRNAGILALKIIGGRAPFRWLANGKPLAETFRRRTASWAPDGGGASTLTVIDAAGRTASVSVFLE

SEQ ID NO: 50270 - DNA, 2172 bp, Mesorhizobium sp. BNC1
  CDS (1)..(2172)
atggcgaagcgcgatcggggaaaacgcatcgaaccaagcttcggcgcaccgggcgggcggcgctctggaacattgtcggtgagccagtccgaccgtattctccctcccgcgcgccgtccgagccgcaaaaagggtaaaaagaaagcccaccgccgttccagccgcgcgcggcgcagcgggctcggaggttttctgcgaggcttcgtctactggtcgatcgtgctcgccctttggggagggatcgccgctgcagggctcatcgcctattacggcgcccagatgccgagcctaaccacctgggtgattcccgataggccgcctaacgtaaagatcgtggcagtggatggcacgctgatcgccaatcgcggcatgacaggcggcgaagcgatcggcctgcacgaaatgtcgcccttcatcccccaggcggtgattgccatcgaggatcggcgcttctactcccattggggcgtggatccgatgggtatggcgcgcgcgatggtcgcgaacctgcttgagggcgagctgtcccagggtgggtccaccattacccagcagctggccaagaacctctatctgaaacccgaccgcacgcttgagcgcaaggttcaggagatgctgctcgctctgtggatggagcagaaatataccaagaaccagatactcgagatgtatctcaaccgggtctatttcggttcgggcgcctatggcgtggaggctgcttcacagcgctatttcaacaagtcggcccacgaaatcacgctttccgaggcggctttgctggccggcctcctgaaggctccctctcggctttcccccgcgcgcgatccgcaggccgcagaggaacgcgcccaggtggtgctctcggccatgcgcgaggagggcatgatcggcgacagccagctggcggcggcgatgagcgcgcctgccaaccgcgcggcagcctactggaccggctcggagcactacgtggccgatcggatcatggaagagctgcccgctcttgtcggcacggtggaacgggatgtggtggtcaaaaccaccattgacctgcatttgcagaaggtggcggaaaagtcgatccgccgcctcattgacgagaaggggaagcagcttcaggtaagccagggtgcgctcgtttccatcgacggttccggtgcggtacgcgcgatggtgggcggatatgattatgcgcacagccaatttgaccgtgcctcggaggcgcggcggcagcccggctcggctttcaagccattcgtctacatggccgcgcttgaacaggggcgcacgcccgacagcatgcgcaacgacgcaccggttcgaatcggcaaatggcggccggagaattatcagggcaagtattatggccaggtcacgctggcggaagcgcttgcgcggtcgctcaattccgtcgcagcgcagttggccgtcgaggtcggacctgaagcggtcgtcgaagtggcgcatcgcatgggcgtcgagtcgagcctcaacgcgaacgcttcgatcgcgctcggcacatccgaggtgacgccgcttgagctcaccgccgcctatgtgccgttcgccaatggcggctttaagcccgagatacacttcatcgaaaccatcaccaccgcgtccggcaaggtgctctaccagcaaaaggcaagccacgtcccgcgcgtggccaatgccgagatcatcggcatgatgaattacatgatggcaggtacaatcgagtacggcagcgggcgagccgccgctttcggctggcctgccgcgggcaagacgggcaccacgcaggaatcccgcgatgcctggttcctcggctatacatcgaatcttatcaccggtgtctggttcggcaatgacaacagccgccccaccaaggcaaccggcagctcgttgccggcggaggcatggcgcgagttcatgacagccgcccacaagggtgttccggtggcaggacttcccggcagttggagacctcagccgcggttggatgttgcccggccgctggagtcctccaggccggtgccgcagaacgcggttggggaggccgcaaggcctcagccgatcccgtccgtggcggatgccggcggcgggaatggccgcccagttccgccagcggatgtgggcggaccgcaacagcggcggcatctctcgatcctggatgcaattctaggcaactag

SEQ ID NO: 50271 - protein, 723 aa, Mesorhizobium sp. BNC1
MAKRDRGKRIEPSFGAPGGRRSGTLSVSQSDRILPPARRPSRKKGKKKAHRRSSRARRSGLGGFLRGFVYWSIVLALWGGIAAAGLIAYYGAQMPSLTTWVIPDRPPNVKIVAVDGTLIANRGMTGGEAIGLHEMSPFIPQAVIAIEDRRFYSHWGVDPMGMARAMVANLLEGELSQGGSTITQQLAKNLYLKPDRTLERKVQEMLLALWMEQKYTKNQILEMYLNRVYFGSGAYGVEAASQRYFNKSAHEITLSEAALLAGLLKAPSRLSPARDPQAAEERAQVVLSAMREEGMIGDSQLAAAMSAPANRAAAYWTGSEHYVADRIMEELPALVGTVERDVVVKTTIDLHLQKVAEKSIRRLIDEKGKQLQVSQGALVSIDGSGAVRAMVGGYDYAHSQFDRASEARRQPGSAFKPFVYMAALEQGRTPDSMRNDAPVRIGKWRPENYQGKYYGQVTLAEALARSLNSVAAQLAVEVGPEAVVEVAHRMGVESSLNANASIALGTSEVTPLELTAAYVPFANGGFKPEIHFIETITTASGKVLYQQKASHVPRVANAEIIGMMNYMMAGTIEYGSGRAAAFGWPAAGKTGTTQESRDAWFLGYTSNLITGVWFGNDNSRPTKATGSSLPAEAWREFMTAAHKGVPVAGLPGSWRPQPRLDVARPLESSRPVPQNAVGEAARPQPIPSVADAGGGNGRPVPPADVGGPQQRRHLSILDAILGN

SEQ ID NO: 50272 - DNA, 2064 bp, Burkholderia cepacia R18194
  CDS (1)..(2064)
atgtggcgcacgctcgcaggcgcgctgctcggcctgacggtcgcatgcgcgggtatcggcgcatggacgatccagcgcatctggacgcagttgccgtccgtcgagcacctcgccgtgtatcgtccggcgctgccgctgcggatcttctcgcgcgacggcgacctgctggccgaatacggcgtcgagcggcgcgagttcgtgccgctcgaacgcatcccgccgctgatgcggcaggcgctgctcgcggccgaggacgcgaagttctaccagcacggcgcagtcgacttcaacggccttgcgcgcgcgacgttcgcgaacgtcgtgacggggcagccggggcagggcggcagcacgatcacgatgcaggtcgcgcgcaacttctacctgacgcgcgacaaggtgctgagccgcaagcttgccgagatcctgatggcgaccaagctcgaacgcgaatacagcaaggacaagctgctcgagctgtacatgaacgagatctatctgggcgagcgcgcgtacggcttcgcggcggccgcgaacgtgtatttcggcaagccgctcgacgcgctgagcgcgggcgaagcggccgtgctcgcggggctgccgaaggcgccgtccgcgttcaacccggtcgtcaatccggcacgcgcgaccgcgcgacgcaactacgtgctcggccgcatgcatgcgctcggccagcttgacgacgcgacgtaccgcgcggccgtcgacgcgccgatcgcgctggcgaccacgccgccgcccgggatcatcgcggcgccgtacgttgccgagcgcgcacgccggatgatggtggagcgttttcacgacgacgcatacacgctgggtctcgatgtgacgacgacgatctcgatgcgcgaccaacgcgcggccgaatcgtcgcttgcacgcacgctgagccgtcagccgcgcgcgaagcgcgatgcgcgcaacgggcttgaaggcgcactgatatcgctcgacgcggcgaccggcgacatgctcgcgctcgtcggcggcgcggatttcaaccgcaacgtgttcgaccatgcgctgcaggcgtatcgccagccgggctcgagcttcaagccgttcgtctattcggcagcgctggagaagggctacttcccgggcgtgctcgtcgacgacacgcagcgcacgctcacgcatgaggaaaccggcgcgcggccgtggcgcccgcgcaatttcgccaacaactacgagggcttcatcccggtgcggcgcgggctcatgcgctcgaagaacctcgtcgcggtcagcctgatgcaggccaccgacgcgcgctacgtgcagcagcacgcggtgcacttcggtttcgatgcgcagcgcaatccggcgtcgctgccgctcgcgctcggcgcgggcgccgtgacgccgctcgaactggcgagcgcgtacagcgtgttcgcgaacggcggcacgcggatggagccgcgcctgatcctgtcggtgaagcagcgtcacggcggcgcgatatacgaagcgacggcgccggcaggcgagcgcgtcgtgtcggcgcgcaacgcgttcgtgatggacagcatgctgcgcgacgtcgtgaagtccggcaccgcgcgcggcgcgctcgcgctgcgccgcgacgacgcggccggcaagacgggcacgtcgaacgggtcgaaggacgtctggttcgccggctactcgtcgggcatcgtcgcggtcgcgtggctcggctacgacacgccgcgcccgatgggacgtgcgaccggcgcgtcgctggcgctgccggtctggctcgactacatgaagacggccgtcgacgggcgtacgccggtcgaggcgacgccgccgcaggacgtcgcactcgtcgacggcgacttcgtgtacgccgaatacacgcgcggcacgtgcacggccgacgtgccgtcgtacatccgcagccgcttcgcgtgcggcggggccgcggcggtttccggtgcgtcggacgcgccgggcaacaacggcaagcccgccgagccgatgcctggcgcggtcgatgcggccgagcgcgaacgcgtgctcgacctgttccggacggaagactga

SEQ ID NO: 50273 - protein, 687 aa, Burkholderia cepacia R18194
MWRTLAGALLGLTVACAGIGAWTIQRIWTQLPSVEHLAVYRPALPLRIFSRDGDLLAEYGVERREFVPLERIPPLMRQALLAAEDAKFYQHGAVDFNGLARATFANVVTGQPGQGGSTITMQVARNFYLTRDKVLSRKLAEILMATKLEREYSKDKLLELYMNEIYLGERAYGFAAAANVYFGKPLDALSAGEAAVLAGLPKAPSAFNPVVNPARATARRNYVLGRMHALGQLDDATYRAAVDAPIALATTPPPGIIAAPYVAERARRMMVERFHDDAYTLGLDVTTTISMRDQRAAESSLARTLSRQPRAKRDARNGLEGALISLDAATGDMLALVGGADFNRNVFDHALQAYRQPGSSFKPFVYSAALEKGYFPGVLVDDTQRTLTHEETGARPWRPRNFANNYEGFIPVRRGLMRSKNLVAVSLMQATDARYVQQHAVHFGFDAQRNPASLPLALGAGAVTPLELASAYSVFANGGTRMEPRLILSVKQRHGGAIYEATAPAGERVVSARNAFVMDSMLRDVVKSGTARGALALRRDDAAGKTGTSNGSKDVWFAGYSSGIVAVAWLGYDTPRPMGRATGASLALPVWLDYMKTAVDGRTPVEATPPQDVALVDGDFVYAEYTRGTCTADVPSYIRSRFACGGAAAVSGASDAPGNNGKPAEPMPGAVDAAERERVLDLFRTED

SEQ ID NO: 50274 - DNA, 2388 bp, Burkholderia cepacia R1808
  CDS (1)..(2388)
atgcaatccacgtcccctacgtccccgcctcccgcgcccgagccgaagaagcgcccctggtggctgaaggccctgatcgggctcgccgcgatgtgcgtggccatcgtcgtggccggcggcctcgtgctcggctatgcgctcgtcgtcgcatggccgaacatgccgtcgctcgacgcgctgaccgactaccgcccaaaggtgccgctgcgcatctacacgtccgatcacgtgctgatcggcgaattcggcgaggaacggcgcgacatcgtccatttcaaggacgtgccggattcgctgaagaaggcgatcctcgcgatcgaggacgcacggttctacgatcatggcggcgtcgacctcaccggcatcgcccgcgcgggcttcgtcgcgttgacgaacggccatgcgtcgcagggcgcgagcacgatcacgatgcaggtcgcgcgcaacttcttcctgtcgagcgaaaagacctacacccgcaagatctacgagatgctgctcgcgtaccggatcgagcgcgcgctgacgaaagatcagattctcgaggtctatatgaatcagatctacctcggccagcgcgcatacggcttcgcgagcgcggcgcgggtctacttcggcaaggacctgaaggacatcacgctcgccgaggcggcgatgctcgcggggctgccgaaggcgccgtccgcgtataacccggtcgtcaatccgaagcgcgcgaaggtgcgtcaggagtacatcctgcagcggatgctcgagctgaacttcattacgcgcgagcagtacgacgaagccgtcgcgcagccgctcgtcgtcaagggcgcggggcgcgagttcagcgtgcacgccgagtacgtcgcggagatggtccggcagatgatgtacgcgcagtaccgggaagaaacctacacgcgcggcttcaacgtggtcacgacgatcgactccgccgatcagcaggtcgcgtacaccgcactgcgcaagggcatcatggattacgagcgccgtcacggctatcgtgggccggagggcttcatcgagctgccgtccggcgcggacgatcgcgagcaggcgatcgacgacgcgctgctcgagcatcccgacaacggcgagctgatcgcggcagtcgtcacggcgacgagcccgcgccagatcaccgtggcgttcatcgacggcagcagcgcgacgatcgacggcgacaatctgcgcttcgcgtcgagcgcgctgtcggccaacgcgcagccgaaccgccgcatccggccgggcgcgatcgtgcgcgtcgtgaagaacgacaccggcaaatggtcgatcacgcagttgccgcaggtcgaaggcgcgttcatctcgatcgtcccgcaggatggcgcgatccgctcgctcgtcggcggcttcgattacaacaagaacaagttcaatcacgtcacgcaggcgtggcggcagcccggctcgtcgttcaagccgttcatctattcggcgtcgctcgacaaggggctcgggccggccaccgtgatcaacgacggcccgctgtatttcagcgcggccgaaaccggcggccagccgtgggaaccgaagaactacggcggcggcttcgaaggcccgatgtcgatgcgcaccgcgctgcagcgctcgcgcaacctcgtctcgatccggatcctgaaccacatcggcacgaagtacgcgcagcaatacatcacgcgcttcggcttcgacgccgagcgccatccggcctacctgccgatggcgctgggcgcgggccaggtcacgccgctgcagatggccggcgcgtactcggtgttcgcgaacggcggcttccgcgtgaatccgtatctgatcgccgaagtgaccgatccgagcggcgcgatcgtcgcgcgcgcgcagccgctcatcgccgagcagaacgcgccgcgcgcgatcgacgcgcgcaacgcatacgtgatgaacagcctgctgcagagcgtcgcgcagcgcggcaccggcgcgcgcaccaacgtgctcaagcgcaccgacctcgccggcaagacgggcacgacgaacgattcgcacgacgcgtggttcgccggctatcagcacacgctcgcggcgatcgcgtggatcggctacgacaacccgcgcagcctcggcgatcgcgaaacgggcggcgggctgtcgctgccggtctggatcgactacatgggcgcggcgctgaaggacgtgcccgagttcaagccgaccatgcccgacgacgtccagtcgctcggcggcgagctgtacttcaccgagttcacgccggggcacggcttcgtgtcgacggtcggcgtaccgcaggcggcgactccgcagaacgtcgacgaagaagcgccgcatgtcgacgagcaggaaaagcaggacatcatgaacctgttccgcggccactga

SEQ ID NO: 50275 - protein, 795 aa, Burkholderia cepacia R1808
MQSTSPTSPPPAPEPKKRPWWLKALIGLAAMCVAIVVAGGLVLGYALVVAWPNMPSLDALTDYRPKVPLRIYTSDHVLIGEFGEERRDIVHFKDVPDSLKKAILAIEDARFYDHGGVDLTGIARAGFVALTNGHASQGASTITMQVARNFFLSSEKTYTRKIYEMLLAYRIERALTKDQILEVYMNQIYLGQRAYGFASAARVYFGKDLKDITLAEAAMLAGLPKAPSAYNPVVNPKRAKVRQEYILQRMLELNFITREQYDEAVAQPLVVKGAGREFSVHAEYVAEMVRQMMYAQYREETYTRGFNVVTTIDSADQQVAYTALRKGIMDYERRHGYRGPEGFIELPSGADDREQAIDDALLEHPDNGELIAAVVTATSPRQITVAFIDGSSATIDGDNLRFASSALSANAQPNRRIRPGAIVRVVKNDTGKWSITQLPQVEGAFISIVPQDGAIRSLVGGFDYNKNKFNHVTQAWRQPGSSFKPFIYSASLDKGLGPATVINDGPLYFSAAETGGQPWEPKNYGGGFEGPMSMRTALQRSRNLVSIRILNHIGTKYAQQYITRFGFDAERHPAYLPMALGAGQVTPLQMAGAYSVFANGGFRVNPYLIAEVTDPSGAIVARAQPLIAEQNAPRAIDARNAYVMNSLLQSVAQRGTGARTNVLKRTDLAGKTGTTNDSHDAWFAGYQHTLAAIAWIGYDNPRSLGDRETGGGLSLPVWIDYMGAALKDVPEFKPTMPDDVQSLGGELYFTEFTPGHGFVSTVGVPQAATPQNVDEEAPHVDEQEKQDIMNLFRGH

SEQ ID NO: 50276 - DNA, 2145 bp, Listeria monocytogenes str. 4b H7858
  CDS (1)..(2145)
atggacaaattcaaacagcaactaattaaatacttaaaattattctttggttttataggaaaatggcttagcaaaggatggcagaaatttagacgtttctggaaaaacaaacatatcggaaagatttttttactagctggacttgtatttttattaagttttatcatttatcttgtaatagtagcaaaatctgccgacatagatgcactaaaaaaaggcttagagtcagccacgattatttatgacaaagatggcgacaaggcaggggagctttcttccactgatgcaacatttgtatccatcgataaaatatctaaaaacttacaaaatgcagtagtttccattgaagatagaaaattttatgaacataaaggttttgacttgaaagggatagctcgggcgggtgttaatttagtcactagcggaggcatttctggtggcggtagtacgattacacagcaactcgccaaaaatgctctactgacacaagaacaaaccttcacacgaaaagccaaagaaatatttatggctcgtgaaatcgaaaaaacctactcaaaagacgaaattatggaaatgtacttaaaccgttcttactttggtaatggggaatggggagtagaaaatgcttccttaaaatattttggtaaatcagcggcagacttaaacataccagaagctgcgacaattgctggattgcttcaagctccaagtgcgtatgatccataccaacatatcgacaaagcgactaatcgccgcaacatggtattaaatgcaatggtcgaaacaggcacaatttcaaaagcagaaggcgataaatacaaagctacaaaaatagttttaaatgatcaatcaaaagatccacttgcgaataaatatccatggtacgtcgatgcagttattaatgaggctgtaaatgaagcagatataacgcaagatgaaatcatgcaaaaaggatataaaatctatacggaattagatcaaaattatcaaacttccttagaaaatgtttacaacaatgatgggttattcccttctaatgcaaatgatggcacactagttcaatcaggagctgttttaatggatccagctactggaggcattagagcgcttgttggtggacgcggagaacatgtcttccgtggtttcaaccgggcgacacagatgaaagcacaaccaggttccacaatgaagccacttgcggtatacacaccggcgcttcaatctggttatgacgtggattcaatgctaaaagatgaaaaaataacctacaaaggtaactacacaccaaccaatgttggcggcgtttatagtggagaagttccaatgtataaagctgtagccaactcgattaatgcccctgccgtttggttacttgatcaaattggtattgataaaggtgtaaaatctgtcgaaaaatttggtattacagttccagaaaaagatagaacgcttggacttgcactcggtggtatgagtaaaggtgcttcgccagtagaaatggcaacagcgtatgcaacctttgctaacaatggtgccaaaccggaatctcatattattactaaaattgtcgatccatcaggcaatacagtttacgaaaatgttcctaaaactaaacaaatcatttcagaaacagtatctaatgaaatgacttccatgcttttagatgttatcaatacaggaactggtcaaagtgcagctgtttccggtcacgaaatggctgggaaaacaggttccacgcaagttccatttgatgatacaagcggtactaaagatcaatggtttgttggctacacgccaaacctagtcggagccgtttggatgggatatgataaaactgacaaagagcattacctaactacaaccagttctgctggtgtttctagtttggctcactacgtaatgaatagtggtttgcagtatcagaaatccgcagactttagtacgaagagtgctgcacaagaaactgcagcgaaaaaagaagaagaagaaaaagagaagaacagtggtagcgacttttggagtggcgtgaaagaaaaagccgatgaagctggagaaacaatcaaaaaaggcgcagataaagtaaaagaattcggtggaaaagtttctgatggcattggaaacttaatcgactcgataggtaattaa

SEQ ID NO: 50277 - protein, 714 aa, Listeria monocytogenes str. 4b H7858
MDKFKQQLIKYLKLFFGFIGKWLSKGWQKFRRFWKNKHIGKIFLLAGLVFLLSFIIYLVIVAKSADIDALKKGLESATIIYDKDGDKAGELSSTDATFVSIDKISKNLQNAVVSIEDRKFYEHKGFDLKGIARAGVNLVTSGGISGGGSTITQQLAKNALLTQEQTFTRKAKEIFMAREIEKTYSKDEIMEMYLNRSYFGNGEWGVENASLKYFGKSAADLNIPEAATIAGLLQAPSAYDPYQHIDKATNRRNMVLNAMVETGTISKAEGDKYKATKIVLNDQSKDPLANKYPWYVDAVINEAVNEADITQDEIMQKGYKIYTELDQNYQTSLENVYNNDGLFPSNANDGTLVQSGAVLMDPATGGIRALVGGRGEHVFRGFNRATQMKAQPGSTMKPLAVYTPALQSGYDVDSMLKDEKITYKGNYTPTNVGGVYSGEVPMYKAVANSINAPAVWLLDQIGIDKGVKSVEKFGITVPEKDRTLGLALGGMSKGASPVEMATAYATFANNGAKPESHIITKIVDPSGNTVYENVPKTKQIISETVSNEMTSMLLDVINTGTGQSAAVSGHEMAGKTGSTQVPFDDTSGTKDQWFVGYTPNLVGAVWMGYDKTDKEHYLTTTSSAGVSSLAHYVMNSGLQYQKSADFSTKSAAQETAAKKEEEEKEKNSGSDFWSGVKEKADEAGETIKKGADKVKEFGGKVSDGIGNLIDSIGN

SEQ ID NO: 50278 - DNA, 2511 bp, Bacillus cereus G9241
  CDS (1)..(2511)
atgtcagaaaattatcgttctcgagaggagcgacgacaagttaaaaagaaaaaacaaccagcttctaaaacacaaaaaccaaaaggtaaaacatcattttttcgcaagtttttaattacttgtttattacttggtattgttggtttagtggcgggggttaccaccttttttgtaatgattaaggatgcaccaaaacttgagaaagcaaaacttgttaatccgttatcctcaaaaatttatgataaaaatggcgatttggtatatgaatacgggaaagaaaaacggacgaatgttacgtatgatcaaattcctaaattagtagaaaatgcatttttagcaacagaagatgcacgtttttacgagcatagcggagtagactttaaaggtactgcccgtgctgttttggtgagtcttaaaggagattacggttcacaaggtggaagtacgataacacagcaagttattaaaaactacttcttatcgatggaaaaaacatcaaaacgtaaagttcaggaaatatatttagcgtataagctagaacaacaatattcaaaacatgaaattttagaaatgtatttaaataaaattaacttaggaaaccgttcatatggaatcgcaacagcagcacaaaactactatggtaaagaattgaaagatttaacattaccagaagttgcgatgcttgcagggttaccgaaagcaccaaataactatgatccaacgaaaaaggaaaatgttcaaagggcaacagaaagaagaaatgttgttctaaacttaatgaatcgacatggatatataacaaaacaggaaatggaagaagcatcaaaagttgacgtagaaaagggactcaagcctgcaactcaacttcaagcaatgccataccctgcatttatggatgcagttgtgaaagaagtagaaaaagaattgcccgatgctaatattggctctgatggtttagaaattcatacaactttggatccaaaagcacaggaattagctgacaatattttaaatacaaatattattaattatccaaatgataaattccaaggtgctttcacatttatggatacgaaaacaggtgaggttcgtgctataggtagtggtcgcggtgaaaataaagcagtatttaaagggcataatatggcaattgaattagatcgtgcagctggttcaactatgaagccaatctttgattacggccctgcaattgaatacttaaaatgggctacgtatcatcaaattgatgattctccatttaaatattcaactggacaagaacttcgaaatgcggacagaactcatttaggcccaattacgatgcgcgaagcgttaaaaatgtcacgtaacgttccagcagttaaaactgcaaaagaagtaggacttaataaatcaaaagaattctctgagaaattaggtattacatttgattcaacaccgaaagaatctacagcgattggtacaaacgaagtatcaccaactgaaatggcgggtgcttatgcgacatttggtaatggtggaaagtatgcaaaaccacattttgttaagaaaatagtttatccagacggcaaatcacaaagctttgagcaaaaaccaaaacaagttatagctgattctacagcatatatgattactgatatgcttcgctcagtagtaacatcaggtactggtacagcagcaaatattagttctttagacgtagctggtaagacgggtacaacaaactatgattcaaaacaattagcgaaatttaacattccagaaagtgcaactcgtgatagttggtttgcaggttatacaccgcagtatacgatggcagtatggactgggtatatgaaagatggtaaagacgagtatattagtagtaaaaatacaaaaattgcacagttgatctttaaagaaatgatgagtgaaatggctactgataaatcacgctttaaaatgccaagtactgttattcaagaaggtagtgagctacgtataaaaggtgaaaaacgtgattcttctccaaatacgagcgtaccggacacgacagaaaaaccaaaacaagaccagcaacaaaaaactgaagacgagaaaaagcaagaagaagaaaagaaacaagaagaactgaaaaaacaagaagaacaaaagcaacaagaggaacttaagaagcaagaagaacaaaagaaactagaagagcaaaagaaacaagaagaagaaaagaaacaaaatgaacaaaataatggtaatggtcaaggaacgacacctccagcaaataatggaggaggtcaaggaaatacgacacctccagcaaataacggaggaggccaaggaaatacaacacctccagcaaataacggaggaggccaaggaaatacaacacctccagcaaataacggaggagaccaaggaaatacaacacctccagcaaataacggaggaggccaaggaaatacaactccaccagcgactacacaaccagagactggcggtaatgcaggagaggcccctgctaataatggacaataa

SEQ ID NO: 50279 - protein, 836 aa, Bacillus cereus G9241
MSENYRSREERRQVKKKKQPASKTQKPKGKTSFFRKFLITCLLLGIVGLVAGVTTFFVMIKDAPKLEKAKLVNPLSSKIYDKNGDLVYEYGKEKRTNVTYDQIPKLVENAFLATEDARFYEHSGVDFKGTARAVLVSLKGDYGSQGGSTITQQVIKNYFLSMEKTSKRKVQEIYLAYKLEQQYSKHEILEMYLNKINLGNRSYGIATAAQNYYGKELKDLTLPEVAMLAGLPKAPNNYDPTKKENVQRATERRNVVLNLMNRHGYITKQEMEEASKVDVEKGLKPATQLQAMPYPAFMDAVVKEVEKELPDANIGSDGLEIHTTLDPKAQELADNILNTNIINYPNDKFQGAFTFMDTKTGEVRAIGSGRGENKAVFKGHNMAIELDRAAGSTMKPIFDYGPAIEYLKWATYHQIDDSPFKYSTGQELRNADRTHLGPITMREALKMSRNVPAVKTAKEVGLNKSKEFSEKLGITFDSTPKESTAIGTNEVSPTEMAGAYATFGNGGKYAKPHFVKKIVYPDGKSQSFEQKPKQVIADSTAYMITDMLRSVVTSGTGTAANISSLDVAGKTGTTNYDSKQLAKFNIPESATRDSWFAGYTPQYTMAVWTGYMKDGKDEYISSKNTKIAQLIFKEMMSEMATDKSRFKMPSTVIQEGSELRIKGEKRDSSPNTSVPDTTEKPKQDQQQKTEDEKKQEEEKKQEELKKQEEQKQQEELKKQEEQKKLEEQKKQEEEKKQNEQNNGNGQGTTPPANNGGGQGNTTPPANNGGGQGNTTPPANNGGGQGNTTPPANNGGDQGNTTPPANNGGGQGNTTPPATTQPETGGNAGEAPANNGQ

SEQ ID NO: 50280 - DNA, 2706 bp, Bacillus cereus G9241
  CDS (1)..(2706)
atgtcagataattatcgttctcgtacagaacgaaatcatgtaaaaaatcaaaaggaagaaacaaatacagagaaaaaaccaaagaaaaaaggctccttttttaaaaaattccttataggttgtctacttcttggtatcgttggtcttgtagctggcgtttccgctttctttgttatggtgaaggacgctccaaaattagacaaatcaaaacttgtcaatcctttatcaacaaagtttcttgataaggatgggaactttttctatgaatacggtgctgaaaaacgaacccacgttacgtatgatcaaattccaaaagtagttgaaaatgcattccttgcaactgaggactcgcgtttctatgatcataatggaattgattttaaacgaactacaaaagcagttatggaaaatgtcactggaggtttcggatctcaaggtggtagtacgattacacaacaagtagtcaaaaactattttctaacgatggacaaaactgcaaagagaaaagtacaagaatggtacctatcttacaaattagagcaacaatactctaaacatgagattttagaaatgtacttaaataagattaacttaggtaaccgttcgtatggtattgcaacagcagcaaaaaaatattatgacaaagatttaaaagacttacagttacatgaagctgcaatgcttgcaggtttgccccaaggtcctaatatttatgatccaacaaaaccagataacgttgaacgagctacacaacgtcgtaacgtcgtattatcattaatgaatcgacatggttatataacaaaagatgaaatgaataacgcaatgaaaatccctgtaactgagggccttcaaccgtcttcagaagtaacagagatgaaatatcaagcatttttagatgctgttgtaaaagaagttgaaaaagaatatcccgatgtaaatatcggttcagatggtttaacgattcatacaacacttgatcaagatgctcaagattatgctgaaaaaattatggatggcaatcttattaattatccgaacgatcaattccaaggatcattcgtatttatggatacacaatctggagaagttcgagcaattggagctgggcgtaaaggaagtaagtctactttcaaaggtcataatatggccactgatttaaaacgccaagtcggttcaacaatgaaaccaatttttgactacggccccgcaattgagaatttacaatggtctacataccatcaattaaatgactcagagtatacgtattccgatggtaaaaaaatacgaaatgcaacaaatagttacaaaggtgacgtttcactacgtgaagctttgaaaaagtcattaaacatcccagctttaaaaacagcccaagcggttggtattcctaagtctcaagcgtttgctgaaggattaggtatgacctttaaagacggcaaagcatatgaatcaacggcaattggtagtaacgatagttctccattacaattagcgggtgcatacgcagcctttggtaatggtgggaactacaataaaccgcacttcgtaaaagaagttatcttcccagatgggaaaaagaaaagttttaaaccgaaagaacaacgtgcgatgcaagactacacagcttacatggtgactgacgttcttcgtgacgtagtaaaacccggttctggtggtacaggtgcaacggcatacgttccaggtgttgatgtagccggtaaaacaggaacacaaaactttgatgaagacgttattaaaaaatatggtattccagctgatgcaaacagagatagctggttcgctggatatacaccgcaatatactatgactgtttggactggttacgaaaaagacggtccagaaaattacattggcgatcgctctactagaattgcacaacaaatgttccaagtaatgatgagcaaattcgctacagataaaactcgtttcgaacgcccttcttctgtacaagaattaaatggtgaattgtacgtaaaaggcgctaagaaagatgcagtgaaacaaattaaagtcgatgcacctagtggtcttaatgtcactttcgatggtgctagcacagttacactaaactggtctggaccagcagaagttgatgcttatgcagcaagctataaggcgactgacggttcaagcggtagtttatcaataaaaggtacgacagctactcttggtggtattaaaccaggtgttacttatagcttctctgtagtagcgaaaaaaggtactggaacaagcccggccgttggtgcatccttcactgcgcctggaggaactccagacgcgaagaaagctgaagatgaagctgctaagaagaaggctgaagaagaagctaagaaaaaagccgatgaggaagctaagaaaaaggctaatgaagataaactaaaacaagaagaagctaagaaaaaagctgaagaagaaactaagaaacaacaagaacaacagcgtaaacagcaagaagaagctcaaaagaaagctgaagaggaagctagaaaaaaagctgaagaagaagctaagaaacaacaagaacaacaacgtaaacagcaagaagaggctcaaaagaaagctgaagaggaagctagaaaaaaagctgaagaagaagctaagaaacaacaagaacaacaacaacaaaataccggcgaagatacaccacatgcagacggaaatgttgttacaacagagtcttaa

SEQ ID NO: 50281 - protein, 901 aa, Bacillus cereus G9241
MSDNYRSRTERNHVKNQKEETNTEKKPKKKGSFFKKFLIGCLLLGIVGLVAGVSAFFVMVKDAPKLDKSKLVNPLSTKFLDKDGNFFYEYGAEKRTHVTYDQIPKVVENAFLATEDSRFYDHNGIDFKRTTKAVMENVTGGFGSQGGSTITQQVVKNYFLTMDKTAKRKVQEWYLSYKLEQQYSKHEILEMYLNKINLGNRSYGIATAAKKYYDKDLKDLQLHEAAMLAGLPQGPNIYDPTKPDNVERATQRRNVVLSLMNRHGYITKDEMNNAMKIPVTEGLQPSSEVTEMKYQAFLDAVVKEVEKEYPDVNIGSDGLTIHTTLDQDAQDYAEKIMDGNLINYPNDQFQGSFVFMDTQSGEVRAIGAGRKGSKSTFKGHNMATDLKRQVGSTMKPIFDYGPAIENLQWSTYHQLNDSEYTYSDGKKIRNATNSYKGDVSLREALKKSLNIPALKTAQAVGIPKSQAFAEGLGMTFKDGKAYESTAIGSNDSSPLQLAGAYAAFGNGGNYNKPHFVKEVIFPDGKKKSFKPKEQRAMQDYTAYMVTDVLRDVVKPGSGGTGATAYVPGVDVAGKTGTQNFDEDVIKKYGIPADANRDSWFAGYTPQYTMTVWTGYEKDGPENYIGDRSTRIAQQMFQVMMSKFATDKTRFERPSSVQELNGELYVKGAKKDAVKQIKVDAPSGLNVTFDGASTVTLNWSGPAEVDAYAASYKATDGSSGSLSIKGTTATLGGIKPGVTYSFSVVAKKGTGTSPAVGASFTAPGGTPDAKKAEDEAAKKKAEEEAKKKADEEAKKKANEDKLKQEEAKKKAEEETKKQQEQQRKQQEEAQKKAEEEARKKAEEEAKKQQEQQRKQQEEAQKKAEEEARKKAEEEAKKQQEQQQQNTGEDTPHADGNVVTTES

SEQ ID NO: 50282 - DNA, 2496 bp, Rhodospirillum rubrum
  CDS (1)..(2496)
atgattcggattctgctgaccctggtcatgatcggcatggtcggcggcgccggcggcacggcctatctgctcaattcctatgggagcgacctgcccgattacggcgccctggccaattacgagccgccgatcaccactcgggttctggccagcgatggccgtttgatggcggaatacgccatcgaaaagcgggtctatgtgccgatcaacgccattccccagaaggtcaaggacgcctttttgtcggccgaggacaagaacttctacacccactcgggcgtggatttcgtcgggctgttccgcgccgtgctgaccaatctgcagaactatggctcgggccggcggccggtcggcgcctcgaccatcacccagcaggtggccaagaactttctgctgaccaacgaggtgtcctttgatcgcaaggtcaaggaagccatcttggccttccgcatcgaggaggccttttccaaggatcacattctggaactgtatctgaacgagatctatctcggcttcagttcctatggggtggccgcggcggcggtgaactacttcaacaaaagccttgatgagctgaccatcggcgaggtcgccttcctcgccgccttgcccaaggcccccaacaactacaatccggtgcgcaagaacgacgcggccaaggcccgtcgcgactgggtggtcgaccgcatggtcgaggatgatcacatcacccaggccgagggcgaagcggccaaggccgagcccctggaggtgcgcagccgtgacgagacccagcttgtgcgccatgccgacttcttctcggaagaggtccgccgacagctgcaaagccgctatggcgaagaggcgctttacaagggcgggctttacgtgcgcaccacccttgatccccgccttcaggagatcggggcgcgggccctgcgcaaggggctgatcgattacgatcgccgccatggctggcgcggcccggtgacccgcctggaaaacgttcaggaatggaaggcgcgtctggccgaattgcccgttccccccggcgcctcgaccaactggcggttggccgccgtgctgcggcttgatgccggcgaggtcaagcttggcctgcccgacggcttcggcggcgccatcccgatgaaggaaatggcctgggcccggccgacgctcgacggtcagcgggtgggcaacgcccccaagaagcccgccgatgtcttgaaggttggcgatgtcgtgctggtcgagcctttggagaaggacgacaagggcaaggcctatgcgcccggaacctatggcttgcgccagatgcccaatgtcgaaggcgccctggtcgccatggatccccataccggccgggtgatggcgatggtcggcggcttcgcgcccgagcgcagcgagttcaaccgggcgatccaggccaagcgccagcccggctcgtcgttcaagcccttcgtctatctggccgccctcgatcacggctatacgccggcgaccatcatccttgacgcgccgttcgtctatgatccgggccccggccaacccttgtggaagcctaagaactacagcggccagttctacggcccctcgaccctgcgtcggggtgtcgagatgtcgcgtaacctgatgacggtgcgtctggccaatgcggtgggcatggatgtggtcgccgaatatgccgagcgcttcggcgtcgtccacaccatgccgcgcgtcctcgccgcctcgctcggcgccgtcgagaccacggtgatggacatgacgacggcctatgcgatgctggtcaatggcgggcggcggatcgccccgacgctgatcgaccgcatccaggaccgcaccggcaccaccgtctatcgccatgacgagcggccctgcgatgcctgcaaggcgtcgcaatgggcgggtcaggccgtgccggcggtcgttgacaatcgcgagatcatgaccgatccgctgtcggcctatcagatcgtgtcgatccttcagggcgtcgtccagcgcggcaccggcggcaaagtccaggcggtgggcaaatcggtcgccggcaagaccggcacctcgaacgacagcctcgatacttggttcgtcggcttttcgcccgatctggtctgcggggtcttcgtcggcttcgacgagcccaagtccctggggtcccatgaggccgggtcgacgacggcggcgccgatcttcacgaccttcatgaaggaagccctggccgacaagcccgatattcccttccgcgtgcccgagggtatcaaattcgtccgcatcgatccccagaccggccagcgcgccggcccgggaacctccaacgccatccttgaggccttcaagccgggatccgagccctcgctggcctcgagttatgtgatcgacggatcggcgccggtgggcgattacggcgcctattacggcggcgtcggcggcgagggcgccaccggcgttcccggtcaggcggccccgggcttcggcgccggtggcgccccgccccaggcgggcggcctttattag

SEQ ID NO: 50283 - protein, 831 aa, Rhodospirillum rubrum
MIRILLTLVMIGMVGGAGGTAYLLNSYGSDLPDYGALANYEPPITTRVLASDGRLMAEYAIEKRVYVPINAIPQKVKDAFLSAEDKNFYTHSGVDFVGLFRAVLTNLQNYGSGRRPVGASTITQQVAKNFLLTNEVSFDRKVKEAILAFRIEEAFSKDHILELYLNEIYLGFSSYGVAAAAVNYFNKSLDELTIGEVAFLAALPKAPNNYNPVRKNDAAKARRDWVVDRMVEDDHITQAEGEAAKAEPLEVRSRDETQLVRHADFFSEEVRRQLQSRYGEEALYKGGLYVRTTLDPRLQEIGARALRKGLIDYDRRHGWRGPVTRLENVQEWKARLAELPVPPGASTNWRLAAVLRLDAGEVKLGLPDGFGGAIPMKEMAWARPTLDGQRVGNAPKKPADVLKVGDVVLVEPLEKDDKGKAYAPGTYGLRQMPNVEGALVAMDPHTGRVMAMVGGFAPERSEFNRAIQAKRQPGSSFKPFVYLAALDHGYTPATIILDAPFVYDPGPGQPLWKPKNYSGQFYGPSTLRRGVEMSRNLMTVRLANAVGMDVVAEYAERFGVVHTMPRVLAASLGAVETTVMDMTTAYAMLVNGGRRIAPTLIDRIQDRTGTTVYRHDERPCDACKASQWAGQAVPAVVDNREIMTDPLSAYQIVSILQGVVQRGTGGKVQAVGKSVAGKTGTSNDSLDTWFVGFSPDLVCGVFVGFDEPKSLGSHEAGSTTAAPIFTTFMKEALADKPDIPFRVPEGIKFVRIDPQTGQRAGPGTSNAILEAFKPGSEPSLASSYVIDGSAPVGDYGAYYGGVGGEGATGVPGQAAPGFGAGGAPPQAGGLY

SEQ ID NO: 50284 - DNA, 1929 bp, Rhodospirillum rubrum
  CDS (1)..(1929)
atggcgcccgttttcgaggcctccgccccctcccgcccgccgctgatcgccgagcgggtggtgccggagctaagcgacgacgcgccccgacgcgccgccccctcgccgcgcccgccgccccgtcgccgcaagcccggtcgctcaccggcgcgcaaggcgccgcgccggccgcggcggcggtgggtttggccgctgatccgcctgatgctggtcggggtgatctggatggtgatcggtctggccggggtggtcgtatggttcggccatgacctgcccgacccggtgacgtcggccaatgtgacgcggcggccctcggtgacgctgcttgccgccgatggcagccaattggcctcctttggcgatatccagggcgataccgtgcgcacgagcgacgtgccccgcgccctggttctggcgattctcgccaccgaggaccggcggttcttcaagcatttcggcctggatctggtgggtatcgcccgcgccagcgtggtcaacctgcgggcggggcgggtggtccagggcggatcgacgctcacccagcaggtcgccaagaacctgttcctgacccacgaccgcaccttcaaacgcaagatccaggaggtcttgctggcgctgtggctggaacaaaccttcaccaaggaccagattctcagcctttatctcaaccgcgtttatctgggcgcgggcacccacggcgtcgatgcggcggcgcggcgctacttcgaccagccggtggggcagatcaatctttaccaagcggcgttgctggccgggctgcccaaggcgccctcgcgcctgaacccggtgaccaatcccgacggatcgcgggttcgcacccttcaggtgctgcaaaacatggtcgaggccaagatgatcaccccggccctggccaaacaggccgcggccttggccgacggggcgattcccggcgcccggcgcggcggcatgggcagttatttcgccgattggatccttgagcgcgtcgatgatttcgccggcccccgcgaccgcgatctgatcgtgcgaaccacccttgatccggtgcagcagcgctcggccgaggcggcggtggccgggctgctcgccgaaaaaggcgcggcgatgaaggccagtcaggccgccctggtcgccctcgcccccgatggcgcggtgacggcgatggtgggggggcgcgatcacgcgaccagcccgttcaaccgggcggcccaggcccgccgccagccgggcagcgccttcaagcccttcgtctttctggcggggctggaagctgggctgacgccctcgacgatgatggacgacgcgccgatcacggtgaacggctggtcgccgggcaattacaaggacaaatacaaggggcgggtcagcctgacccaggccttcgcccagtcgctcaatacggtggcggtgcgggtgagcgaaaccgccgggcgcggcgccgtggtcaaggtcgcccatcgcctgggggttatcggatcgctctcgcccctgccctcgatcgcgctcggcgtcttcgaggtctcgccgctggatctgacggcggcctatgcccccttcgccaacggcggttatgcggtggtgccccacggcattctgagcatcgccgatcgcgatggcggcctgctctatgaacgccaggacagcgggccgcgccgggttgtggcgcccgaactcgcccggtcgatggatacgatgctaggcgccgtggtgtcctggggaaccggacgggcggcggggctgcccgatcgcacggcgcgcggcaagaccggaaccagccagggataccgcgacgcttggttcgtcggctatgccggcaaaaccctggccggagtctgggtcggcaatgacgatggcacgccgatgcgcgatgtcaccggcggtattctgcccacgcagatctggcatgccttcatgctgaacgccccgtaa

SEQ ID NO: 50285 - protein, 642 aa, Rhodospirillum rubrum
MAPVFEASAPSRPPLIAERVVPELSDDAPRRAAPSPRPPPRRRKPGRSPARKAPRRPRRRWVWPLIRLMLVGVIWMVIGLAGVVVWFGHDLPDPVTSANVTRRPSVTLLAADGSQLASFGDIQGDTVRTSDVPRALVLAILATEDRRFFKHFGLDLVGIARASVVNLRAGRVVQGGSTLTQQVAKNLFLTHDRTFKRKIQEVLLALWLEQTFTKDQILSLYLNRVYLGAGTHGVDAAARRYFDQPVGQINLYQAALLAGLPKAPSRLNPVTNPDGSRVRTLQVLQNMVEAKMITPALAKQAAALADGAIPGARRGGMGSYFADWILERVDDFAGPRDRDLIVRTTLDPVQQRSAEAAVAGLLAEKGAAMKASQAALVALAPDGAVTAMVGGRDHATSPFNRAAQARRQPGSAFKPFVFLAGLEAGLTPSTMMDDAPITVNGWSPGNYKDKYKGRVSLTQAFAQSLNTVAVRVSETAGRGAVVKVAHRLGVIGSLSPLPSIALGVFEVSPLDLTAAYAPFANGGYAVVPHGILSIADRDGGLLYERQDSGPRRVVAPELARSMDTMLGAVVSWGTGRAAGLPDRTARGKTGTSQGYRDAWFVGYAGKTLAGVWVGNDDGTPMRDVTGGILPTQIWHAFMLNAP

SEQ ID NO: 50286 - DNA, 2160 bp, Rhodospirillum rubrum
  CDS (1)..(2160)
ttgcggcacccgggacggatcgccctggcgatcgccggcgtggttctggcgcttggcgtccttgtgctggcgatcaacctctacaccatgccgctgtcgcccagcttccaggagcccgagcgttcggggtttctgatcgccgacgcggaaggcacggtggtggcgacgcggggggtcaccgccggccggccagtcgccctggccgagatgcccgcttcgctggtcaacgcggtgatcgccttcgaagaccgccgcttccgcgaccattggggcgtcgatccgaggggcatcgcgcgggcgatctgggtcaatctgcgctcgggcggacggacgcaaggggccagcaccctgacccagcaactggtcaagaacaccctgctcaccccggaaaagaccttcacccgcaagatccaggaggccatgctcgccctgtggatcgagcgcaagctgaccaaggacgagattctagaacgctacctcaattcgctgtatctcggcgccggctcctatggcgtcgatgccgccgcccggcgttatttcaacaagccggtgaccgatctgtcgctggcggaatcggcgatgatcgccggattgatccaggccccggcccgcaccggcccgaccacggcccttgatgtcgcccgccagcgcgccgaactggttctggacgtgatgcgcgaccagggactgatcggcgccgacgaggcgacctgggccaaggcccatcccgcctcgctcgccgttccgccggtcgaactgccggcctatggcgcggtgtcggactggatcgccgatgaggcgcgcaaggccctggggccgctgtcgggcgacttcctggtggtcagcacccttgatcgccggctgcaggtgctggcccagcagacgatccaggagggaatggccgccgagggcgcaggcctgcgcgccacccaggccgccctggtggcgatggcccccgatggccgggtcctggccatggtcggcggtcgcgactatcaggaaagccagttcaatcgcgccgtccaggcccgccgccagcccggttcgatcttcaagctgtttgtctatcttacggcgctgtcgaacaactggcgccccgatgacccgatcgacgacacgccgctgacgatcgacggctggagccccgagaattatggcggcggtgccggccatggcagcgtgccgctgcgcgtcgccttcgcccattcctacaatctggccgccgtccgcctgcaagaggcggtgggccgcgaggcggtgatcgccacggcgcgatcgatgggattgaaggacgatctccaacctttgcccagtctggcccttggcaccttccccgccaccttgcttgatctgaccagcgccttcgccgccgtcgccgccgaccgtgccaccgtccagccccgggtgatcgaggttctgcgcaccccgggcagtggcgagatccgcccgccggtgcgccagtcgggccgggcgccctggccgcgcgccagcgcccttgatctgctcaacgccgttgtcacccaagggaccggacgggccgccgccctgggggtgccgacctacggcaagaccggcaccacccaggacaaccgcgacgcctggttcatcggcttcgccggcaatctggtgatcggcgtctgggtcggcaatgacgacgaaacgccgatgaccggcatcagcggcggcggcctgccggccaagctgtggcaaagcttcgccgcccgcgccctggccggcggggtcgcgggcagcgccccggccgcgccgatcgccgccgccaccaccgccaccctccccgccgccgctccgcccgcccccaccccggcgccggccgtcccgtcgcgccaaccgttctcggccgtgcccgaggcggtggtcgataccggaaccttgcgcctgggcgggcgggtggttcgccttgaaggggtgaagggcctcaccggccgtccggcccgcgatatggcgggctatatcggcgatcgctccgtcacctgccgcccggcgggacgcgagcgctggcgctgcgatgtcgaaggctgggatctgtcggaagtggccttgttcaacggcggcgcccgcgccaccgccgacgcgccggccgatctggtcgccgccgaacgcaaggcccgccaagccggccggggtgtctgggggcgctga

SEQ ID NO: 50287 - protein, 719 aa, Rhodospirillum rubrum
MRHPGRIALAIAGVVLALGVLVLAINLYTMPLSPSFQEPERSGFLIADAEGTVVATRGVTAGRPVALAEMPASLVNAVIAFEDRRFRDHWGVDPRGIARAIWVNLRSGGRTQGASTLTQQLVKNTLLTPEKTFTRKIQEAMLALWIERKLTKDEILERYLNSLYLGAGSYGVDAAARRYFNKPVTDLSLAESAMIAGLIQAPARTGPTTALDVARQRAELVLDVMRDQGLIGADEATWAKAHPASLAVPPVELPAYGAVSDWIADEARKALGPLSGDFLVVSTLDRRLQVLAQQTIQEGMAAEGAGLRATQAALVAMAPDGRVLAMVGGRDYQESQFNRAVQARRQPGSIFKLFVYLTALSNNWRPDDPIDDTPLTIDGWSPENYGGGAGHGSVPLRVAFAHSYNLAAVRLQEAVGREAVIATARSMGLKDDLQPLPSLALGTFPATLLDLTSAFAAVAADRATVQPRVIEVLRTPGSGEIRPPVRQSGRAPWPRASALDLLNAVVTQGTGRAAALGVPTYGKTGTTQDNRDAWFIGFAGNLVIGVWVGNDDETPMTGISGGGLPAKLWQSFAARALAGGVAGSAPAAPIAAATTATLPAAAPPAPTPAPAVPSRQPFSAVPEAVVDTGTLRLGGRVVRLEGVKGLTGRPARDMAGYIGDRSVTCRPAGRERWRCDVEGWDLSEVALFNGGARATADAPADLVAAERKARQAGRGVWGR

SEQ ID NO: 50288 - DNA, 2319 bp, Ralstonia metallidurans CH34
  CDS (1)..(2319)
atgatctgggtgatcggactgcttatcgccggcatggcagcggtagcgctgctggttggctatgcgttggttgtggcggcgccgaacctgccgtcgctggacacgatcaccgactaccgccccaagatcccccttcggatctatacggccgacaacgtgctgatcggcgagttcggcgaggaacgtcgcaacttcgtgccgatcaccgaaatccccgatgtcatgaagaaggccgtgctcgcgatcgaggacgaccggttctacgagcacggcggcgtggacttcgtcggcgtgatgcgcgccggcctggccaacctgcgcgggggtctgtcgcaaggtgcctcgacgatcacgatgcaggtggcgcgcaacttcttcctttcgagcgagaagacctacacgcgcaagatttatgaaatgctgctcgcgtacaagatcgaggcgaatctgagcaaggatcagatcctcgagctctacatgaaccagatctatctggggcagcgcgcctacggcttcgccagcgcggcgcgcgtgtacttcggcaagtcgatcaaggacgtgacgccggccgaggccgccatgctggccggcctgcccaaggcgccgtcggcctacaacccggtggtcaacccacgccgcgcgaaggtgcgccaggagtacatcctgcagcgcatgcgcgacctgcactacatcacgccggaacagtacgaccaagccgtgcgcgaaccactgaacgtgcgtagtgaaggcaacgaattctcgacccacgccgagtacgtggcggaaatcgtgcgccagctgatgtacgcgcagtaccgcgaggaaacctatacccgcggcctgacggtctacaccacgctgaccaagcccgatcaggatgccgcctacgagtccgtgcgcagcggcatcatgaactacgagcgcaagcacggctatcgcggccccgaagcgttcatcgacctgccgtccgatccgaccgaacgtgaacaggccatcgacgatgcgctggtcgagcatccgggcagcgacgacctgcgctccgccgtggtcacgagcgtcacgccgaaacaggttcgcgcgactctgctctcgggcgaggtggcaacgatcgaaggcacggcgctgcgcttcatcgcgccgtcgctggcggccagcgcgcagcccaaagtgaagatccgcccgggcgcgatcatccgcgtgacgcaggacccgaaggacaactcgtggacggtgacacaattgccggaagtcgccgccgcgttcatctcgatcaaccccgaggacggtgcgatccgctcgatggtgggtggcttcgactacaaccggaacaagttcaaccatgtgacgcaagcctggcgtcagcccggatcgagtttcaagccgttcatctacacggctgcgctcgaaaagggcttctcgccggccacggtgatcaatgacgcaccgctgacgatcggaccggatacgggtggccaggtctgggaacccaagaactacgacggcaagttcgaaggtccgatgacgatgcgccgcgcactggccaagtcgaagaacctggtgtcggtgcgtatcctgcgcgcgatcggcacgcagtacgcccaggactacatcacgcgcttcggcttcgaggccgacaagcatccggcctacctgccgatggcgcttggcgcgggtagcgtgacaccgctgcagatggcgggcgcctactcggtgttcgccaatggcggctatcgcattaacccgttcctgatccagcgggtcgaggattcgcgcggcaagatcgtctcggagactcatcctcagaaggctggcggcgatgccgtgcgggtgctcgacgcacgcaccgcgttcatcgccgacagcatgctgcgcgaggtcgtgcgtagcggcacggcgaacccggccaagcagcgcctgggccgtaacgacatggccggcaagaccggtaccaccaacgatgcggtcgatgcgtggttcgccggctacacgccgaagctggtggcgattgcctggatgggctacgaccagcccaagagcctcggtgtgcgcgaaaccggtggcggactggcactgccgatctgggtcggctacatgagcaaggcgctcaagggtgtgccggaaagcccggatcgccagccgcctgaaggtgtggtcatggtagcgggagactggacgctcgaggaaaacgccggcggcgcaggcgtggcatctgtgggcctgggcgacccatggcctggcaagccggacgaaagctcgcgcccgccacaggacaccgaggcggaaaagaagaagatcctggaaatgttcggcggagcctga

SEQ ID NO: 50289 - protein, 772 aa, Ralstonia metallidurans CH34
MIWVIGLLIAGMAAVALLVGYALVVAAPNLPSLDTITDYRPKIPLRIYTADNVLIGEFGEERRNFVPITEIPDVMKKAVLAIEDDRFYEHGGVDFVGVMRAGLANLRGGLSQGASTITMQVARNFFLSSEKTYTRKIYEMLLAYKIEANLSKDQILELYMNQIYLGQRAYGFASAARVYFGKSIKDVTPAEAAMLAGLPKAPSAYNPVVNPRRAKVRQEYILQRMRDLHYITPEQYDQAVREPLNVRSEGNEFSTHAEYVAEIVRQLMYAQYREETYTRGLTVYTTLTKPDQDAAYESVRSGIMNYERKHGYRGPEAFIDLPSDPTEREQAIDDALVEHPGSDDLRSAVVTSVTPKQVRATLLSGEVATIEGTALRFIAPSLAASAQPKVKIRPGAIIRVTQDPKDNSWTVTQLPEVAAAFISINPEDGAIRSMVGGFDYNRNKFNHVTQAWRQPGSSFKPFIYTAALEKGFSPATVINDAPLTIGPDTGGQVWEPKNYDGKFEGPMTMRRALAKSKNLVSVRILRAIGTQYAQDYITRFGFEADKHPAYLPMALGAGSVTPLQMAGAYSVFANGGYRINPFLIQRVEDSRGKIVSETHPQKAGGDAVRVLDARTAFIADSMLREVVRSGTANPAKQRLGRNDMAGKTGTTNDAVDAWFAGYTPKLVAIAWMGYDQPKSLGVRETGGGLALPIWVGYMSKALKGVPESPDRQPPEGVVMVAGDWTLEENAGGAGVASVGLGDPWPGKPDESSRPPQDTEAEKKKILEMFGGA

SEQ ID NO: 50290 - DNA, 2223 bp, Ralstonia metallidurans CH34
  CDS (1)..(2223)
atggcctttggcgcctggcacgtctatcaggcatggctgtcgctcccggacgtcaatagccttgccgcgttcaagccagacaggccgctgcgcatttattctcaggatggcatcctcctggccgagtatggcgacgagcgccgggagatcgtcccgctttccagaattccgatcgtcgtgcagcagagcctgctggcgatcgaagatgcgcggttctacgaacacggtggcgtggacttctcgggattgttccgcgctgcatgggccaacttcgcatcgggccggcacgcgcagggggccagcaccatcaccatgcaggtagcgcgccgcctgtacctgtccagcgagaagacttacgaccggaagctgcgcgaagttcttctggccttcaagctggagcagcagttcagcaagcaacggctgcttgaggtctatatgaaccagatctatctgggcgagcgcgcatacggatttgctgccgcggcgagcatctatttcgacaagtcactcgaccagttgaccccagcggaagccgccctgctcgcgggcctccccaaagcaccgtccgcattcaacccgacggtcaacccggagcgtgcccgcgtacgccagcggtacatcctcgcgcgcatgcacgagcttggatatctgggcgacgaacagtacgcatccgcattggatgaaccgcttcggctgaagccacgtagctatgccatcgacccggcatttgcctttccggtggagcgcgcacgccaactggtcgtggaccagtacggtgaacgcgcctatcgcgatggcctggacgtgacgctaaccattcaaaccgccacgcaggcagccgcttacgatgccctgcatgacggcctgcttcgcgcccagcaaagacgacgctatatcccgctgggacgggtggccatcgacggcaatgcgccagcatcggggcttgacgactatccggatcgggacggcctcaccacggccgtcgtcaccgccacggccgatcgcagcggccgcctgacggtcaagacgcgcgatggcacgacccttcgtgcgcaagcacccgcgtatgccgcgacgccgctgacgcgcggcacggttgtcaccatggcaagcctgggtggcaaatgggagatcgggcaagcgcccgacatggagggcgcgctggtttccatcgattccgtcagcggcgatgtcgtggcgtgggtgggtggctatgacttccatcgcggcaagtttgatcacgccgtgcaggcgttgcgccagccgggctcctgcttcaaaccctttgtctactccgcctctctcgaaaaaggctactttccgggaaccatggtggacgacagtcagcgggtactggactcgaccgtcaccggtgcccggccctggcggcccaagaactacggcggccgctacgacggcttcatcacggcacgcgaggggcttgtccgctccaagaacctggtgacggtggggctgacgcaggcttccggtatcgattacgtgcgggatttcgcgctgcgattcggcttcgcgccagacctgaatcccggcagtttccccctggcgctgggcgccggcagcgtgacgccgatgcaattgacgcaggcgtacgccgtcttctccaacggcggctatctcgtgcagccgcgcctgatcgcccggatcgtgcagcgcggtgaccaggagctctacacatcggccggagacatcgagcgcaaacagatcatctccccacgcaacgcgttcatcatggactcgctgcttcgcgatgtggttcggaaaggcaccggtcgcgcggcggcccatatcgacaaggccgacgctgccggcaagacggggacctcgaacgatgccagggacgcatggttcgccggatacgcgacggggctggcgaccaccgtatgggtaggccatgaccagttccgcagcctcggggcggtcacgggtgggacgcttgcactgccgatctggacggacttcatgcgccacgccacggctgaccgcgccccgatcagcagagcgttgccggacgatgttgtcgaggaaaacggcgactacatctaccgcgagtatcgttcgtccgcctgcgtgagcgattcccacgcattcatccggacgggataccgctgcgcatccgagcccgcgcctgtcccgacacgcgagcagcaacgcgagcacgagcagattctggagtggttccggcaagacgccgataacgtgtga

SEQ ID NO: 50291 - protein, 740 aa, Ralstonia metallidurans CH34
MAFGAWHVYQAWLSLPDVNSLAAFKPDRPLRIYSQDGILLAEYGDERREIVPLSRIPIVVQQSLLAIEDARFYEHGGVDFSGLFRAAWANFASGRHAQGASTITMQVARRLYLSSEKTYDRKLREVLLAFKLEQQFSKQRLLEVYMNQIYLGERAYGFAAAASIYFDKSLDQLTPAEAALLAGLPKAPSAFNPTVNPERARVRQRYILARMHELGYLGDEQYASALDEPLRLKPRSYAIDPAFAFPVERARQLVVDQYGERAYRDGLDVTLTIQTATQAAAYDALHDGLLRAQQRRRYIPLGRVAIDGNAPASGLDDYPDRDGLTTAVVTATADRSGRLTVKTRDGTTLRAQAPAYAATPLTRGTVVTMASLGGKWEIGQAPDMEGALVSIDSVSGDVVAWVGGYDFHRGKFDHAVQALRQPGSCFKPFVYSASLEKGYFPGTMVDDSQRVLDSTVTGARPWRPKNYGGRYDGFITAREGLVRSKNLVTVGLTQASGIDYVRDFALRFGFAPDLNPGSFPLALGAGSVTPMQLTQAYAVFSNGGYLVQPRLIARIVQRGDQELYTSAGDIERKQIISPRNAFIMDSLLRDVVRKGTGRAAAHIDKADAAGKTGTSNDARDAWFAGYATGLATTVWVGHDQFRSLGAVTGGTLALPIWTDFMRHATADRAPISRALPDDVVEENGDYIYREYRSSACVSDSHAFIRTGYRCASEPAPVPTREQQREHEQILEWFRQDADNV

SEQ ID NO: 50292 - DNA, 2064 bp, Ralstonia metallidurans CH34
  CDS (1)..(2064)
atgcgcgccatgaaaaagattgcagtcaaggctgccggcgtcgtcgcggcgctgggagccgccggcgtcctgctcgtcggctttgccgcggtagtcagcctgcggcaacttccctcggtcgacgcattgcgcgactatcgtccccaggtaccgctgcgcgtgttcaccagcgacgatgttctcattggcgagtttggcgccgagcatcgagagttcatcccgatcgagagaatgccgaagctgatgaccgaggcactactcgcggccgaggacgaccagttctacaaccatgccggcgtggacatccccggcctggtccgcgcggcgctggcagacctcggcgagggctacgcgcagggcgcatccaccatcacgatgcaggtggcgcgcaacttctacctgtcccgcgaaaagacgctcgcccgcaaatggtacgaagtcctgctggcatggcagatcgaccgcacgctgcccaaggaccgcgtccttgagctctacatgaaccaggtctacctgggcgagcacgcctacggcttcggcagcgccgcgcagacgtacttcggcaagccgctggcgtcgctctctctggcggagaccgcaatgctggcggggctgcccaaggcaccctcgacgatgaatccgcaggtgaactacccgcgcgccaaacgtcgccaggagtatgtgctcggccggatgctggcgctgggcatgatcacgcaggaccagtatcgcgaggcgcgcggcgcgcaactcgtagtgagccgcgacgccaacggcagcttcagcgggcacgcggagtacgtggccgaactggcacggcaactggcgttcgaccgcttcggcgacgaagcctatacgcgcggcatcaatgtctacaccacggtgtcgtcggtgcgccagacattggcgtacgacgccgtgcaggccggactggccagttacggcaagcggcacggctcggcgaaggcacaggtcgcgctgccccaggcggcgctggtctcgctcgatgcgagcaccggcgcgattgaagccatggtgggtggcgccagtttcgatacgagccggttcaaccacgccacgcaggcacagcgccagccgggatccacgttcaagccgttcatctattcggccgcgctggagcgcggcatttcgcccggcacgctgatcaacgacgcgccgctcgacgacccgcgctggcagccgtcgaatgatgacaatcgcttcgtcggcccgatcacggtacgtcaggcgctggcggaatcgcgcaacctgccggctatccgcacgctgcgcgccattggcatcccctacgcaatcgacttcgcgggcaagttcggcttctccaccaagcggctgccgccgtatctgccgcttgcgctgggcacgggcaccacgtcgccgctgcgactggctgccgcctatggcgtgttcgccaaccagggccaccgcatcgaaccctacctgatagacaagatcacggatggcgacggaaacgtgctgtttgccgcgcagaacgcagcggaggtgacgcgtgtgatctccgagcgcaatgcgttcgtgatgaacagcctgctgcaaagcgtggtggacgagggcaccggtaccggcgtgaaacgctatctgcgccgggacgatgtggccggcaagaccggcaccaccaacgattcggtagacggctggttcgccggctacgcgggtgatgtggtaaccgtgacgtggatgggcttcgatgacaatcgcagcctgggccggcacgagttcggcgcgaccaccgcgctgcccatctgggctgcctacatggaaggacgcctggccggcgcgccagaagccagcttcccgacgccaccgcagcttgcccgccttaatgacgactgggcctacgcggagaacgcggacggatcccacggaattgcatcgattggattcccgccaccgactgtcacgccggacgtacctgccgagggcagccctcccggcgcaccgacagccgcggcgccgacccctgcagcgcttgaggtatcgccgcaggtatcgtcccaacgtcctgccgctaccggcctgtga

SEQ ID NO: 50293 - protein, 687 aa, Ralstonia metallidurans CH34
MRAMKKIAVKAAGVVAALGAAGVLLVGFAAVVSLRQLPSVDALRDYRPQVPLRVFTSDDVLIGEFGAEHREFIPIERMPKLMTEALLAAEDDQFYNHAGVDIPGLVRAALADLGEGYAQGASTITMQVARNFYLSREKTLARKWYEVLLAWQIDRTLPKDRVLELYMNQVYLGEHAYGFGSAAQTYFGKPLASLSLAETAMLAGLPKAPSTMNPQVNYPRAKRRQEYVLGRMLALGMITQDQYREARGAQLVVSRDANGSFSGHAEYVAELARQLAFDRFGDEAYTRGINVYTTVSSVRQTLAYDAVQAGLASYGKRHGSAKAQVALPQAALVSLDASTGAIEAMVGGASFDTSRFNHATQAQRQPGSTFKPFIYSAALERGISPGTLINDAPLDDPRWQPSNDDNRFVGPITVRQALAESRNLPAIRTLRAIGIPYAIDFAGKFGFSTKRLPPYLPLALGTGTTSPLRLAAAYGVFANQGHRIEPYLIDKITDGDGNVLFAAQNAAEVTRVISERNAFVMNSLLQSVVDEGTGTGVKRYLRRDDVAGKTGTTNDSVDGWFAGYAGDVVTVTWMGFDDNRSLGRHEFGATTALPIWAAYMEGRLAGAPEASFPTPPQLARLNDDWAYAENADGSHGIASIGFPPPTVTPDVPAEGSPPGAPTAAAPTPAALEVSPQVSSQRPAATGL

SEQ ID NO: 50294 - DNA, 2400 bp, Burkholderia fungorum LB400
  CDS (1)..(2400)
atgcaatccacgtctcctacgtccccgccgcccgcgccgcagaagcgcaaacgcccgttgtggctgaagctcatcatcggcttcgtgggtctcatcgtcgcaggcattctgtgcgtgctgctggtgctcggttatgcgctcgtcgtcgccacgcccaatctgccgtcgctcgatgcattgaccgattaccggcccaaggtgccgctgcgcatctatacggccgaccacgtgctgatcggcgagttcggcgaggaacggcgcgacatcgtccacattcaggacgtgcccgatagtctgaagaaggccatcctcgccattgaagacgcgcgcttctacgaccacggcggcgtcgacctcaccggcattgcgcgcgcgggtatcgtcgcgctgaccaatggccacgccacgcagggcgcgagcacgatcaccatgcaggtggcgcgcaacttcttcctctccagcgagaagacttacacgcgcaagatctacgagatgctgctcgcctacaagatcgaatcgaagctgtcgaaagatcagattctcgaggtgtacatgaatcagatctatctcggtcaacgcgcgtacggattcgcaagcgcggcgcgcgtttacttcggcaaagacctgaaggatctgacgctggccgagtccgccatgctggccggactgcccaaggcgccgtccgcctataacccggtggtcaacccgaagcgcgcaaaggtgcgccaggagtacatcctgcagcgcatgtacgagttgcactacatcacccaggaacaatacgacgaagcgagcaagcagccgctggtggtcaagggcgcgggcaaggagttcagcgtgcacgcggaatacgtcgcggaaatggtgcgtcagatgatgtacgcgcaatatcgcgaggaagcctatacgcgcggcctgaacgtggtgaccacgatcgattcggccgaccaggacgtcgcttaccgggcgctgcgcaaaggtctgacggactacgaacggcgccacggttatcgcggtccggaggcgttcatcgatttgccgtccgacgccgacgaccgcgaacaggccatcgacgacgcgctgctcgaacacccggacaacggcgaaatcattgccgccgtggtcaccgcggcgagtccgaagcaggtgcaggccgctttcatcgacggcaatgtcgcgacgatccagggcgacggcttgcgcttcgcgcagttcgcgctcggtccgcgcgctcagccgaatcaacgtgtgcggcccggcgcgatcatccggctcgtcaagaacgacgacggcgactggtcgatcacgcaattgccgcaagtggaaggcgcgttcgtttcggtgattccgcaagatggcgcgatccgtgcgctggtcggcggtttcgacttcaacaagaacaagttcaatcacgtgactcaggcgtggcgtcagccgggttcgagcttcaagccgttcatctattcggcgtcgctcgaaaagggactcgggccggcaaccgtcatcaacgacgcgccgctctttttcagcgcggctgaaaccggcggccaggcgtgggagccgaagaactatggcggcggcttcgacggcccgatgaccatgcgcacggcgttgcagcgctcaaaaaacctggtgtcgattcgcatcctgaaccagatcggcacgaagtacgcgcagcagtacatcacgcgcttcggcttcgacgcggatcgtcacccggcttatctgccaatggcgctgggcgccggtctcgtcacaccgttgcagatggcgggcgcgtactcggtgttcgccaacggcggctatcggatcaacccgtatctgatcgccgaagttaccgaccagcgcggcatcgtggttgcgcacgcgcagccgctggtggcggcgcaaagcgcgccgcacgcaatcgaaccgcgtaatgcgtacgtgatgaacagcctgctgcaaagcgtggcgcaacgcggcacgggcgccaagaccaatgtcctcaagcgcaccgatctcgccggcaagacgggcacgaccaatgattcgcgcgacgcgtggttcgccggttatcagcacacgctcacggccatcgcgtggatcggctacgacaatccgcgcagcctcggcgacaaggaaaccggcggcggtctgtcattgcccgtgtgggtcgaatacatggggcgcgcgctcaagggtgtgccggagtacaagatgccgatgcccgacggcctgaccgaactcggctcggagttgtacttcgacgacttcacgccggggcacggtttcgtcgccacggtcggcatcagtcaggcggcgctggatgccgaggcgagcggcgcgtcggcggccgcgcccgagcaggtcggcgaacaggagaagcaggacatcatgaacctgttccgcggccactga

SEQ ID NO: 50295 - protein, 799 aa, Burkholderia fungorum LB400
MQSTSPTSPPPAPQKRKRPLWLKLIIGFVGLIVAGILCVLLVLGYALVVATPNLPSLDALTDYRPKVPLRIYTADHVLIGEFGEERRDIVHIQDVPDSLKKAILAIEDARFYDHGGVDLTGIARAGIVALTNGHATQGASTITMQVARNFFLSSEKTYTRKIYEMLLAYKIESKLSKDQILEVYMNQIYLGQRAYGFASAARVYFGKDLKDLTLAESAMLAGLPKAPSAYNPVVNPKRAKVRQEYILQRMYELHYITQEQYDEASKQPLVVKGAGKEFSVHAEYVAEMVRQMMYAQYREEAYTRGLNVVTTIDSADQDVAYRALRKGLTDYERRHGYRGPEAFIDLPSDADDREQAIDDALLEHPDNGEIIAAVVTAASPKQVQAAFIDGNVATIQGDGLRFAQFALGPRAQPNQRVRPGAIIRLVKNDDGDWSITQLPQVEGAFVSVIPQDGAIRALVGGFDFNKNKFNHVTQAWRQPGSSFKPFIYSASLEKGLGPATVINDAPLFFSAAETGGQAWEPKNYGGGFDGPMTMRTALQRSKNLVSIRILNQIGTKYAQQYITRFGFDADRHPAYLPMALGAGLVTPLQMAGAYSVFANGGYRINPYLIAEVTDQRGIVVAHAQPLVAAQSAPHAIEPRNAYVMNSLLQSVAQRGTGAKTNVLKRTDLAGKTGTTNDSRDAWFAGYQHTLTAIAWIGYDNPRSLGDKETGGGLSLPVWVEYMGRALKGVPEYKMPMPDGLTELGSELYFDDFTPGHGFVATVGISQAALDAEASGASAAAPEQVGEQEKQDIMNLFRGH

SEQ ID NO: 50296 - DNA, 2376 bp, Burkholderia fungorum LB400
  CDS (1)..(2376)
atgaccatcgccatctggttcgccggcctgatcgcgaccatcgcggtggtgagtgcgctgatcatcggctatgcgctggtggtgatgggcccgcaactgccgtcgctcgacgcgctcaccgactatcgcccgaaggtgccgctgcgcgtctataccgcggaccatgtgctgatcggcgaattcggcgaagagcggcgcagtctcgtgcgcttccaggacattcccgatcagatgaagaaagcggtgctcgcgatcgaagactatcgcttctacgagcacggcggcgtcgacttcatcggtattctgcgggcaggtgtctccgatctttcgcacggcggcgcttcgcagggcgcgagtacgatcaccatgcaggtggcgcgcaacttcttcctgtcgagtgagaagacctacacgcgcaagatctacgaaatgctgctcgcgtacaagatcgagcgcgcgctcaccaaggatcagattctcgagctgtacatgaaccagatttatctgggtgagcgcgcctacggtttcgccgcggccgcgcgcgtgtacttcggcaaggatctgaaggacatcacgctggcggaatcggcgatgctggcgggcttgccgaaggcgccctccgcgtataacccggtggtcaatccgaagcgcgcgaagatccgtcaggagtacattctgcggcgcatgctcgagctcagatacatcagccaggagcagtacgaccaggcggtgaaggaagagatccacaccaagaatccgggcaacgaatacagcgtgcacgccgagtacattgccgaaatggtccggcagatgatgtacgcccagtacaaggacgaaacctatacgcgcggcctgaacgtcaccaccacgatcgactccgccgaccaggacgccgcctatcgcgccgtgcgcaagggcgtgatggattacgagcggcggcacgggtatcgcgggccggagggcttcgtgcagctgcccgcgccgggtgacgaccgcgatcagacgatcgacgacgcgctcaccgatcaccccgacaacggcgagatcatcgccgccgtggtgacggacgcgagtccgaagcaggtcaaggcgcaactggtggacggcacgcaggtggcgatcagcggcgacggtctgcgcttcgtagcgggcgcgctgagcacgcgcgcggcggcggccacgaagatcaggccgggctcgatcgtgcgtctggttgccgacgacaagggcaactggcagatcacgcaactgccgcaggtggaaggcgcgctggtatcgctcacgccgcaggacggcgcgattcgcgcactggtgggcggtttcgacttcaacaagaacaagttcaaccacgtcacgcaggcgtggcgccagccgggttcgagcttcaagccattcatttactcggcggcgctggacaaaggtctcggaccggccacgatcatcaacgacgcgccgctgtatttcccgtccagcacaccgggcggcgacgcgtgggagccgaaggacgacgaccagccggacggtccgatgccgatgcgtctcgcgttgcagaagtcgaagaacctggtgtcgatccgtattctgtcgttcatcggcaccagatacgcgcaggacttcgtcacgcagcgtttcggcttcgacgccgacaagaccccgccgtacctgccgatggcgctcggcgcgggcctcgtcacaccgttgcagtcggcgggtgcgtattcggtgttcgccaacggcggctaccggatcaatccgtatctgatcaacgaggtgacggacgcgcgcggcgagccgctctccagagcgcagccgctcacagccggtcgcgatgcgccgcgcacgctcgaaccgcgcaacgcgtacatcatgaacagcctgctgcattcggtggcgaccgccggcacgggcgcgggcaccaacgtgctgcatcgttcggacctgcagggcaagacgggtaccaccaacgacgcgaaggacggctggtttgctggttatcagcagtcgctcgtggcggtggcgtggatgggttacgaccagcccaagagcctcggcagccgcgaattcggcgcgcaactggcattgccgatctgggtggaatacatgcagcgcgcgttgcgcggcgtgccgcaaagcgaaccggcgcagccggacggcgtgacatccgtcgacggtgagctgttctatacagacatgacgccgggcaacggcttcgtggccagcatcggtctggattcggcgaaccccaccgcgggcgcgagcgatgcggtcggcggcgtgggacccgcgggcatgacgccgccggcggtaccgccgccgagcgtctcgtcgaacgagaagaagcagatcatggatctgttcgagtcgaacaagccctga

SEQ ID NO: 50297 - protein, 791 aa, Burkholderia fungorum LB400
MTIAIWFAGLIATIAVVSALIIGYALVVMGPQLPSLDALTDYRPKVPLRVYTADHVLIGEFGEERRSLVRFQDIPDQMKKAVLAIEDYRFYEHGGVDFIGILRAGVSDLSHGGASQGASTITMQVARNFFLSSEKTYTRKIYEMLLAYKIERALTKDQILELYMNQIYLGERAYGFAAAARVYFGKDLKDITLAESAMLAGLPKAPSAYNPVVNPKRAKIRQEYILRRMLELRYISQEQYDQAVKEEIHTKNPGNEYSVHAEYIAEMVRQMMYAQYKDETYTRGLNVTTTIDSADQDAAYRAVRKGVMDYERRHGYRGPEGFVQLPAPGDDRDQTIDDALTDHPDNGEIIAAVVTDASPKQVKAQLVDGTQVAISGDGLRFVAGALSTRAAAATKIRPGSIVRLVADDKGNWQITQLPQVEGALVSLTPQDGAIRALVGGFDFNKNKFNHVTQAWRQPGSSFKPFIYSAALDKGLGPATIINDAPLYFPSSTPGGDAWEPKDDDQPDGPMPMRLALQKSKNLVSIRILSFIGTRYAQDFVTQRFGFDADKTPPYLPMALGAGLVTPLQSAGAYSVFANGGYRINPYLINEVTDARGEPLSRAQPLTAGRDAPRTLEPRNAYIMNSLLHSVATAGTGAGTNVLHRSDLQGKTGTTNDAKDGWFAGYQQSLVAVAWMGYDQPKSLGSREFGAQLALPIWVEYMQRALRGVPQSEPAQPDGVTSVDGELFYTDMTPGNGFVASIGLDSANPTAGASDAVGGVGPAGMTPPAVPPPSVSSNEKKQIMDLFESNKP

SEQ ID NO: 50298 - DNA, 2172 bp, Enterococcus faecium
  CDS (1)..(2172)
atggattttcaaagcattttagaaaagataaaagctgctttgatcagtttttggcgttggatcagaccatatctcggacaattccatcgatggcgaaagcgcatctggaaaaaatatcatgtgaacaaattgattttgctgattggtttgatctgtgtcttagtgacaagtatctacctctttattttagcaaaacaagcaaatgtcgaaacgttaaaatcaggattaagccaatcgacagtcatttatgataagaaaaacgaagaagctggcacactgtacgcccaaaaaggaacatatgtagaattaaacgcgatttctccctatatccaagatgcagtaatctcgacagaagataggaatttttacgagcatcacgggtttgatatcaaagggattgcccgtgcagcagtccgaatggtcttgtctggcggaacatcagggggcggaggaagtacgatcactcagcagcttgccaaaaatgcgtatctgacattagaccaaacgtttgatcgaaaagcgaaggaattatttttggcaatcgagatcgaaaagaagtacagcaaagaagaaatcttgaccatgtatcttaacaatgcctattttggcaacggggtatggggtgtccaagacgcttccagaaagtattttggagtagatgcaacgaatgttacgctgtctgaggctgctactttggcaggaatgctgaaaggtcctggtatttataatccgatcgatcacccaaaaaatgcgaatgatcggaaaaacacagtactaagtgtaatggaagaaaacggaaaaatcacaaaagaacaagaacaagcagaaagccagacagatatcagcgcgtatcttaatgacacatacgataattcagattctggttatcgttatccttattattttgatgcagtgatcgatgaagcagttaacgagtatggtcttgatgaagaagatgtcatgaataaaggctataaaatctatacagctttagatcaggattatcaaaagcaattagaagctacttatcaaaacagtgcattattcccagcaaatgcttcagatggtgccatggtccaatctgcttcagtagctttagatccgaatacaggtggtgtacaagcactagtaggacgaagaggagatcatgtctttagaggattcagctttgctacacagatgcgtcgttcaccaggatcaacgatcaaaccattaagcgtatatacaccagcactggaagctggatacaagccttccagtatcttgaaagacgaaccgcaaagttattacgatgcgcataattttgacgggacataccaaggagaagtaccgatgtatcaagctgttgcacaaagtttgaatttgcctactgtatggcttttgcatgagatcggtttacaaaaaggatatgataaagcagaagaattcggcctgcctttagcaaaatctgataagtattatggcttagcccttggtggactggaaaaaggagtatctccattgatcatggcgggtgcttacagtgcatttgccaatgatggtcagatgtatacgccgcatcttatcacgaaaatcgttgattcgactggagcggtgatcgtcgataacacaaacaaaaaaccaaaacaggtcatatcaaaggaaacagccgatgaaatgaccagcatgcttcttggtacattttcaaatggaacagcggctgctgcgaatcctgcaggttatacgatagcagggaaaacaggaaccacagaaactaatttcgatgccacaaaagcaaatgaccaatggatgatcggttacacgccagacgtagtgatttcgacatggatgggttacgaagaatccagcaagctgcactatttggaagggacaagtggaaatgttgtcgggaaagtcttcaaatcagcggcagaaggcatccttccgtatacttcaaaaacaggatttagtgtagcagatgcctatgccacaggaggacaagtggtagctgcagatcaagttggaaacacaggaaattctaatggagagtctggaaattggcaagataacttgaatcaatatggtgaacaagcaaaagaagggctgaaaaacttcggcgatatggtgaaagaaggcgttcagggaattggtgaagcggctaaagacctctggcggaaatatcaaggagagtag

SEQ ID NO: 50299 - protein, 723 aa, Enterococcus faecium
MDFQSILEKIKAALISFWRWIRPYLGQFHRWRKRIWKKYHVNKLILLIGLICVLVTSIYLFILAKQANVETLKSGLSQSTVIYDKKNEEAGTLYAQKGTYVELNAISPYIQDAVISTEDRNFYEHHGFDIKGIARAAVRMVLSGGTSGGGGSTITQQLAKNAYLTLDQTFDRKAKELFLAIEIEKKYSKEEILTMYLNNAYFGNGVWGVQDASRKYFGVDATNVTLSEAATLAGMLKGPGIYNPIDHPKNANDRKNTVLSVMEENGKITKEQEQAESQTDISAYLNDTYDNSDSGYRYPYYFDAVIDEAVNEYGLDEEDVMNKGYKIYTALDQDYQKQLEATYQNSALFPANASDGAMVQSASVALDPNTGGVQALVGRRGDHVFRGFSFATQMRRSPGSTIKPLSVYTPALEAGYKPSSILKDEPQSYYDAHNFDGTYQGEVPMYQAVAQSLNLPTVWLLHEIGLQKGYDKAEEFGLPLAKSDKYYGLALGGLEKGVSPLIMAGAYSAFANDGQMYTPHLITKIVDSTGAVIVDNTNKKPKQVISKETADEMTSMLLGTFSNGTAAAANPAGYTIAGKTGTTETNFDATKANDQWMIGYTPDVVISTWMGYEESSKLHYLEGTSGNVVGKVFKSAAEGILPYTSKTGFSVADAYATGGQVVAADQVGNTGNSNGESGNWQDNLNQYGEQAKEGLKNFGDMVKEGVQGIGEAAKDLWRKYQGE

SEQ ID NO: 50300 - DNA, 3390 bp, Thermobifida fusca
  CDS (1)..(3390)
atgccagggggcgacgaactgagcgagagcagtagaggcgacaccactccgcgccctgagaccgaggaagcgactgtcgccgattcttccgtaacgaacgacgatgtgagcgtcgacgagtctggcgttgacgctcgtgctgacgatgtcgacgacgggagcgaacccgaatggttcgcttccgctggggaatccccttacctcgaggccagcgcgttcaaagacagcggcagtttctttagagacaaggttgcccgcagcctggccgaagagtacgggatcgatctcgacgacgccggagaccagaccgcggactccgcagccagtagcggagcagacggccagcaggcccaggacgcagacacgcatgccgggaccgcgtctcccgccgaggacaccgaccaggctgcagcggctgcggctggtgcagaggaggacgaggaggcgacggagcagctccgcccggctgatgctgtgggcggcgattctggtggtcttgatgaggccacggtgcagataaccccgacagatgcggcggatgcgtctgcggtggacgaggaagggaccactgaacggctcagcccgccgtcctcctccggccccggggcagacgacgaagccaccgaacagatcaacctgccgtcgtcggccgcggcggacgacgaagagaccacggagcggctcagtccgtctgctgcacgagcgggagacgacgaggccacggaacggcttgatgtgccagcctcctctaccgcggtggatgcggaggaggcgacggagcagctccgcccggctgatgctgtgggcggcgattctggtggtcttgatgaggccacggtgcagatagccccggtaggtgcggtggatgcggaggagaccaccgaacggctcagtccgtctgctgcacgagcgggagacgacgaggccacggaacggcttgatgtgccagcctcctctgccacggtggatgcggaggagaccaccgaacggatcagccccgtcacccccaccggtcacggcagcggcgaagagaccacggtccagctctccccggtagaggcagcgcagagccaggccgcaccctccacgaccgacccctccgagagcaccaagctcgaaaccaccgcggtcctccgcgagaacctgaaatcgcggctccggaagcgccccctccgtccgcggttccggaagtcggctgctgccgcaggcggtgtgggacccgccagtccgcctccccccaccgccccgtcgggaacctcgcactccagcggccccgcggagaagaaggcaccagcgaagaaaaccaagcggaagaaaccgttgtggtggcggatcacccgcgccggactgatcgtcatcgtgctgctcgtggggctggtgaccggcgcattcgcctacgcctactcgatgttcgaggtccccgacgcagcccaggccgacgcgactgcgcagggctccatcttctactacgccgacggatcagtcctcaccgaacgcggcgtcaaccgtaaaccggtctccctcgacgaggttcccgagcacgtccagaacgccatcctctccgcggagaaccgcgggttctgggacgagccgggcgtgtccatcaccggtacggcgcgtgcggtgtggtccaccgtcactggaaagcagctccagggcggatccaccatcacccagcagttcgtccgcaactactacgaagggctcagccaggagcagaccatcgagcgcaaactcaaggagatcatcatcgcgctcaaggtcgaccgctcccagagcaaggagtggatcctggagcagtacctcaacaccatctacttcggacggaacgcctacggcatccaggcggccgcggaagcctactacgacaaggatgtcggcgacctcacgccggatgaggcggcgttcctcgccgcagccatccagcagcccaccaagttcggcttcgcggacagcgacaccactcctgagatggagagccgctggcagtacgtggtcaacggcctggtggacatggggtcgatcactgaagccgaggcggcagagtacaagttccccaaacccctgccggaacggccgcaggacaacatcgacctcagcggctacaagggctacatgttccagcaggccatgaaggagctggaggagctcggctacaccgaggacaacatcaaccggggtggctacgagatccacaccaccttcgaccccaagctgatggagctggcctacgaagccgtgcaggagaccgtgcccatcgacgacctccccgaaggggtgcgggtcgggctcagcgtggtcgatccgaagaccggcggggtgctggccttctatggcggagaggactacttcgagaaccagtacgacagcgcgttcctcggcaccgcgcaggcagggtcggcgatgaagccgtacgtgctggccgcagccctcaaggaagggttgagcctgcacacggtggtggacggccgcggcccccggtacatcaacggcacgcggatccagaacgcgggcaacgcccccggtggtccgatgaacctcatccaggccaccgcggtctccaacaacctcggctacatcgacctcgctcagcgggtcggactggagaaggtcgcggaaaccgcctacgccatggggctgcccgaaggaagcatcgacctggtgccggtgctgccgttgggcgccaacagtgtgagccccaccgaccaggcgggcggctacgcgactttcgccaacggcggcgaacacatcgagacccacgtggtcgcttccatcatcaacaaggaaggtgaagaggaacgccccgagccgaaacgcaaccgggtgctcaccaaggagcaggcagcagacgccacctacgcaatgcgccaggtgatcacctccggtaccggaacggccgccaacattgggcgtccggcagcgggcaagaccgggaccaccgacggaagcgtggccgcctggttcgtcggctacaccccgcaattgtctgccgcggtgggcatctacagcggcgacaaccagaggttctacgtgccgggctggggcaccctgtccggcggtacgctcccggcgaccgtgtggcgcacgttcatgcagaaggcgctggcggacaagccggtggaggacttcccgtcgccctcgttcggcggatccgcgcagaactgggcgccccagccggagccgagcacgcctgcggacaccccgcaggaccagggcccgaaccaggacggcctgaacccggcgcccgagcctgaagtaccgcaaccggctcccgaacctgtggtgcctgagcctgtggtgcccgaaccggttgttccggaacccgtggtgcccgagccgggaggcccggatcctggtttcccaggaggggggctacctccgtcaggctga

SEQ ID NO: 50301 - protein, 1129 aa, Thermobifida fusca
MPGGDELSESSRGDTTPRPETEEATVADSSVTNDDVSVDESGVDARADDVDDGSEPEWFASAGESPYLEASAFKDSGSFFRDKVARSLAEEYGIDLDDAGDQTADSAASSGADGQQAQDADTHAGTASPAEDTDQAAAAAAGAEEDEEATEQLRPADAVGGDSGGLDEATVQITPTDAADASAVDEEGTTERLSPPSSSGPGADDEATEQINLPSSAAADDEETTERLSPSAARAGDDEATERLDVPASSTAVDAEEATEQLRPADAVGGDSGGLDEATVQIAPVGAVDAEETTERLSPSAARAGDDEATERLDVPASSATVDAEETTERISPVTPTGHGSGEETTVQLSPVEAAQSQAAPSTTDPSESTKLETTAVLRENLKSRLRKRPLRPRFRKSAAAAGGVGPASPPPPTAPSGTSHSSGPAEKKAPAKKTKRKKPLWWRITRAGLIVIVLLVGLVTGAFAYAYSMFEVPDAAQADATAQGSIFYYADGSVLTERGVNRKPVSLDEVPEHVQNAILSAENRGFWDEPGVSITGTARAVWSTVTGKQLQGGSTITQQFVRNYYEGLSQEQTIERKLKEIIIALKVDRSQSKEWILEQYLNTIYFGRNAYGIQAAAEAYYDKDVGDLTPDEAAFLAAAIQQPTKFGFADSDTTPEMESRWQYVVNGLVDMGSITEAEAAEYKFPKPLPERPQDNIDLSGYKGYMFQQAMKELEELGYTEDNINRGGYEIHTTFDPKLMELAYEAVQETVPIDDLPEGVRVGLSVVDPKTGGVLAFYGGEDYFENQYDSAFLGTAQAGSAMKPYVLAAALKEGLSLHTVVDGRGPRYINGTRIQNAGNAPGGPMNLIQATAVSNNLGYIDLAQRVGLEKVAETAYAMGLPEGSIDLVPVLPLGANSVSPTDQAGGYATFANGGEHIETHVVASIINKEGEEERPEPKRNRVLTKEQAADATYAMRQVITSGTGTAANIGRPAAGKTGTTDGSVAAWFVGYTPQLSAAVGIYSGDNQRFYVPGWGTLSGGTLPATVWRTFMQKALADKPVEDFPSPSFGGSAQNWAPQPEPSTPADTPQDQGPNQDGLNPAPEPEVPQPAPEPVVPEPVVPEPVVPEPVVPEPGGPDPGFPGGGLPPSG

SEQ ID NO: 50302 - DNA, 2193 bp, Thermobifida fusca
  CDS (1)..(2193)
atggcggtgctgttcgtcctcggggtcgcggggatcggcatcgcctacgccatggccccctcccatgaagaccttgaggccaaagccgacgtcaagctcgcagcgaacgtcgtctacttcgaggacggcaagaccgaggccaccaggttcggggaagtcgaccgggtgccggtcggtatcgagcaggtgccgcagaccgtgatcgacggtgtcctcgcggccgagcaccgcaccttctacgaggacaacgcgatcaacctgatgggtctgctccgcggtctcgtcttcggcggtacgcaaggtggtggttcgaccatcacccagcagatggcccggaactactacgactcgctgaccaccaacgagtcgtccacgatcgaccggtacgtccgtaagttcaacgagatcctcatcgcgttcaaggtcgagcagagcctgacgaaggacgagatcctcgagcagtacctcaacaccatttacttcgggcgcggcatcggggtgcaggcagccgcccaggggtacttcggcaaggacgtcagtgaactcgacgccgctgagggtgcgttcatcggcacggtgatccagcagccgggcaacttcggcactgcggtccccgactccgagatgtacgagatcctcaaggagcggtggcagtacacggtgaacggcctcgtcgagatgcacgaggagaaccccgagcgcggtcttagccgcgaagaggccgacaaactggagttccccgacccgctgccgctcgaagccgacgactcgtacgcgggctaccgcggctacatccaggaggcggtccgcagcgagctggagtcccgctacgggctgaccccggagcagattgcgcgcggcggctaccaggtgaccacttcgctcaacgagaagtggatgcagtacgccgaggaagtcgtcgaggagcagaaagaacggacgctgaacaacaccggccaggagatcccggaggagacccagttcggtatcgccatggtcgatacctccaccggtgagatcaaggcgttctacggcggtccggaccccacccagtacgccaaccagtctctggtgcagcggcagcaagccggctccgcgttcaagccgtacgtgctggccactgcgttggagcagggcatcagcctgcggagcatctacgacggcgacagcccgaaggagttcccgggcctggcccagccggtcaggaacgacggcaaccgcagctacggtccggtcgacttgatccagtccacccgggactcgatcaacaccagctacgtgcagttggcgatcgaggtcggcccgcaggcggtgatcgagaccgcgctggccgcgggaatcccggagaagcagttggaaacggccgagatcggtcccaacatcgcgctgggcaccatgtcggtcgccgcggtcgaccaggcggccgggttcgcgactttcgccaacggcggttaccacatgccgcagcacttgatcgctaaggtggtggacaccgagaccggcgaggagctgcagccgaaggacgccgacattctggagtccggtggcacccgggcgttcagcgcagagacggcggccgacgctacttacgcgatgcaacaggtcatcaccgacaaccacaacgccaagctggacgacggccgtcccatggccggcaagaccggtacctccaacaacgccgtgtccgcgtggtttgtgggctttgtgccgcagtactccactgcggtgggactgcatcgcaccgacggcgaaccgctcgtgctgcctggtgaggccagcatctacggtggtcaaatgccagcccggttgtggaaggcgttcatgaccaaggtgctggaggacgtgcctcccgaagagttcccccagccggtgttcggcggcgaggtgcgcaaccacgcaccgactccgagcccggatccttcgccttcgcaggagccggaggagaccgaggagccgaccaccgagccgagcatgccgcttccctcgttcactccgccgggtcggggcgacgagccgaactgcgacatccagtggtggctgccggagtgccgccaggatgacgagccgcccggcgacggggagccgacttctccgcctgacgagccgggccagccgggcaccgggcctggccccggcggtatcggcggtccggggtggaacagtaaccagatcgcttaccggggccgggagtga

SEQ ID NO: 50303 - protein, 730 aa, Thermobifida fusca
MAVLFVLGVAGIGIAYAMAPSHEDLEAKADVKLAANVVYFEDGKTEATRFGEVDRVPVGIEQVPQTVIDGVLAAEHRTFYEDNAINLMGLLRGLVFGGTQGGGSTITQQMARNYYDSLTTNESSTIDRYVRKFNEILIAFKVEQSLTKDEILEQYLNTIYFGRGIGVQAAAQGYFGKDVSELDAAEGAFIGTVIQQPGNFGTAVPDSEMYEILKERWQYTVNGLVEMHEENPERGLSREEADKLEFPDPLPLEADDSYAGYRGYIQEAVRSELESRYGLTPEQIARGGYQVTTSLNEKWMQYAEEVVEEQKERTLNNTGQEIPEETQFGIAMVDTSTGEIKAFYGGPDPTQYANQSLVQRQQAGSAFKPYVLATALEQGISLRSIYDGDSPKEFPGLAQPVRNDGNRSYGPVDLIQSTRDSINTSYVQLAIEVGPQAVIETALAAGIPEKQLETAEIGPNIALGTMSVAAVDQAAGFATFANGGYHMPQHLIAKVVDTETGEELQPKDADILESGGTRAFSAETAADATYAMQQVITDNHNAKLDDGRPMAGKTGTSNNAVSAWFVGFVPQYSTAVGLHRTDGEPLVLPGEASIYGGQMPARLWKAFMTKVLEDVPPEEFPQPVFGGEVRNHAPTPSPDPSPSQEPEETEEPTTEPSMPLPSFTPPGRGDEPNCDIQWWLPECRQDDEPPGDGEPTSPPDEPGQPGTGPGPGGIGGPGWNSNQIAYRGRE

SEQ ID NO: 50304 - DNA, 2406 bp, Thermobifida fusca
  CDS (1)..(2406)
ttgctgcagaaactcggtcagttgttcggggtctcggtcgctgccggagtactcgtggctgcgctcgccgctcccgccctcggcggtatcggcatcgctgcccgcaacgtagcgaccggcttcctcaacatgcccagcgagctagagaccccgccgccgccccaacgctcgatcatctacgacgcagaaggcggcgtcatcgctgaggtgtacgaccggaaccgggaactggtagaactcgaccagatcgccccgatcatgcagcaggcgatcatcgccatcgaggacagccggttctacgagcacggcggcctcgacatcgtgggcaccttccgcgccgccctgcgcaccatcgccgggcgcacccaaggcggctcctccatcacccagcagtacgtcaaaaacgtgctgatcgaaagcgccacatcccaggcggaacaagaagaagcccgcgaaaccaccctgggacgcaagatccgcgaactgcgctacgccatcgcgctcgaacagcggatgaccaaagacgaaatcctcgagggctacctcaacatcgcctacttcggggacggcgcctacggtgccgagtccgcggcccagcacttcttcagcgtcagcgccagcgaactcaacctcaaccaggctgccaccctggccggtctcgtccgctaccccgagctgtacaacccccgcctcaacccggaccaggcccaagaacggcgcgacgtggtcctcgaccggatggtcgccaccggggtgatcaccgaagaagaagccgagaagaccaaagcgcaagacctggaactcgacatctccacgcccagcaacgggtgcatgcccagcaagcagccgttcttctgcgactacgtgatccaggagatcgagaagaacgaagcgttcggggagaccgaaaccgaacgcgcccgctggctgcgcaccgcaggcctggagatctacaccacgctcgaccccgacatgcaggaggctgggcagaaagccgtagacaagtgggtgccgcgcaagaacgaagcccgcaaggtcgccgccgaagtcttgattgaacccggcaccggggagatccgggccatggtgcagagccgcaactacggccccgacgaaagcaaactcggcgaaacctccatcaacttcacagccaacgccgaccgcggcggcagcaccggcttccaagccggctccaccttcaaagccatcaccctggccgcggccctcgaaaaaggactgccgtacagcacgtccttcacctcgggcagcaccatcactgtcaccggccagaagaactgcgacggcaacactctcgccccgtggacagtgagcaactccagcgaaagcggcggcgccgccacccacaacatggtgtcgggcaccaaaggctcggtgaacacctacttcgcccaactgcagaaacgggtcggcctgtgcaacgtcatcaaaatggcggaaaaactcggcctgacccgggccgacggccaaagctacgacaacccgcgcacccaggggaacaactccttcaccctgggcagtgaggaagtctccccgctgaacgtggccgccgcctacgcgaccttcgcctcgcggggcatctactgcaagccgatggcgatcaccaagatcgtcgaccgccaggccgggcgcaccatcgaaatggaaccggagtgcgaacggcgcatctccaaagatgtcgccgacggcgtgaactacctgctccagcagaccttcaaaggcggcaccgccaccggactgggtatcggccgccctgccgccggaaagacgggaaccaccgacaactcggcgagcgcctggttcgcgggctacaccccgaacctggccggcgccgtgttcgtcggcgacccgcgcggccccaaccagtacccgctgcggaacgtcaccctcggcggacgctactactcggtggtctacggcgcgaccatccccggtccgatctggcaggaaaccatgcgggaagccgtgaagaaactggacgagaagagcttcgcacggtcgcccgcacggttcggctccaccagcgaacccgcgccgccacgacgagaggaccccacggacgccaacccggcttccagcccgggaagcgtacccaacgtggttggcatgtcccgtgaccaagcggtagccgccatcgaatccgccggctaccgggcgaacgtggccgaccggcggctgccgtccagccacccggaaggcaccgtggccctcgtcgagccttccgcgggctcccgcctcgccgaaggctccgtcgtcaacatcttcctgagccgcggccccgccgacaacggcaacagcaacggcggcaacggcaacggcggctgggaattccccggcggaggcggctgggagctccccgccttagatgaccagtggggcgcgttctag

SEQ ID NO: 50305 - protein, 801 aa, Thermobifida fusca
MLQKLGQLFGVSVAAGVLVAALAAPALGGIGIAARNVATGFLNMPSELETPPPPQRSIIYDAEGGVIAEVYDRNRELVELDQIAPIMQQAIIAIEDSRFYEHGGLDIVGTFRAALRTIAGRTQGGSSITQQYVKNVLIESATSQAEQEEARETTLGRKIRELRYAIALEQRMTKDEILEGYLNIAYFGDGAYGAESAAQHFFSVSASELNLNQAATLAGLVRYPELYNPRLNPDQAQERRDVVLDRMVATGVITEEEAEKTKAQDLELDISTPSNGCMPSKQPFFCDYVIQEIEKNEAFGETETERARWLRTAGLEIYTTLDPDMQEAGQKAVDKWVPRKNEARKVAAEVLIEPGTGEIRAMVQSRNYGPDESKLGETSINFTANADRGGSTGFQAGSTFKAITLAAALEKGLPYSTSFTSGSTITVTGQKNCDGNTLAPWTVSNSSESGGAATHNMVSGTKGSVNTYFAQLQKRVGLCNVIKMAEKLGLTRADGQSYDNPRTQGNNSFTLGSEEVSPLNVAAAYATFASRGIYCKPMAITKIVDRQAGRTIEMEPECERRISKDVADGVNYLLQQTFKGGTATGLGIGRPAAGKTGTTDNSASAWFAGYTPNLAGAVFVGDPRGPNQYPLRNVTLGGRYYSVVYGATIPGPIWQETMREAVKKLDEKSFARSPARFGSTSEPAPPRREDPTDANPASSPGSVPNVVGMSRDQAVAAIESAGYRANVADRRLPSSHPEGTVALVEPSAGSRLAEGSVVNIFLSRGPADNGNSNGGNGNGGWEFPGGGGWELPALDDQWGAF

SEQ ID NO: 50306 - DNA, 2055 bp, Novosphingobium aromaticivorans DSM 12444
  CDS (1)..(2055)
atgggaaggctgtttgcctggggcatcggattcgcgctgcttggcgccatagcgctgatagtggccgtcgcggtcaccgcgcgctcgctgcccggctaccaggagctgaagtccagccagaccgggcagatggtggtcgtgcgggccgccgacggttccgaaatcgtgacgctcggccccagctacggcaagtgggttccctatgagcgcatccccgaggtgatgaaggacgccatgacctcggtcgaggacaggcgcttccgcagccactggggcgtggacccgatcgggatcgtgcgatcgctgatggtgcgcgtggagagcggctactggaagcagggcggctcgaccatcacacagcagcttgcccgcaacatcttcctcaacaataccaagaccttcggccgcaaggcgcgggaatgggtgctggcgctggcgctggagcagaagttctcgaaggaccagatcctcgagctgtacctcaacaaggtctacttcggcggcggcgcctatggcatcgattcggccgcacgcaagttcttcggccattcgggcgaggagatcaccctgcccgaggccgcgatcatcgccggcctggtcaaggcaccgtcccgctattcgcccacggccgatgccgatgccgccgtcggtcgcgccggcgtggtgctgcagacgatgcaggacaacggcgtgctgaccgcgcaggaagccgccgccgtcgacctcaggaaggtcaagatggtggaggaccgcgccagccagaactcggcgcgctacttcaccgactgggcgttgccgcaactcgacctgatcctgcccgagaacgaccagccgatcgaggtttggaccacgctcgatccggtgatgcagcgcgccgcgacgagcgccattgccggcttcgcgccgaagggcgcgcaaggcgcgcttgtctcggtggaccgcgacggcgccgtcctcgcgatggtcggcgggaccgactacgtcagctcgaactacaaccgcgcggtaaacgccgtccgccagccgggttcggcgtggaagctgttcgtctacctcgccgcgctcgaggccggatatacccccgacgaccgcgtggtcgacgagccggtgacgatcgacggctggacgccgcgcaacgacggcgcgcgctatgctggcgagatcgacctgcgcaccgcatttgcctattccaagaacaccgttgcagcacaactcggcaacgaggtgggcttcggcgcggtggccaacatggcacggcgcttcggcatcaccacgccgatcaacaccttgccctcgatggtccttggatcgtcggaagttcgggtgatcgacatggtccgcgccttcgcctcggtccaggccaagggcaattcggtgaccccctatggcatccgcaaggtgacgacgaccgatggcgaagtgctctacaagcaccgcgccgatgcctcgcagcagctcgtcccgccctatgtcgcggcgggcatgaccgatctcatgcagaccgcggtgaatatcggcactggccgcgccgcgcagatcggacgacccgtcgcaggcaagaccggcaccacctcttccaacaaggacggctggttcctcggtttctccagtggcatcaccacgggcgtatggatgggccgtgacgatgccaagccggtgcccggcctccagggcggcgccgcgcccgcgcgcgcattcgctgcctacatgaaggtcgccacggccaagcgcccgtccgaaaagttcgataccgaactcaagctgccgcaatggcagctcgaacccgacgacgaggcgatgcagggcaatcccgacgattacttctatgtcgacgaacagggcaaccttgtggacccgtcacgtcgcccatcgcccggcgccaatcccgacgccgtcgatccggatgcgctgcccgaaggcgtgcccccggatgcgccccaggcggcgaccgacgatttcctcaaccgcgccacggggcggcagggagacacgccacccgcgacaggaccgcgcacccgtccgacgagcagcgcccggacggtgaccgttccctga

SEQ ID NO: 50307 - protein, 684 aa, Novosphingobium aromaticivorans DSM 12444
MGRLFAWGIGFALLGAIALIVAVAVTARSLPGYQELKSSQTGQMVVVRAADGSEIVTLGPSYGKWVPYERIPEVMKDAMTSVEDRRFRSHWGVDPIGIVRSLMVRVESGYWKQGGSTITQQLARNIFLNNTKTFGRKAREWVLALALEQKFSKDQILELYLNKVYFGGGAYGIDSAARKFFGHSGEEITLPEAAIIAGLVKAPSRYSPTADADAAVGRAGVVLQTMQDNGVLTAQEAAAVDLRKVKMVEDRASQNSARYFTDWALPQLDLILPENDQPIEVWTTLDPVMQRAATSAIAGFAPKGAQGALVSVDRDGAVLAMVGGTDYVSSNYNRAVNAVRQPGSAWKLFVYLAALEAGYTPDDRVVDEPVTIDGWTPRNDGARYAGEIDLRTAFAYSKNTVAAQLGNEVGFGAVANMARRFGITTPINTLPSMVLGSSEVRVIDMVRAFASVQAKGNSVTPYGIRKVTTTDGEVLYKHRADASQQLVPPYVAAGMTDLMQTAVNIGTGRAAQIGRPVAGKTGTTSSNKDGWFLGFSSGITTGVWMGRDDAKPVPGLQGGAAPARAFAAYMKVATAKRPSEKFDTELKLPQWQLEPDDEAMQGNPDDYFYVDEQGNLVDPSRRPSPGANPDAVDPDALPEGVPPDAPQAATDDFLNRATGRQGDTPPATGPRTRPTSSARTVTVP

SEQ ID NO: 50308 - DNA, 2475 bp, Clostridium thermocellum ATCC 27405
  CDS (1)..(2475)
atgaactcgagaacggaaactgcttcaaggagaactcaaaaaagttcaaaaaagaagcggaccaataaaactggtagaataatattgtcgatcttcagggtcatcgtcttttttgccgtcgtcttttcggttatcatcggaggtatactggcaggtatgacgttggcttatgttgcaactacagaagacctcactgccgagcagctggtgcttacagggttcaccacccgtgtgtatgactgcaacggcaacgagattatggctctacaaggggacaaaaacagggaaatggttgactttaaagatataccacaggacttaaaagacgctttcgttgcaattgaagataaacgtttttacaagcatcccggcatagatgtgaaaagaatagcaggagcggtaataaatttcttcaagcccggagcatcatcttacggcggtagtaccattacccagcaggtaataaaaaaccttaccggcaatgacgaaaggtcggtcaaaagaaagattcaggaatggaaactcgccttaagtcttgagcgcaatctcagcaaagaccagatactggaactttatttaaatctcatatatatgggacagaactgctatggagttcaggctgccgcacaaacttatttcaacaaggacgtaagcgaactcacccttgctgaatgcgcttctcttgccggaatcacgaatttgcccggcaaatatgatccttttaccgaaaaagggagagaaaacaatatcaagcgccagagaatcatattaaaagaaatgctggatcagggatatataaccgaagctgaataccagaaggccataaatgaagaactgaaattcgccgaatcaaacaagcgtacagcggaaaacgccagcaatcagccctactttatagatcaggttgtaaaagacgtaaaaagggatcttatggcacagggttattcggaagaagtggccataagaatgatttataacggtggactccaaatatataccacaatggatcctgatattcaaaaagcaatggacgaagtgtttacggatgaaaaatatttcacaaaagtaaacaaaaagacaagccagactccccaggcagccatggtaataatggaccccaacggttatgtcagagccctgtacggaggctctggggaaaaaataggcgcacctcttaacagggcatcggatccccaggtgcagaggcagccgggttcgactttcaaacctattgccatttacgggcctgccataaatgaaagaagaataaccgctgcaacaatcgtagacgacgttcccgtgtatatgctgggagtggacaaaggtgcatatcccaacaattttgactactcatacgccggacttaccaccatccgcaacgccataaaaaggtccgtaaacgtagtggccgccaaagtatggcaggatattttaggccctgatttgtctttagaatatcttgacaaagttaatttaaacagggacaatgaaagatacctgtcgctggctctgggtggacttaaccaaggtgtaaacccccttcaaatggcagcggcatatgtgcctttcgtcagcaaaggtatatattatgaaccgatgacctatacaaaagttttggatatgaaaggcaatgtcattctggaaaagaagccaaaaagcaccatcgtctatgacgagactgccgcatatgttatggttgacatgctgaaaagcgtggtaagtgaatcaggtggaactgccgtcggacttggtcagctgcaaaacgggaaaatgcccacagcgggtaagaccggtaccaccagccagaactttgacaaatggttcgtaggcttttctccttattacgttggagctgtctggtacggttatgactacaatgtcagcatctcaagcgctgaatcaaacagggcgctgcaaatatggcatgatgttatggaaaaagtacacgagaaattggagccgattccgtttgctgaacccgaaggcattgtcagaaagagaatatgcatctactccgggaaaattgcgacagatttgtgtgccagtgatccaaggggttccgcagtcagaactgaactgtttatcaaaggtacggagccttccgatgataatttatgcgacgtccacgtcaaagcacgggtttgcaaggacagtaccgacgccaacggcaaatctctgcttgccggtgaatactgtcctgaaagttcagtggaagaaaaggtgtttataaggcgtccggttccttatgtgccggtcaagcccggcgaaaaagcacctgctgatttgatatatgaacttccggaaggagagtactgcaatgtccacggtcccgcagaagtgccggatttggaggatattgtcgacgacattccggatatccccaatgagaattcttccaaccgaaatccatggatcgactttttcgatgaacttgaccagacattcccgcgaatattcaggcgggatgacagataa

SEQ ID NO: 50309 - protein, 824 aa, Clostridium thermocellum ATCC 27405
MNSRTETASRRTQKSSKKKRTNKTGRIILSIFRVIVFFAVVFSVIIGGILAGMTLAYVATTEDLTAEQLVLTGFTTRVYDCNGNEIMALQGDKNREMVDFKDIPQDLKDAFVAIEDKRFYKHPGIDVKRIAGAVINFFKPGASSYGGSTITQQVIKNLTGNDERSVKRKIQEWKLALSLERNLSKDQILELYLNLIYMGQNCYGVQAAAQTYFNKDVSELTLAECASLAGITNLPGKYDPFTEKGRENNIKRQRIILKEMLDQGYITEAEYQKAINEELKFAESNKRTAENASNQPYFIDQVVKDVKRDLMAQGYSEEVAIRMIYNGGLQIYTTMDPDIQKAMDEVFTDEKYFTKVNKKTSQTPQAAMVIMDPNGYVRALYGGSGEKIGAPLNRASDPQVQRQPGSTFKPIAIYGPAINERRITAATIVDDVPVYMLGVDKGAYPNNFDYSYAGLTTIRNAIKRSVNVVAAKVWQDILGPDLSLEYLDKVNLNRDNERYLSLALGGLNQGVNPLQMAAAYVPFVSKGIYYEPMTYTKVLDMKGNVILEKKPKSTIVYDETAAYVMVDMLKSVVSESGGTAVGLGQLQNGKMPTAGKTGTTSQNFDKWFVGFSPYYVGAVWYGYDYNVSISSAESNRALQIWHDVMEKVHEKLEPIPFAEPEGIVRKRICIYSGKIATDLCASDPRGSAVRTELFIKGTEPSDDNLCDVHVKARVCKDSTDANGKSLLAGEYCPESSVEEKVFIRRPVPYVPVKPGEKAPADLIYELPEGEYCNVHGPAEVPDLEDIVDDIPDIPNENSSNRNPWIDFFDELDQTFPRIFRRDDR

SEQ ID NO: 50310 - DNA, 2238 bp, Microbulbifer degradans 2-40
  CDS (1)..(2238)
atgggtttctctataccttttagtatttacttggtttatctcgatcgcattgtggtgcaacaatttgagggcaagcgctttgctttgcctgccaaggtgtatgctcggccgttagagttgtatgtggggcaaaaaataaatgccgatgtgctgcaggcagaattaaaagagttaggctacaaaccggtagaaaatgtagttttagcggggcagtttagccgcacgcgcgatcagtttgatatatacatacgcccttttaccttttgggatggcgagcagcaagcaagtcatatacagctcacccttaataatgggcaagtgcgcagtttaaaaaataaaagcgagctagcaccgcttaaccttgtgcgtttagacccaataaccatcggcggtatttaccccaatcacggtgaagatagagaacttgtacgcctgcaccaagtgccacaagtgcttattgatgcgctaatagccgtggaagacagacgctattatcagcatcacggggtggaccccaaagccatattgcgcgctgcaaccacgttaattaccagtgagcgcgtgcagggcggcagcaccattacccagcagctaatcaaaaactttttcttaacacgcgagcgcaccatagagcgcaaagtaaaagaaatgcttatggcaatcttgctagagctgcattttagtaaagacgatattttagaaacctatctcaacgaagtgtactttgggcaagatcgcaaccgcgctattcacggctttggtttggcgagccagttttatttctcgcgccctattgaacatttagaacctcatcaagcagcgctgttggtgggaatgctaaaagggccagcctattacaacccgcgccagcaccctaagcgcgcaactgagcgccgcaacttggtgttaaatgcgctggccgatcaaaattacattagcgatagcacctacaggcaacaagttttgcagcccttagtcataagtgaattgccgggcttggggcaatcgcgtcaccccgcatttatgcaattggtggtgcgtcagttaaaacgcgattaccgcgaaaccgatttgcaatctgaaggcttgcgcattttcactacgctcgacccttacgagcaaaaagtcgccgagcaacaattaacgaagaatttgcagcagctagaaaaagcgcgcagcttgccgcatagccatttgcagggcgcggtgataatagccaacgtgcacgacggcgaagtaaaagccgttgtgggcggtcgcgatagtcattaccaaggttttaatcgcgcgttagatgcgtcccgtcaaattggctcgcttataaagcccgccatttatttaaccgcactggcagatattgaacactacaacttggcaacgccattagatgacagccccttcgagtggagtgagccgggcatagaaccttggcgcccgcaaaactacgatcacgagtttcacggtacggtgccgctctggttggcactggctaaatcgtacaatgtgtcggcggcgcgtttgggtacgcaaataggtgtagataacgttatgcgcaccgtggccaaccttggggtagaaaagtcactgcctacctatgcttctagtttgctgggtaccgtgcaccttacgccttacgaaataacacagatgtaccacaccatagcgagtgggggctttaaaactccgtttcgcgcaattcgcgaggtaaccacagtaaatggtgcgccgcttaatcgttacaaccttagcgtagagcaagtggtaacccccaccgccaaccacttaattgtggcaggtttacagcaggtggttgcgcgcggtaccggcaccggcgtgctgaattatattgctgatgatatacacgcagccggcaaaaccggtacaacggatgacttgcgcgatagttggtttgcgggttttaccggtaatcgcgtagcggtggtgtgggttggtaacgataaaaacgagccgataaaacttaccggtgccagcggcgcactaagaatttggggcgacattatgaaaaatttgtcgctcgaaccccttaacgctgcggcaccagaaaatgtagactacgtgcccatcagtcatcgcgacgggtttgttgcgcgcgataactgcaataatacttttactttgccttttcacactaaatcgctgcccgatgccgactactgcggtgctaaaactgggcgcaaggtaaagtcttggtttaacaaattatttggaaaagattaa

SEQ ID NO: 50311 - protein, 745 aa, Microbulbifer degradans 2-40
MGFSIPFSIYLVYLDRIVVQQFEGKRFALPAKVYARPLELYVGQKINADVLQAELKELGYKPVENVVLAGQFSRTRDQFDIYIRPFTFWDGEQQASHIQLTLNNGQVRSLKNKSELAPLNLVRLDPITIGGIYPNHGEDRELVRLHQVPQVLIDALIAVEDRRYYQHHGVDPKAILRAATTLITSERVQGGSTITQQLIKNFFLTRERTIERKVKEMLMAILLELHFSKDDILETYLNEVYFGQDRNRAIHGFGLASQFYFSRPIEHLEPHQAALLVGMLKGPAYYNPRQHPKRATERRNLVLNALADQNYISDSTYRQQVLQPLVISELPGLGQSRHPAFMQLVVRQLKRDYRETDLQSEGLRIFTTLDPYEQKVAEQQLTKNLQQLEKARSLPHSHLQGAVIIANVHDGEVKAVVGGRDSHYQGFNRALDASRQIGSLIKPAIYLTALADIEHYNLATPLDDSPFEWSEPGIEPWRPQNYDHEFHGTVPLWLALAKSYNVSAARLGTQIGVDNVMRTVANLGVEKSLPTYASSLLGTVHLTPYEITQMYHTIASGGFKTPFRAIREVTTVNGAPLNRYNLSVEQVVTPTANHLIVAGLQQVVARGTGTGVLNYIADDIHAAGKTGTTDDLRDSWFAGFTGNRVAVVWVGNDKNEPIKLTGASGALRIWGDIMKNLSLEPLNAAAPENVDYVPISHRDGFVARDNCNNTFTLPFHTKSLPDADYCGAKTGRKVKSWFNKLFGKD

SEQ ID NO: 50312 - DNA, 1986 bp, Oenococcus oeni PSU-1
  CDS (1)..(1986)
atggtcttttttgttggatcattttatctgattgttcaggctcaaatggctgatgtggacaaattgtctcagcagttggccaagccaacaactatttatgacaaaagtggaaaaaaagccggtgaattagctgaccaaaaaggaactcaggtcagtttgaaagaaatttctccaaatttgaggaaggccgttctttcgactgaagatcgtaatttttatcatgaatttggtttttcttttagcggatatgcccgggctttgtggttatttgttcgtaacaaaataaccggtcggaattatatttccggtggtggatcaacgataacccaacagctagccaaaaatgcttatcttggtcaggaacagacttttacgcgaaagtttaaggaactttatttatcgattgaaatcgaaaaaaattattctaaaaataaaattctttcaatgtatcttaattcatcatattttggccataatatttatggtgtcgaagatgctgccgagggatattttggtgtttcggccgctaacctttctgtttctcaggcagcttcgattgccggaatgctggctaatccaactctttacgatccaacaaagtatttgaagtatgcaacctcgagacgaaatacagtcttgcagaacatggtttcaaacgataagcttagtcaaaaaaaagccaccgctatcgagaaaacgaaagtagtcgcgaagacacccaatgtaagtcaaaaaacaaattatcaatatccttggttttttgatgccgtaatcgatgaggcaatcagcaagtatcatttgaccgaaacagaaattatgaaccgtggctataaaatctacaccacacttgatcaggaagaccaaaaagatttgcaggaagattacagcaataaatatctttttccagtcgaagatgaccaatccgcttcaattgctttaaacgccagaaccggtggcatattggctgtaatcggcggccgtgggaaacatgttttccgaggcttcaatcgagcaattcaggctagacgttctcctggttctttaatcaagcctctggtcgtttatgcacctgctttaagccgaggatatagtagtacaagtacttttccgaatacgccgataactttttccggaaactatcgtccaacaaatgctttgggatatgaatcaggcaaagttgatatggcgaccgctattgcggattcgtataatattccggctgtctatttgttggataagattggtgttaagacaggctacgattatgcaaaaaaatttggtctcccagtagaaaaatccgatgaaaatcttgcattggcacttggtgggatgaaagaaggcgtttcaccccaggaaatggcacaggcttatacagcttttgcaaataatgggaagatgtcggctgcccattacattacgaaaattgttgatgcgactggtagcgtgattgtcaatcgtcccgacgttacacaaaaacaagttatttcaaaaaaagtcgcaaatgaaatgactactatgatgttcggcgtttataaagacggaacgggagccgcggcagcaccaagcggttacaaagttgccggcaaaaccggaacaacacaagatgtcgataatacaagtatccagtatgcctcaaaagatttatgggcaattgcttatacacctgatctggtagttgcttcctggcagggttatgatgtttcaacgactggtaaaacattgccaacctatctgagcgaatcgttaggcccgttatttaaggttcaaaccgaacaattaatttccaattctccacagacagccttcggcagtcaatcaagtacaaaagaaagtagttcaagttggcttgataaattgaaaaatttatttaataactctgggaaaacaggcaaaaatatcagcaaccaattcgccgggatcaaagataagatttctgatgcttggaatagcttgtctaatttcattcaggaacatttaaaacagtaa

SEQ ID NO: 50313 - protein, 661 aa, Oenococcus oeni PSU-1
MVFFVGSFYLIVQAQMADVDKLSQQLAKPTTIYDKSGKKAGELADQKGTQVSLKEISPNLRKAVLSTEDRNFYHEFGFSFSGYARALWLFVRNKITGRNYISGGGSTITQQLAKNAYLGQEQTFTRKFKELYLSIEIEKNYSKNKILSMYLNSSYFGHNIYGVEDAAEGYFGVSAANLSVSQAASIAGMLANPTLYDPTKYLKYATSRRNTVLQNMVSNDKLSQKKATAIEKTKVVAKTPNVSQKTNYQYPWFFDAVIDEAISKYHLTETEIMNRGYKIYTTLDQEDQKDLQEDYSNKYLFPVEDDQSASIALNARTGGILAVIGGRGKHVFRGFNRAIQARRSPGSLIKPLVVYAPALSRGYSSTSTFPNTPITFSGNYRPTNALGYESGKVDMATAIADSYNIPAVYLLDKIGVKTGYDYAKKFGLPVEKSDENLALALGGMKEGVSPQEMAQAYTAFANNGKMSAAHYITKIVDATGSVIVNRPDVTQKQVISKKVANEMTTMMFGVYKDGTGAAAAPSGYKVAGKTGTTQDVDNTSIQYASKDLWAIAYTPDLVVASWQGYDVSTTGKTLPTYLSESLGPLFKVQTEQLISNSPQTAFGSQSSTKESSSSWLDKLKNLFNNSGKTGKNISNQFAGIKDKISDAWNSLSNFIQEHLKQ

SEQ ID NO: 50314 - DNA, 2640 bp, Oenococcus oeni PSU-1
  CDS (1)..(2640)
atgtctgacaattcttacaatccaaataatttcggaagtaattacgacggccaaaatcatagcagcgattctgctaataaagccaactcgaattttgattcagccccatcgaattacaaagatccgaataatatgtttcccgagacaaatggacggcttcctatccattttggtcggaataaaaataaaaataaaaacataaacaaaaattttgatggaaatcagagttcgtacggacaaaaccaggattttaatcaaagtaacgatttcaaccaaaatagtgatttcaatacgcaaaatttctcgtatgagaattatgatagctacaataacgatgcaaacaaagctcctaatgaaaagcgaagggattcatccaataatttgaaaaaaagtcgaagaaaatcaaataatggttcaaatcgacctaaaaataaaaaaaagagcaaattaaggcttttcggtaaaattattgcttggtttacaacaatttttgccttggtcctgttggctggaatggcagttttttttacctacgcggctagtgcaccgaaaattaccgaatcggaattggcttctgaaaattcgacacaaatttatgattcacaagggaatttgatttactcagtttcccaacagcaacgagattatgcagaccagtcggaaatacccaaaagtatgatgcatgcggtcgttgcaatcgaagatcgtcgtttttataaacatcatggtgttgatgtttatcgaactctcggagcacttgtttcggatatcaaaggaaaaataaccggcagtaccgcagggcttcaaggggggtcgactttaacccagcaattggttaaattatccgtattttcaaccaagacatcggatcaaacgctaaaagtaaaagctcaagaagcctggttggctctaaaagtcgagagaaatttcagtaaaaaccaaattctcactttttatatcaacaaagttaatatgggaaacggcatttatggaatggaaacagccgccaaatattatttcggaaagactttaaaacaattagacgtttctcaaactgccattttggcaggaattccccaatccccggtttattacgatccgtatgtctatccgaaaaatctaaaaattcgtcgcgatcaggtactggctggcgaagttaaaatgggctatattactcaagctcaagccaacaaggcgaaagccgagtcagtcacaaaaggacttatttcaaaaagcaaacacactgcgaattctgtaagtacaaaccttactgtgaatgcttatgttcagtctgccctaaaagaagtcaagaaacttggatataatcccaacaaggacggtttgaaaatatatacagccatgaatatgaagatgcaaaagcgtctttataaagttctaaacggcggaacgggagtgccatggcaaaatggtattcaagcggcggcaacagtcgctaatccaaaaaacggacgaatactagcccaagtcggcggtcggaatgttacgacaatgtttggtcttaatcgagcagtacaaaccaatcgatcctcgggatcgacggcaaaacctttggttgattatggaccagcgatcgaatatctaaactggccaacttatcgaacggtacaggatactgcatataaatatccgggaacaaataccagtgttcatgatttcgatgacgaatatgaaggaaacatgactatgcgtaaagcaatcgtggtttccagaaacattccggcggttaaaaccctgatggatgtgggaacaacgagatcctccgaattcttaaataaactcggcatagcgatcaaagcaagccaattaaccgcttcttcagcaattggtattaatgtttccacagaacaagaagcgacagcattctctgctttcgctaatggtggtacttattacaaacccgagtatgtcgaaaaaatcgtcacctcggatggtgtaactcatagttataagccaagcgggacacgagctatgaaaaaatcaaccgcctttatgatgacaaacatgctcgaaggcgttcctcaatcaaatggatctgctcccggagcaaaaatatccggcctctatcaagcggtaaagcccggaatcgttggttatgcctcgtcagtcggacagcctgatggagcagaatcggatgtttggcttacaggctatacaaagtacttggctgcctctttctgggctggctacgacgaaccgaataaaaccggaaactacattccttattcgtcagagtcttccatgcctgagcgtgcctaccgcgatttcatgataagtgccattcaaggatatgaaaacaccaactggaccgcgccaagtacggttgaaaaagttgttaaaaatggagttaccgaatacgaagtcaaaggagcaaaatggagcaacggcggtctgccaagcgtttactcgtcgtcttcctccagtacacagacggttgttgttgatccgcctgcttccgcttcgactgccagcacatcaagttcgtcaagcagcgttgttgttcaaagcagcagctcgtcatcaagttctgcggctgcaagttccagttctagcaatgatacacagacatcatcgtcagccaatactgaatcgtcagccaatactgattcgaatagtccataa

SEQ ID NO: 50315 - protein, 879 aa, Oenococcus oeni PSU-1
MSDNSYNPNNFGSNYDGQNHSSDSANKANSNFDSAPSNYKDPNNMFPETNGRLPIHFGRNKNKNKNINKNFDGNQSSYGQNQDFNQSNDFNQNSDFNTQNFSYENYDSYNNDANKAPNEKRRDSSNNLKKSRRKSNNGSNRPKNKKKSKLRLFGKIIAWFTTIFALVLLAGMAVFFTYAASAPKITESELASENSTQIYDSQGNLIYSVSQQQRDYADQSEIPKSMMHAVVAIEDRRFYKHHGVDVYRTLGALVSDIKGKITGSTAGLQGGSTLTQQLVKLSVFSTKTSDQTLKVKAQEAWLALKVERNFSKNQILTFYINKVNMGNGIYGMETAAKYYFGKTLKQLDVSQTAILAGIPQSPVYYDPYVYPKNLKIRRDQVLAGEVKMGYITQAQANKAKAESVTKGLISKSKHTANSVSTNLTVNAYVQSALKEVKKLGYNPNKDGLKIYTAMNMKMQKRLYKVLNGGTGVPWQNGIQAAATVANPKNGRILAQVGGRNVTTMFGLNRAVQTNRSSGSTAKPLVDYGPAIEYLNWPTYRTVQDTAYKYPGTNTSVHDFDDEYEGNMTMRKAIVVSRNIPAVKTLMDVGTTRSSEFLNKLGIAIKASQLTASSAIGINVSTEQEATAFSAFANGGTYYKPEYVEKIVTSDGVTHSYKPSGTRAMKKSTAFMMTNMLEGVPQSNGSAPGAKISGLYQAVKPGIVGYASSVGQPDGAESDVWLTGYTKYLAASFWAGYDEPNKTGNYIPYSSESSMPERAYRDFMISAIQGYENTNWTAPSTVEKVVKNGVTEYEVKGAKWSNGGLPSVYSSSSSSTQTVVVDPPASASTASTSSSSSSVVVQSSSSSSSSAAASSSSSNDTQTSSSANTESSANTDSNSP

SEQ ID NO: 50316 - DNA, 2154 bp, Pediococcus pentosaceus ATCC 25745
  CDS (1)..(2154)
atgaatatgaaaaaaatagggagtgcgattaaagcattcttacaaaagattggtgcatttttaaaacccgtgtgggataaaattcacccgttcatccataagtactggcacagatatcagcttacgcgatggattattgtagtagttttagcagttgtatttttctcaagtgcgattttaacttatcaagcgaagactgctaatgtaaaaaatttaaaagcagctttatcccagcctactttagtttatgataaaaataatgctaaagctggaagtttatattctcaaaaaggaacctggacaaatctagataatatctcacctaacgttcaaaatgccgtaattgcgacggaagaccgaaacttttataaggaatatggtttttcaattaagggaatcggtagagcgtttgtgatgtacggggtcaataaattacttggtcgagattatatatctggtgggggaagtactttaacccaacaattagtaaaaaatgcctttctatcacagcaacagacctttactagaaaggctaaagagttatttttatcaattgaagttgaaaatgtttattcaaaaaaagatatcttagcaatgtacttgaataacgcctattttggaaatggggtttggggagtacaggatgctgctgagaggtatttcggggtcagtgcttcggaactatcggttccccaagcggcaaccttggcagggatgctgactaatccgagtggctataatccgatcgatcatccaaaaaatgccttttcacgccgtaatgtagttttaagtttgatggcggaaaccggtaagatatccaaggccgacgccaaatcctatgctcaaacagctatctcaaccagtgataattacaatagtgaggacggttataagtatccatactactttgatgcagtaatcgatgaagccattagcgagtatggattgacggagtcggatattatgaatcgcgggtataaaatttatacgtatctggatcaggatagtcagcaaggtatgcaagatacttttgacaactccgctaattttccggttgatgctacagatggtactaaagtacaggctgcatctgttgcagtaaatgccaaaaatggtggtgtagaagcggtagttggtggtcgtggtaatcatgtctttagaggctataaccgagctacccagattaaacgccaacctggctcaaccttaaaacctattgcagtttacgccccagctttagcgagtggatatagttatagttctatgttagaagataaacttcaaacatatggaactaataaatataaacctgaaaattacaataacgaatatgcaggaaagattgcgatgtaccaagcacttgaacaaagtaaaaatgcgcctgcggtatggttattaaataaaattggtgtagataagggttacgattacaccaagaaattcggcttaaacccaagcaaagatgataagaacctagcgatggctcttggtggattgacgaatggtgtatcgccaattcaactagcttctgcttatactgcatttgctaataatggaacgttgtcgaagactggatttattcgcaaaattgtagatgcttctggaaatacgatcgtaaataacaccacggaatccaaacgagttatttcaaaaaaggtcgctaaagaaatgaccagtatgatgttaggtgtttatggtgacagttctggcacaggttatggggcagaaccttttggttatacaattgctggtaaaacaggtagtactgaagcagatacaggaactagtccatcagatgcaacccgtgacaaatggatggtaggatatacaaaggatgttgtagttgctacttgggaagggtttgatgacacaaacaagacccatcatctggaaaatattacgggagtcggcatgaatagtatgttcaagagtgaaatgagtgccattttaccaaatacgaaaggtacttcatttgacgttaaatcagcttctactctagctaatagtggaaacaatgttacatcaaacgtttgggacaatattgaagacggaacttcttccatcacagatagtatttctcgaggagctagtggggtcaaagagaaagcgggagaattcttcaacgaagctaaaaagttcattaccgggaattga

SEQ ID NO: 50317 - protein, 717 aa, Pediococcus pentosaceus ATCC 25745
MNMKKIGSAIKAFLQKIGAFLKPVWDKIHPFIHKYWHRYQLTRWIIVVVLAVVFFSSAILTYQAKTANVKNLKAALSQPTLVYDKNNAKAGSLYSQKGTWTNLDNISPNVQNAVIATEDRNFYKEYGFSIKGIGRAFVMYGVNKLLGRDYISGGGSTLTQQLVKNAFLSQQQTFTRKAKELFLSIEVENVYSKKDILAMYLNNAYFGNGVWGVQDAAERYFGVSASELSVPQAATLAGMLTNPSGYNPIDHPKNAFSRRNVVLSLMAETGKISKADAKSYAQTAISTSDNYNSEDGYKYPYYFDAVIDEAISEYGLTESDIMNRGYKIYTYLDQDSQQGMQDTFDNSANFPVDATDGTKVQAASVAVNAKNGGVEAVVGGRGNHVFRGYNRATQIKRQPGSTLKPIAVYAPALASGYSYSSMLEDKLQTYGTNKYKPENYNNEYAGKIAMYQALEQSKNAPAVWLLNKIGVDKGYDYTKKFGLNPSKDDKNLAMALGGLTNGVSPIQLASAYTAFANNGTLSKTGFIRKIVDASGNTIVNNTTESKRVISKKVAKEMTSMMLGVYGDSSGTGYGAEPFGYTIAGKTGSTEADTGTSPSDATRDKWMVGYTKDVVVATWEGFDDTNKTHHLENITGVGMNSMFKSEMSAILPNTKGTSFDVKSASTLANSGNNVTSNVWDNIEDGTSSITDSISRGASGVKEKAGEFFNEAKKFITGN

SEQ ID NO: 50318 - DNA, 2310 bp, Pediococcus pentosaceus ATCC 25745
  CDS (1)..(2310)
atgaacaacggaaatcagtaccaaaatcgacccatgcgacgaacgcaacattcgaaaatgggtaaacaccctaaacccaaccgacattcttccttaattaagaagttattgttggcagcagtagcagtttttgtagcgatgattattttcggtggtgggctctttatgtactatgctcaaagcgctcctaaaatcacggaagctaaattatcgagtgataacgccactgtaatttacgataaagacggtaaagtattaactcgtctgggatcacaaaatcgtgaatatgttaaaaaagacaagattccaaagactttaaagaacgcgattgtttcgattgaagatcgtcgcttctacaagaataacggtgtggatcccattcgtattgtaggagcaacagttgctaaccttacaggatcttctttaggtctacaaggcgctagtaccttaactcagcaattggttaaattatctgtattctctacggacgcatcagatcgaactttaagagttaaggctcaagaagcttggttagctttgaaggttgataagaaatatagtaaagatcagattcttgaattctatattaataaggtttacatgggtaatggtatttacggtatgcaaacagcggctaagtattactttggtaagtcgcttgaaaaattagatttagctcaattggctttattagccggtatgccacaatcccctactaattacgatccaattagtaaccctaagtatgctaagtcccgtcgagacacggttcttcaagccatggcttctaataaagtagttactcaagctcaagcaacagaagcgcaaaaagaaagtatctctgatggactttcagagacccatgaaacttcaactaactcagctaagaaaaacaagattattgatccttatatcaaacaagtgttacaagacctttctgataaaggatttgatactgctaagggtggtttgaaagtttatactaacatggactatgcggctcaaaagaaactttacgatttagcaaataatgaccaaacggtacaatttaacgatgatgagcttcaaattggtgccacgttagtcaatagtaaaaatggaaaaatcgccgcgatgattggtggacgtaaaactggtgatgttacttatggtttaaaccgagctgttcaaactgaccgtagctctggttcaaccgctaaaccactaatggattacggtcccgcatttgaatatctgaagtggtcgacgtatcgaaaagttaaagatactccatttacttatcctggaacagacacaaaactttatgactttgatcataagtttaagggaacaatgacagtacgagatgcgttaattcaatctcgaaacgttcctgcgattcgaaccttacaagatgtcggcatttccaaggcaacaactttccttgaaggtttaggaattacaagtaaggaaccctataaccttaataatggaattgggttgtacatttctacacttcaaacagccgctgcctatgctgcctttgctaatgatggtatctatcacaagccaacttatattaataaaattgatactaatagcggtaaaacctatacctacaagtctaaaggtgttcgtgcaatgagtaaggctacagctttcttgatgacatcgattctaaaaggagtcacaactgactcgcaaggttctggtactgcagctaatattactggcatgaatatggcttctaaaactggtaccgtagcctattcgaagaaagctaccgaagcaaatgacattccaagttcagcatctagtgattcttggatggctggttataccaaggattattcgttagctgtttggactggttatgatcatccaaatacttcgactggttacctaactcaatcacaaactgagttagctcagtattattggaagtatatgatttattacctatctcaatactcttccaacgaagactggaccatgccttcaacagttggtaaaaaaggtactaaccagtattatcaaattggtgaagattatgatgagactggcaagagtgatgaatactctaagaacaacagtagcagtagctggtcaagttattctagcaagcattcaaactcttcttatagtagtcgttatagtagttctgatgctgacgacgatgatagtagcagcaacgatacttcttctgaagatagctccagcacaccatcctatagctctgacgtaagcagtaatgatacgacaagtgatagcacttctactaccacttctgcttcaacaacttctactagctctgctagtgattctgaataa

SEQ ID NO: 50319 - protein, 769 aa, Pediococcus pentosaceus ATCC 25745
MNNGNQYQNRPMRRTQHSKMGKHPKPNRHSSLIKKLLLAAVAVFVAMIIFGGGLFMYYAQSAPKITEAKLSSDNATVIYDKDGKVLTRLGSQNREYVKKDKIPKTLKNAIVSIEDRRFYKNNGVDPIRIVGATVANLTGSSLGLQGASTLTQQLVKLSVFSTDASDRTLRVKAQEAWLALKVDKKYSKDQILEFYINKVYMGNGIYGMQTAAKYYFGKSLEKLDLAQLALLAGMPQSPTNYDPISNPKYAKSRRDTVLQAMASNKVVTQAQATEAQKESISDGLSETHETSTNSAKKNKIIDPYIKQVLQDLSDKGFDTAKGGLKVYTNMDYAAQKKLYDLANNDQTVQFNDDELQIGATLVNSKNGKIAAMIGGRKTGDVTYGLNRAVQTDRSSGSTAKPLMDYGPAFEYLKWSTYRKVKDTPFTYPGTDTKLYDFDHKFKGTMTVRDALIQSRNVPAIRTLQDVGISKATTFLEGLGITSKEPYNLNNGIGLYISTLQTAAAYAAFANDGIYHKPTYINKIDTNSGKTYTYKSKGVRAMSKATAFLMTSILKGVTTDSQGSGTAANITGMNMASKTGTVAYSKKATEANDIPSSASSDSWMAGYTKDYSLAVWTGYDHPNTSTGYLTQSQTELAQYYWKYMIYYLSQYSSNEDWTMPSTVGKKGTNQYYQIGEDYDETGKSDEYSKNNSSSSWSSYSSKHSNSSYSSRYSSSDADDDDSSSNDTSSEDSSSTPSYSSDVSSNDTTSDSTSTTTSASTTSTSSASDSE

SEQ ID NO: 50320 - DNA, 2067 bp, Trichodesmium erythraeum IMS101
  CDS (1)..(2067)
atgttgagtcaaaaatttcaagagcccttacaagcaccaaaatttgatggcagaaaaagccagaaaaaaaaagttaatcctgtagaaaaaaagacaggtaaaaaggttatagacgtaaatataaaaggaattttattgagttggaagctatggttagggttaggtttgattggaattagtagtattatgatttacggtgggtggatgtggcgaaaattagagcaaagcttaccagaagttgccgatatttcctcctatagaagagatggtactttaacgatcaaagctacagatggtaaaattatacaacaaaccggacctgccactcgagaaaaaattaaattacaagatattcctactcctttagttcaagcttttattgctgttgaagacagacgtttctatgaacatagaggagttgattatccaggagttattcgagcatttatattgaatataattgctagagatatagttcaagggggtagcactattacccaacagttagcacggatggttttccttgatatggaacaaagtatttggcgtaaacttcgggaagcaatgctagcttggaaaatagaaaatgagctatctaaagaagaaattctagaattatatctaaatatagtttatctggggtcaggtacttatggagtcgctgatgcagcctgggtttactttagccaaccagttttcggactaactttagcacaaatggcaactttggcaggtttgcctcctgcacccagtcaatattcacctttggttaacgaagaagctgctaaacgtcggcgaaatctagtattaaaagaaatgcaagcagcaggtttgatttctgatgagcgaacaaaaagagcgatcgctcaaccaatgaaaataaaacctagtgcgccaaaacgtctcatagttgaagctccatattttgctaactatattcagaaagagttaccgaaatatgtttcctcagaagttataatggcaggaggtttaactgtagaaactactctggataggcgttggcaagaaataggggaaaaagtaattcaagaagctgttgatattgatggttatcgtcaaaggtttgaccaagcagcattagtcgctattgatgctaatactggagaggttaaggcgttagtaggaggtcgagattttgctaagagtgaatttaaccgagctattcaagcgcaacgtcaaccaggttcaacttttaaaagttttgtctatgctgctgcggttgctgctggtattcctccgactaatggttatcgagatttaccgtttacagtagatggttataaacccaaaaattatggtaaaaagtatggtggttggcgatcaatgattgattctttggcatattctgtaaatgtggtggcagtgcaggtgttgatagatgtagggtttgaacctgtgattaatttagctaaggatatggggattaaatctgaggttaaggctacttattctatggcgttgggtagttgggaggttaatttattagagctgacaaatgcttatgcgacttttgctgcacagggtaagtatattccagctcatggaatcaaaaaagtaattaatcaaaacggtaaggttatctatgagagtaattttaaaccaaagcaggtgttagataaggatagtgcggcaattgttacctggatgttggagaatgtggtgaaatatggtagcggagcgaatgcttatttgtctgatcgccctgttgcaggtaaaactggtacgactgaagaggcccgagatttgtggtttattggttatattccccaagtggcaactggaatttggtttggtaatgatgataataaacctacttggggtgtgagtagtacagcagcttataattggcaacagtttatgaggaaagtagctaaagatatacctgtgaaaaattttccgaaaaagcccagtttttacgatcgcaaacctactattgaatctaaaccagtgacaccaagatggactaggtatgggaatgttgggcctgatggtagggagttagaaaaaagaaattattatagagattattatgatgggagttattag

SEQ ID NO: 50321 - protein, 688 aa, Trichodesmium erythraeum IMS101
MLSQKFQEPLQAPKFDGRKSQKKKVNPVEKKTGKKVIDVNIKGILLSWKLWLGLGLIGISSIMIYGGWMWRKLEQSLPEVADISSYRRDGTLTIKATDGKIIQQTGPATREKIKLQDIPTPLVQAFIAVEDRRFYEHRGVDYPGVIRAFILNIIARDIVQGGSTITQQLARMVFLDMEQSIWRKLREAMLAWKIENELSKEEILELYLNIVYLGSGTYGVADAAWVYFSQPVFGLTLAQMATLAGLPPAPSQYSPLVNEEAAKRRRNLVLKEMQAAGLISDERTKRAIAQPMKIKPSAPKRLIVEAPYFANYIQKELPKYVSSEVIMAGGLTVETTLDRRWQEIGEKVIQEAVDIDGYRQRFDQAALVAIDANTGEVKALVGGRDFAKSEFNRAIQAQRQPGSTFKSFVYAAAVAAGIPPTNGYRDLPFTVDGYKPKNYGKKYGGWRSMIDSLAYSVNVVAVQVLIDVGFEPVINLAKDMGIKSEVKATYSMALGSWEVNLLELTNAYATFAAQGKYIPAHGIKKVINQNGKVIYESNFKPKQVLDKDSAAIVTWMLENVVKYGSGANAYLSDRPVAGKTGTTEEARDLWFIGYIPQVATGIWFGNDDNKPTWGVSSTAAYNWQQFMRKVAKDIPVKNFPKKPSFYDRKPTIESKPVTPRWTRYGNVGPDGRELEKRNYYRDYYDGSY

SEQ ID NO: 50322 - DNA, 2289 bp, Trichodesmium erythraeum IMS101
  CDS (1)..(2289)
atgaattattctcagcctcttcgtaattctcaaactattttgggtaatattacccagatgataaaaactattcatgctagtgtcaacttttctagactagcaattagacctaatgctagagtacctgaactatggatagaggaaggaaaagctactccaactaaaaaatatcctcttttgggtgatcgttatttgctcggacgctcctcccaagcttgtgacattgttattcgtaatcacctaattagtaagattcatttatctatctcacgaaactcaaataaggctgacgccccttatataataaaagatgaaaactctcgtaatggtctctacaatggcaaaaaaaagatttatagtctgattttacgtcatggtgatatattaactctaggaccacctgcattagctgatactgttaaagttcggtatatttatcctcctgcgtggtatactcaagcctttcgttatagtttacttggtatttctggattcactgctttagtgagtttaattattctacttgaatggacaaaatttcaggtataccctctacctaatccaattacaggcccagtagttatctatgctcgtgatggacaaacacctctacgtccagtttatacaaactcccattatgaattggggcggatatctaaattttctaaatatttaccagacgcagtcattgcttctgaggatagtcgcttttattggcatatcggtatagaccctattggagttgtcagggcaatattgacaaatttacgttcagatggtagacgcgaaggaggtagtacagttactcagcagctagcaagaagtatatttcgagattatgtaggcaccgaagactctgccagcaggaaaatacgagaagcgatagcggcattaaaattagaaactttttatagtaaagatgatttattattagcttatctaaataaagtctatttaggattagatttatacggatttgaagatgctgcaagattttattttggtaaaagcgctcaaaacctaactttatcagaagcagcaacattagtaggaatattaccagcacctaatatttttaatccagtacaaaattatcaaatagctatagaaaaaagagatggggttctttatcgaatgcttagtttaggtatgatagaccaacaggaagcagatagagctaggcgatcactcatagaaattaatccgaaagctatagaaattatccaaagtacaatagcaccttattattatagtcatgtctttagtgaactagaaaatttactaggagaagacctagctaaagaaggaaattttattgttcaaacggctttaaaccctgaaattcaaagctatgcagaaagaactttgcaagatacaattaatcaagttggttcttatgctagcttttctcaaggagctatagttacaatagattcaagaaatggagaagtcataactctgattggaggtgtagactacaaaaaaagtcagtttaatcgagctactcaagcacaacgtcaaccaggttctacttttaaagtctttgcttatgccgctgctatagaaaagggtataccaccaaaaaaattatattcttgtagttcctttgggtggatgggtcaaacttatgaaggttgtcaacggagtagtggtaatagaaatatgtatgatggcttggcactttctgagaatgtggtagctttgcgggtcgctcaacaggtaggtttggatagagtggtaaaaatggcaaagggtttaggaattaagtctcagttaagtgctgtacctggattgattttgggtcaaagtgaagttaatgttttggaaatgactggtgcttatggggtatttgctaatggtggagtggccaataaaccccatactattagaaagattatagatagtagtgattgtcgcgatcgcaataatatttacacttgtcgctgtatttattcatacataccagacacaaattgtgaaaaccccaaaggagatattcaagcaaaccaatctattatacaaccatatatagcaagtattatgactcaaatgctccaagatgttataaggcatggtacaggtcgtagtgctaatttgggatggggagaagcaggtaaaactggtacaactaaccaaggaatagatatatggtttattggatatattcctaacgaaagtatggttacagggatttggctaggaaatgatgataactctcctacttatggtagtagtgaacaagccgcacagttatggggaaattatatgaaaaaggttgtgaataagtaa

SEQ ID NO: 50323 - protein, 762 aa, Trichodesmium erythraeum IMS101
MNYSQPLRNSQTILGNITQMIKTIHASVNFSRLAIRPNARVPELWIEEGKATPTKKYPLLGDRYLLGRSSQACDIVIRNHLISKIHLSISRNSNKADAPYIIKDENSRNGLYNGKKKIYSLILRHGDILTLGPPALADTVKVRYIYPPAWYTQAFRYSLLGISGFTALVSLIILLEWTKFQVYPLPNPITGPVVIYARDGQTPLRPVYTNSHYELGRISKFSKYLPDAVIASEDSRFYWHIGIDPIGVVRAILTNLRSDGRREGGSTVTQQLARSIFRDYVGTEDSASRKIREAIAALKLETFYSKDDLLLAYLNKVYLGLDLYGFEDAARFYFGKSAQNLTLSEAATLVGILPAPNIFNPVQNYQIAIEKRDGVLYRMLSLGMIDQQEADRARRSLIEINPKAIEIIQSTIAPYYYSHVFSELENLLGEDLAKEGNFIVQTALNPEIQSYAERTLQDTINQVGSYASFSQGAIVTIDSRNGEVITLIGGVDYKKSQFNRATQAQRQPGSTFKVFAYAAAIEKGIPPKKLYSCSSFGWMGQTYEGCQRSSGNRNMYDGLALSENVVALRVAQQVGLDRVVKMAKGLGIKSQLSAVPGLILGQSEVNVLEMTGAYGVFANGGVANKPHTIRKIIDSSDCRDRNNIYTCRCIYSYIPDTNCENPKGDIQANQSIIQPYIASIMTQMLQDVIRHGTGRSANLGWGEAGKTGTTNQGIDIWFIGYIPNESMVTGIWLGNDDNSPTYGSSEQAAQLWGNYMKKVVNK

SEQ ID NO: 50324 - DNA, 1965 bp, Trichodesmium erythraeum IMS101
  CDS (1)..(1965)
atgaagtctatccaaggaagtgaaatcaaagtgtccaccaacactctcccaaacaagcaaactaaaaaaccattatctaaatctgcaccagtcttcgagtttgttcagtctgtcggtaaagttacaacaggtacagtattaggcattactatgctgactagctcattagttgctggtggattagtaggtttagccattagctttcgtaatctgccagatgtaaggctgctcaaaaattatacaccttcagaaacaactcgtatatatgatatcaaaggtaggcccctggcaagtctccatgatgaggccaaccgagaagtcatgcctctaaagcaaatttctccagacctcaaacgagcagttttggcaatcgaagatagtaatttctacaatcacctagggatttatcccattggaattatgcgtgctcttgtagctaacttagagcggggtaaaaccgttgaaggtggttctactgtgaccatgcaattggtaaaaaatttgtttctctccccaacagccaaacttagtaggaaagtagctgaagcagttttggcaattagaatggaacaaattatggccaaagatgaaattttagaattatacctcaaccaaatttactggggccataatttatatggagttgaaactgcagctcgaagctattttaataagtcttccgaagatttaaccttggcggaagcggccttgatggcaggtatgattcctgcgccagaggaatatagcccttttattaactacaaaaagtctaaacagcgtcaggcaacagttctagccaggatgcgagaactaaattggattaccgctcaagaggaagcagaagctctcaaacaaccattgtatgtaggtaaagttacttcttttggtaagagtaaacttccttatattaccagtgcagttattcaggaattaactgagaggttcggtaaagatgctgttctgaagggaggaatgcgcatacaaactactattgatatgaacttccaaaagatggcagagaaaactgtaagtgaatggcataaaatcttatattatcgtgggctttatcggagttgggacaaaggtcaattagcattagtagcagttgacccacgcactcattttgtcaaagcgatggttggtggggcagattttaaaacaagtcaatataatcgcgctgttcaagctttcaggcaacctggttcttcgtttaaaccttttgtttactatactgcttttgcttcgggtagatttaccccatcttcagtggttatagatgctcctgttaattatcgagatggtaccggttattattctcctcgaaattatggtggcggatattctggagcagtaagtattcgtaaggctttacaatcttctctgaacatacctgctgttaaaattggtcaggttgtagggcttaataaggtgattgaggtttgtcgaatcttgggaattaaaagtcccatggaacccgtgatttctttaccattgggttctgttgacttgacacctctagaaatggcgggtgcctatgccacttttgctaataatggctggcattctgatacgacgtttattgtccaggtgacagatactagtggaaatgtcttattggacaatactcctaaacctaaattggttctcaatcagtgggctgtagcatcacttaatagtatattggtgggagtaattgaacaaggtacggctactagggcgagaataagtcgtcaagctgctggaaaaactggtacgacttcttcagaaagggatgtttggtttgttggctatactcctcagttgtcaactgccgtttgggtaggtaacgatgattaccgaccactcaactatggagctactggtggtactactgttgcacctatctggcgtgattttatgaatcaagccatgagtggtatgcgcaaagaatattttcctccggcatataagtttgataggccctag

SEQ ID NO: 50325 - protein, 654 aa, Trichodesmium erythraeum IMS101
MKSIQGSEIKVSTNTLPNKQTKKPLSKSAPVFEFVQSVGKVTTGTVLGITMLTSSLVAGGLVGLAISFRNLPDVRLLKNYTPSETTRIYDIKGRPLASLHDEANREVMPLKQISPDLKRAVLAIEDSNFYNHLGIYPIGIMRALVANLERGKTVEGGSTVTMQLVKNLFLSPTAKLSRKVAEAVLAIRMEQIMAKDEILELYLNQIYWGHNLYGVETAARSYFNKSSEDLTLAEAALMAGMIPAPEEYSPFINYKKSKQRQATVLARMRELNWITAQEEAEALKQPLYVGKVTSFGKSKLPYITSAVIQELTERFGKDAVLKGGMRIQTTIDMNFQKMAEKTVSEWHKILYYRGLYRSWDKGQLALVAVDPRTHFVKAMVGGADFKTSQYNRAVQAFRQPGSSFKPFVYYTAFASGRFTPSSVVIDAPVNYRDGTGYYSPRNYGGGYSGAVSIRKALQSSLNIPAVKIGQVVGLNKVIEVCRILGIKSPMEPVISLPLGSVDLTPLEMAGAYATFANNGWHSDTTFIVQVTDTSGNVLLDNTPKPKLVLNQWAVASLNSILVGVIEQGTATRARISRQAAGKTGTTSSERDVWFVGYTPQLSTAVWVGNDDYRPLNYGATGGTTVAPIWRDFMNQAMSGMRKEYFPPAYKFDRP

SEQ ID NO: 50326 - DNA, 2664 bp, Moorella thermoacetica ATCC 39073
  CDS (1)..(2664)
ttgaccctgttagtcctaggtgtgattctggtaggtgccggtgccggctttgccatcggtatcatccgcactatgcctggttggcaacctgataatttcaaactggacatgaccacctttgtttacgaccgcaacaaccagctggtcggcgagcttcacggtgagcaaaaccgggtggtagtgcccctggataaaatacctgtcaatttgcaaaacgctgttatcgctactgaggacgcccgtttctaccagcatcatggtatcgatttgaaagcaattctccgggcagccattatcaacctgcgccacgggagcatccaggagggtgccagcaccctgacccagcaactggctagaaatgctttcattgaaaatccgcagcggaccttcaaacgtaaaatccaggaagccctcatggccattcaactggagcgcatgtatactaaaaaagaaatcctggagaaatacctgaatatcgtctacctcggccccggtacctacggggtggaagccgccgcccagtactactttggtacagacgtccagaacctcgacctcgcccagtcggctatgctggcgggtatcatccagagcccgggtaattacaaccctttcgtcaagggtaatgaacaggcagctaaagaccgccaggctgtcgtcctggataatatggtaaaatacggttacattacccaggaacaagccaaccaggccaaggctgaaaaattaacctttaaggagtccaaaaaggctccggtagacaagtatccctattatatcgatgctgtagtcgaggaagccagccgcttacttgagagcaacggtatcgaatcctccgaactttaccggggcggcctgaaaatctatacagccctggaccccgccatccaaactgaaatggagcaggtttaccaggataaaaataacttccctcccagcgccaaagaccgccagatcgaaagcgccatggttgtcctggacccccataccggcgaggtacgtggcctggttggcgggcgcgattatactacccgccggggctttaaccgggcgatccaggctgagcggcaacccggttccacgattaaaccactggttgtttatgcccctgccctcgaaaaaggctatcctccggcctatgtcattgacgacgtacccaccaccttccccgggtcacccaaaccctttaccccccgtaactacgatggccgttaccgggggctcatcagcatgcgggaagccctgcgctggtccgtcaacgtcgccgccgtcaagatgctaaataccattggtgtcgatactggctacgatttcggactgcgcctgggattgccccttaaacctgaggatcgcaacctgtccctggccctgggtggcctgactaccggggtatcgcccctggagatggctgccgcctatggcacctttgccaaccagggggtatatatcaccccccacctgattacccggattaccgaccacaacggccgggatctgattgtagttaatccccagaagcaggccgtcatgagcgagcaatctgcctacctcatgaccgatatgctggaaacggtagttacctccggtaccggcaccagggcccaaattggccgtccggctgccggcaaaaccggtactacctccctgccggaaacaccggagttcaaaaacttgaatggtgaaaaggacgcctggttcgttggttatacgccagaactagtcggggccgtatggatgggctatgaccagaccgacccccagcactacttgaaaagcgtcgccggcggcggctacccggccttaatctggaaaaaggtcatcggggccgctttgaaggataaaccggtccaggacttcccccggccggcggggattatctatgctgacgtggacgccaagtcaggtctcctccccagcgacctgacccccaaagagtttatcgttaaagagatctttacccagagtatgctacccacgaaggtctccgacgtctgggtacaggtacagatcgaccccaccacaggtatgctggccacccccaattgccccaatgtcaccaccggcgtgtttttaaggcgaccggatggctatacgggcaaggcggaagattcttatctggaagcgccgcggcaatactgtaccctccacagcgggggaaacagtaacaaagcgggcctggtgagcatctgtaccgatccgcgccacggcggtgcccttttcctggccaacatcccgggaccgggccaatccggcggttgcccctcccagtatgtaaaacaggtacaattacccccgggccaggtgcctaccagacattgcgatctaccggatcaccagctcagcaaaagtaccggtggccccagccaggacaatgggccgccggccccgcagctggatgcccagctggaggtcggacccaatgtcagccagccccgggtaatcctcacctgggacgtacctgatggcggcaattacgtcttttccgtcgagagaagtaccggcggttccggccatagaagcctggccatcgtcaggcaaaccagttataccgacaccagcgtgcaaccgggggtgacctaccggtaccgggtaatcgccctgagtggtaatgataaatcgggtactccttccaatgaggtgaccatagctatacccaaaaaataa

SEQ ID NO: 50327 - protein, 887 aa, Moorella thermoacetica ATCC 39073
MTLLVLGVILVGAGAGFAIGIIRTMPGWQPDNFKLDMTTFVYDRNNQLVGELHGEQNRVVVPLDKIPVNLQNAVIATEDARFYQHHGIDLKAILRAAIINLRHGSIQEGASTLTQQLARNAFIENPQRTFKRKIQEALMAIQLERMYTKKEILEKYLNIVYLGPGTYGVEAAAQYYFGTDVQNLDLAQSAMLAGIIQSPGNYNPFVKGNEQAAKDRQAVVLDNMVKYGYITQEQANQAKAEKLTFKESKKAPVDKYPYYIDAVVEEASRLLESNGIESSELYRGGLKIYTALDPAIQTEMEQVYQDKNNFPPSAKDRQIESAMVVLDPHTGEVRGLVGGRDYTTRRGFNRAIQAERQPGSTIKPLVVYAPALEKGYPPAYVIDDVPTTFPGSPKPFTPRNYDGRYRGLISMREALRWSVNVAAVKMLNTIGVDTGYDFGLRLGLPLKPEDRNLSLALGGLTTGVSPLEMAAAYGTFANQGVYITPHLITRITDHNGRDLIVVNPQKQAVMSEQSAYLMTDMLETVVTSGTGTRAQIGRPAAGKTGTTSLPETPEFKNLNGEKDAWFVGYTPELVGAVWMGYDQTDPQHYLKSVAGGGYPALIWKKVIGAALKDKPVQDFPRPAGIIYADVDAKSGLLPSDLTPKEFIVKEIFTQSMLPTKVSDVWVQVQIDPTTGMLATPNCPNVTTGVFLRRPDGYTGKAEDSYLEAPRQYCTLHSGGNSNKAGLVSICTDPRHGGALFLANIPGPGQSGGCPSQYVKQVQLPPGQVPTRHCDLPDHQLSKSTGGPSQDNGPPAPQLDAQLEVGPNVSQPRVILTWDVPDGGNYVFSVERSTGGSGHRSLAIVRQTSYTDTSVQPGVTYRYRVIALSGNDKSGTPSNEVTIAIPKK

SEQ ID NO: 50328 - DNA, 2175 bp, Streptococcus suis 89/1591
  CDS (1)..(2175)
ttgaaaactacaacaattaaaaaagctcttctaatcactgcaaatattttacttgcgggggctatcattgcctgcctggccggagctgcattggttgtttactacatccaaagcgctccagaattgacagaagaatctttgacagcaactgtgtcaagtaaaatttacgataagaacggaaatcttattgcagatttaggagcagaaaaacgttcgagtgccaagactgaagaaattccaacagacttggtaaatgcgattgtcgcaatcgaagaccaacgcttcttcaatcatagaggtgttgacgtgattcgtattgcaggttccctgattaataacctgagtggtggacgtttgcaaggtggctcgacacttgaccagcagtttatcaagctgacttatttctcgacatccgtagaagatcaaaatctaaaacggaaaattcaagaggcttggctagctactcaattggaacgtcgcaataccaaacaagagattttgacctactacatcaacaaggtgtatatgtcaaatggtaattacggtatgaagactgctgctcttgctttttatggaaaagagttaaaagatttgactcttcctcaattagctcttttagcaggaatgccccaagcgccaaaccaatatgatccttataccaatccagaagatgcaaaagcacgtcgcgatttggtattggctgagatgctggaagaaaagtacattgataatccccagtatgaacaagctgttctaacacctgtaacagatggtttgcaaccactatctaatgcagctgcttatcctgcttatatggacaactatctgaaacaagtcgttgaagaagttgaagcaaaaacaggttacaacttgctgacaacagggatggatgtctatacgaacgtcgatcctgccgcccagcagcaactttggaatatctacaatacagatatgtatgtcagctatccagatgatttattgcaggtagcttcaacggttgtggatgtttctaatggtaaagtcgttgcgcaattaggtggtcgtaaacaggaaacaaacgtctcatttggtaccaaccaatccgttgaaaccaaccgcgacttcggttctacaatgaagccaatcacagactatgctcctgcttttgaaaacggcatttatacatctacagcagatttaatcttagacggtccttataactatcctggtacaccaactcctgtcaataactgggataaacaatactacggtaatatctctgttaagactgccattcagtattctcgaaatgttaccgccgttaaagcattggaagctacgggcttagaaaatgccttgaaatttttgaatagcgttggtatcaattatccagatattcattactctaatgctatttcaagtaatacatccgatactagcagtaagtatggagcaagtagtgaaaaaatggctgctgcctacgctgcttttgccaatggtggtacttactacgctccacagtatgtcaataaaattgtctttagtgatggaacagtaacagaatatgctcctaaagggaccaaagtcatgtctgccgaaacagcctacatgatgaccgatatgatgaaggctgttatgtcttacggttatggattaaacgcttctgttagtggtgttcctatggccggtaaaacaggtacatcaaactataccgatagcgaaacggatactattctagcttcaattccagaagcaaattatagttacatggtcgttcctgatgaaaacttcgttggatattctagtcagtacgcaatggctgtttggaccggatataccaatcgtatgactcctatccttgataacagcatgcgaattgcaacggatgtctaccacaatatgatgctctttatgcattcggactatacagctaccgattgggagatgccaagcggactcgtacgttacggttccaactactatctcagaggtagtcgctcactctccaatgcttataatacttacactagctctagtacaagttcttctagttcgactgaaactagtgaaacaaccgaagcgacgacaacatcaagcgaaacatcatctggaactgcaaccgagactgcaacttcttcaactgaaactgcaacaacaggaaacaatcccgcaacgggacagacagatggtcaataa

SEQ ID NO: 50329 - protein, 724 aa, Streptococcus suis 89/1591
MKTTTIKKALLITANILLAGAIIACLAGAALVVYYIQSAPELTEESLTATVSSKIYDKNGNLIADLGAEKRSSAKTEEIPTDLVNAIVAIEDQRFFNHRGVDVIRIAGSLINNLSGGRLQGGSTLDQQFIKLTYFSTSVEDQNLKRKIQEAWLATQLERRNTKQEILTYYINKVYMSNGNYGMKTAALAFYGKELKDLTLPQLALLAGMPQAPNQYDPYTNPEDAKARRDLVLAEMLEEKYIDNPQYEQAVLTPVTDGLQPLSNAAAYPAYMDNYLKQVVEEVEAKTGYNLLTTGMDVYTNVDPAAQQQLWNIYNTDMYVSYPDDLLQVASTVVDVSNGKVVAQLGGRKQETNVSFGTNQSVETNRDFGSTMKPITDYAPAFENGIYTSTADLILDGPYNYPGTPTPVNNWDKQYYGNISVKTAIQYSRNVTAVKALEATGLENALKFLNSVGINYPDIHYSNAISSNTSDTSSKYGASSEKMAAAYAAFANGGTYYAPQYVNKIVFSDGTVTEYAPKGTKVMSAETAYMMTDMMKAVMSYGYGLNASVSGVPMAGKTGTSNYTDSETDTILASIPEANYSYMVVPDENFVGYSSQYAMAVWTGYTNRMTPILDNSMRIATDVYHNMMLFMHSDYTATDWEMPSGLVRYGSNYYLRGSRSLSNAYNTYTSSSTSSSSSTETSETTEATTTSSETSSGTATETATSSTETATTGNNPATGQTDGQ

SEQ ID NO: 50330 - DNA, 2208 bp, Silicibacter sp. TM1040
  CDS (1)..(2208)
atgactcaggggcgcaattctgggcgcggcactggacgcgggcgtggcccgctggttgcagagaaacgcaatttgggcggcaatcagcgtaaaccggccaaaaaagcgccaaggaagcgcgccccacaaaaggccaaacgcggctggagcctgtttggacggcgcaagaccgcgcgcccgcagcgcagacgtggactcctgggctggctgttgctgccttttcagatcgtggcacgggtgatctgggcggtgagctggcgcatgggggttgtcggcggtctctttctggccggggcggtcgcctttcactacaccaagctgcccgagtatcaggcgctgctggatgggcggcatcagggctcggtgacgctgctcgatcgcaacggcaagacatttgcatggcgcggcgatcagtttggcggcgtggttacggcggataccgtctcgccgcatctgaagaacgcgatcgtcgccaccgaggacaaacggttttaccgccatttcgggatttcgccgcgcggcatcgccagcgcggtgcgcatcaacctcagcgaagggcgtggcccgctgtcggggcatgggggctctacgatcacccagcagaccgccaagctgatgtgccttggggtggaatatgatcccgacatctgggagagcgaagccgcctatgagagcgactgccgccagtcgtcgctctggcgcaaggggaaggaagcgatctttgccctcgcgatggaggtgaaatacaccaagaacgagatcctctccatctatatgaaccgcgcctatatgggcggtggggcacatggggtggaggccgctgcgcagcgctatttcggcaaatccgcaaatcaggtgaacccgccggaggcggcgatgctggcggggctcttgaccgcgccgtcgacgctggcgcccaccaacaatatcgaacgctcacgcaatcgcgcggccactgtgctgcggctgatggaagaacagggctacctcagccccaaggaacgccagatggccgccgccaatcccgcggagctgagcgaggcggcggcagcgcgcgcggggggctattttgccgattggatcatggacacggtgccgtcctttctgggcgatcagaccaccgaagatgtggtgatccgcaccacgcttgatcaacggctgcaacaggccgccgaggatgcggtgaactatgtgtttgaaaacaaggtgcgtgcaggctccaaggcgcagaccgctgtggtcgtgatgagcgccgatggcgcggtgcgggccatggtgggcgggcgcaaggtgcgtgcctcgggtgtgttcaaccgcgccacgcaggccaagcgccagaccggttcggcgttcaaaccctttgtctatgccgccgcgctggagcttggctattcgccctatgaccgggtgctggatgcggaatattgtctcgatattcccggctccggcccgtggtgcccacagaactacactcgcaagttctatggcgaggtgacattggcgcgcgcgcttcgggactcgctcaatgtgcccgcggtcaaagtctccgaggcggtgggccgcgacaaggtgcgtctggtggcaggcgaattcggcatcgaaagcgatcttgccgatgggccctcgctggcgctgggcgtctctgaaagcacgctcctggaaatgaccggcgcctatgcgggcatcctgaacggtggctcctccgtgacaccctacggggtggaggcgctgacgctggtcggcgattcagagccattgatgggcgcgtccggcggcatgggggagcgggtgatccgccccgtcgcggcgcaggagctgatctggatgatggaaaaagtcatcgccgagggcaccgggcaacgcgcgcagatccccggctggcaggcggcagggaaatccggcaccacctcttcggccaaggatgcatggtttattggctttaccgccgattacgtcgccggggtctggatgggctatgatgacaacacgccgctcaccggtgtcaccggcggcggtttgcccgcagagatctggcgcgagacgatggtgcgggtccacgatgggttggccccccagcccctgccaatggcagcgcccgagccgatcgtggtgcccgagcctcagccgcagcggcgcaatgggggcggctttggccgggagcttgagcgcaccttgaatggcgtgttgcaggacatctttggcaattga

SEQ ID NO: 50331 - protein, 735 aa, Silicibacter sp. TM1040
MTQGRNSGRGTGRGRGPLVAEKRNLGGNQRKPAKKAPRKRAPQKAKRGWSLFGRRKTARPQRRRGLLGWLLLPFQIVARVIWAVSWRMGVVGGLFLAGAVAFHYTKLPEYQALLDGRHQGSVTLLDRNGKTFAWRGDQFGGVVTADTVSPHLKNAIVATEDKRFYRHFGISPRGIASAVRINLSEGRGPLSGHGGSTITQQTAKLMCLGVEYDPDIWESEAAYESDCRQSSLWRKGKEAIFALAMEVKYTKNEILSIYMNRAYMGGGAHGVEAAAQRYFGKSANQVNPPEAAMLAGLLTAPSTLAPTNNIERSRNRAATVLRLMEEQGYLSPKERQMAAANPAELSEAAAARAGGYFADWIMDTVPSFLGDQTTEDVVIRTTLDQRLQQAAEDAVNYVFENKVRAGSKAQTAVVVMSADGAVRAMVGGRKVRASGVFNRATQAKRQTGSAFKPFVYAAALELGYSPYDRVLDAEYCLDIPGSGPWCPQNYTRKFYGEVTLARALRDSLNVPAVKVSEAVGRDKVRLVAGEFGIESDLADGPSLALGVSESTLLEMTGAYAGILNGGSSVTPYGVEALTLVGDSEPLMGASGGMGERVIRPVAAQELIWMMEKVIAEGTGQRAQIPGWQAAGKSGTTSSAKDAWFIGFTADYVAGVWMGYDDNTPLTGVTGGGLPAEIWRETMVRVHDGLAPQPLPMAAPEPIVVPEPQPQRRNGGGFGRELERTLNGVLQDIFGN

SEQ ID NO: 50332 - DNA, 2286 bp, Rubrobacter xylanophilus DSM 9941
  CDS (1)..(2286)
atgagccggcggcgccggcggatgcgcaggaggggcagcctctggtcccgggtcaggacagcgctcctggtcctcgcggggatcacggccctcagcctcgccgggcttctggccagcttctcctacgcctactacgcgctggccgacgacctcccggacctcgacgactaccgctccgtggagctggcccagacctccgtcgtctacgacgccgacggcaacgtcgtggaccagctctacggggtgcagaaccgcttcgtggtcgagctggacgagatagaccccaccctgcggaacgcggtggtcgccatcgaggaccaccggttctaccagcaccggggggtggacttccgggccatcctgcgggccgcccgcaccaacatagccaccatgtccatccgcgagggcggctccaccatcacccagcagctcataaagaacacctacatagcccaggagcagcgctccgtccccagcttccagcgcaagatcaacgaggccgccctggcctggcagtacgagaaggagcactcgaagcgggagatcctggagcagtacctgaacaccgtgtacttcgggcggggggcctacggggcggaggccgcggcgaggacctacttcaacaagagcgccgaggacctcacgctccccgagtccgcgctgctggccgggatcatcaacctcccgagcgcctacgacccgttcaccgaccccgagagcgccagaaaacggcgcaacgtggtgctggacaggatgctccggtacggctacataacgaaggaggagcacgaccgggcggtccgggcgccgatagagctcagccgcggccggatagagccgcgcaacgacaacgagtacttcctcgacgcggtgcgcaaggagctcgcccgcgagtacggcgaggagatggtctacgagggggggctgaagatctacaccaccctcgatcccgacctgcaggagctggcctcgcgcgccgtggacgcggtggtgaacccggaggccggcgacccctcggcggccctggtctccatagacccgaacaccggggcggtgcgggcgatggtcggcggctcggacttcgaccggctgaagttcaatctggccacccaggcgcgccggcagccgggcagctccttcaagcccttcgtgctggcggagatggtggaccagggctactcgccgcagagcgtgtacgtctccaggccgctgcgcatcccgatgcccccgggctcggccgagccttactacgaggtctccaactacgcggacgtgttccgcggcccgatcacggtggaggaggccaccgcccagtcggacaacacggtcttcgtgcagctggcgatggatttggggctcgagaacgtggtggagatggcccacgagctggggataaagagcgagctcgagccctacccctcgaccgccatcggcgggctcggccagggcgtgagcccgctggagatggcctccgcctactccacgttcgccaacggcggggtgcacatggagccctacctgatcgagaaagtcaccaccgaggagaacggccgggaggtcgtcctggaggagcacgagcctgagggggagcgggtgctgagccgggacgaggccgcggtggtcaccgagaccctgcgggcggtggtggagcgggggacggcgagcctgttccacgacctggacgccgagctcggacgcccctcggcaggcaagacggggaccaccgaggagttcgccgacgcctggtacgtgggctacatcccccagctcgccacgagcgtctgggtcggctacccgggggagcggcgcccgatggtgaacatccggggctactcggagatcaacggtgagaacttcccgctggacatctggtcgctgtacatgcagggcgccgtgcagtacttccccgtccagcagttcgacgtgccgagcccggacctggacctgcgggtgagaaacgcgggcctgctggagaccaccggcgagggggagacgacctcgggcgcggcggacgaggagaccaccggcctcgtggaggacctgctggacggcgtgctcggcgaagacggccgtgaagaggagggccccgcccgcgagcgcccgcgaacgcccccgcagcgaccctcgccccaaccgccgcccccgccacagcccgccccccagccggcgccccagcccgccccggccccgcagcccgccccagccccgcagccggccccggccccgcagcagcccggcggcttccccggcggcgacgccttcgacagctgggtcttcgaggactag

SEQ ID NO: 50333 - protein, 761 aa, Rubrobacter xylanophilus DSM 9941
MSRRRRRMRRRGSLWSRVRTALLVLAGITALSLAGLLASFSYAYYALADDLPDLDDYRSVELAQTSVVYDADGNVVDQLYGVQNRFVVELDEIDPTLRNAVVAIEDHRFYQHRGVDFRAILRAARTNIATMSIREGGSTITQQLIKNTYIAQEQRSVPSFQRKINEAALAWQYEKEHSKREILEQYLNTVYFGRGAYGAEAAARTYFNKSAEDLTLPESALLAGIINLPSAYDPFTDPESARKRRNVVLDRMLRYGYITKEEHDRAVRAPIELSRGRIEPRNDNEYFLDAVRKELAREYGEEMVYEGGLKIYTTLDPDLQELASRAVDAVVNPEAGDPSAALVSIDPNTGAVRAMVGGSDFDRLKFNLATQARRQPGSSFKPFVLAEMVDQGYSPQSVYVSRPLRIPMPPGSAEPYYEVSNYADVFRGPITVEEATAQSDNTVFVQLAMDLGLENVVEMAHELGIKSELEPYPSTAIGGLGQGVSPLEMASAYSTFANGGVHMEPYLIEKVTTEENGREVVLEEHEPEGERVLSRDEAAVVTETLRAVVERGTASLFHDLDAELGRPSAGKTGTTEEFADAWYVGYIPQLATSVWVGYPGERRPMVNIRGYSEINGENFPLDIWSLYMQGAVQYFPVQQFDVPSPDLDLRVRNAGLLETTGEGETTSGAADEETTGLVEDLLDGVLGEDGREEEGPARERPRTPPQRPSPQPPPPPQPAPQPAPQPAPAPQPAPAPQPAPAPQQPGGFPGGDAFDSWVFED

SEQ ID NO: 50334 - DNA, 2946 bp, Chloroflexus aurantiacus
  CDS (1)..(2946)
atgattcgctcacgtcgtttacatgcaaatggtcgcaatggtcgccgccacgtgccgccacatctgttgcgcgggttgcggggccgatcaacaccacgatctgcggtcagtcgctggcttgttaatgcgctcctggccggacttggtttagtagcggtggtgatcgtcgctatcgccggctttgcctacaatgcctacgcgcaggttgccgagagtctgaaaccgcgactggctttgctcgataaccgggaattgttcgagaactcgcgcatctttgaccgtaacggtgagctgctgtacgagtttttcgataccggcaagcgcacaaaagtgacgattgacgagattagtccgctgttgattcaggcgacgattgcgattgaggataagaccttctataccaatccgggcatcgatctggccggtattgtgcgtactctgattgacagcctgcgggcaggtgaagagaccggtggtgcctcgacgattacacagcaggtgatcaagaatagcgtgctcaccccggaagagcgtctcccggaacggcgttacgaacggaaactgaaggagattatcctcgcccaggagctggatcgcatctataccaaagatcagattcttgagctatatctgaatgagaatttttacggcaatctggcctacggtattcaggcggccagtgaggtctattttggggtgagcgcggctgatcttgatttgaaccaggcgtcgctccttgccggtttgccacagttaccatcggtctacaatccgattaactatctggagcgcgacgagcagggtggttatctcccgcccgtctttgtcggcgatggctggcttgaccccgatgcccgtctgcccgccggcacaccgctgccacggatccggcaggcggctgtgttgcgtcggatggttgaggatggctacatcaccgaagcgcaggctcgccaggcattggccacaccgctgcggttcgcgccgcaagaggcacccctcaatgcgccgcacttcgtcttctatgtgcgcgacctgctcttgcaacgctacggcgctcagattgtgtatggcggtggtttgcggatcacaaccacgctcgacctgcaattgcaacggatggcccagcgcaccgccttcgagcgtatcgctgaactggagtcgcgcaacattcacaatgccgcggtcgtgattatgcagccgaacaccggtcagattttggcgatggtcggtagtattgattacaacgcggtcaaaccaaccactacgcccggcgagtcgggtaatgtgctcgacggtcaggtgaatgtggcgacacgcgagcggcaacccggttcggcgctgaagccgtttacctacctggcggcgatggaacaggggatgaccccagagacggtgctgtgggatgtgccaactcgcttcccaaccggtaccggtgactggtacgcgccgcaaaactataacggccagtggaacgggccggttcgtatccgtaccgcactggcgaattcgttgaatatgccggcagtgcgggcactgaagtttgccgggattgactacacgatccggttgctggaacgggttggcatccgtaccggtctgaaacgtggtgccggtttctacggcctttcgttgacgctcggtggcggtgaggtgtcgcccctggagctgacaaccgcgtacaacactctggccagcggtggtcgttactttgcaccggtcgctatcctggagattaccgactcgcagggccgtgttcttgaacggtttacccaaacccctggcgaggaggtggttgatccggcgctggtcgcaatcatctctgacatgctcagtgatgatcgtgcgcgccaggccatctggggactgaacagcccgctgcggctcagcctgccggctgcggtcaagaccggtaccaccaacgactggcgtgacgcctgggcagtcggctatacgccgtttgtgacggttggcgtctggacgggtaacaacaacaatgaaccaaccgcccgggtcgagagtctgaccggtggtggcattatctggcgcaacgtgatggagaatatctttcggctgatcgccgaagatgagcgataccgcgacctgttcgccgcacccttccctaacggagaaatccaaaccgaatttgtgctacctgaagaggtggtaccgcgtccgatctgtgaactgcccggcccattcggtggctatcgtgaagagctatttacgcttgatatgatcaagcggctggaagaggcagcgcaaccgacaccggaagcgaccaccggtgatgccatcccgaacgaaggtttctgttcggcctacacaaaagtacgtgttgtccggattccgaccccggaagagtggacaaccagcggcgagctacgccccaatccgccaccgccgccgccaacagaccccaaagcaccaccgttgccgcaagacctcagcgccttaaccgatggtgcttattgccgaccggcgcctgatgccgcctatccgccggagctggtacgggacatctacctgtggaagctgccaccgcccgatcctgatgaagaggttgagtataagtggcgcggcggtgatgcaacggttccgctcaagtacgaagagctgccggagtgtaccccggcaatgtttgagccaccgatcccggtgccaccggttgaaggtgctatcctgatgcccgatctgcgtcggttgggtgaaaatcaggcgaaagaagtgctggcgctgttgggcattgaccccggtcggatttacgttgattaccaggggccagatcgtgccggcgaggattattatcggtatgggccgtatgtggtcctgagttcactcccggcagcgggcgaatggatcttgccggacacaaccatcgtgctgggcattcgcgcacctgatccaaaccccgaaccaccagcatccgacagtactgagggcaattga

SEQ ID NO: 50335 - protein, 981 aa, Chloroflexus aurantiacus
MIRSRRLHANGRNGRRHVPPHLLRGLRGRSTPRSAVSRWLVNALLAGLGLVAVVIVAIAGFAYNAYAQVAESLKPRLALLDNRELFENSRIFDRNGELLYEFFDTGKRTKVTIDEISPLLIQATIAIEDKTFYTNPGIDLAGIVRTLIDSLRAGEETGGASTITQQVIKNSVLTPEERLPERRYERKLKEIILAQELDRIYTKDQILELYLNENFYGNLAYGIQAASEVYFGVSAADLDLNQASLLAGLPQLPSVYNPINYLERDEQGGYLPPVFVGDGWLDPDARLPAGTPLPRIRQAAVLRRMVEDGYITEAQARQALATPLRFAPQEAPLNAPHFVFYVRDLLLQRYGAQIVYGGGLRITTTLDLQLQRMAQRTAFERIAELESRNIHNAAVVIMQPNTGQILAMVGSIDYNAVKPTTTPGESGNVLDGQVNVATRERQPGSALKPFTYLAAMEQGMTPETVLWDVPTRFPTGTGDWYAPQNYNGQWNGPVRIRTALANSLNMPAVRALKFAGIDYTIRLLERVGIRTGLKRGAGFYGLSLTLGGGEVSPLELTTAYNTLASGGRYFAPVAILEITDSQGRVLERFTQTPGEEVVDPALVAIISDMLSDDRARQAIWGLNSPLRLSLPAAVKTGTTNDWRDAWAVGYTPFVTVGVWTGNNNNEPTARVESLTGGGIIWRNVMENIFRLIAEDERYRDLFAAPFPNGEIQTEFVLPEEVVPRPICELPGPFGGYREELFTLDMIKRLEEAAQPTPEATTGDAIPNEGFCSAYTKVRVVRIPTPEEWTTSGELRPNPPPPPPTDPKAPPLPQDLSALTDGAYCRPAPDAAYPPELVRDIYLWKLPPPDPDEEVEYKWRGGDATVPLKYEELPECTPAMFEPPIPVPPVEGAILMPDLRRLGENQAKEVLALLGIDPGRIYVDYQGPDRAGEDYYRYGPYVVLSSLPAAGEWILPDTTIVLGIRAPDPNPEPPASDSTEGN

SEQ ID NO: 50336 - DNA, 2028 bp, Polaromonas sp. JS666
  CDS (1)..(2028)
atgaccccggccctgcaccgcgcagccacttttaccgctgaacagttccaccgcctcatgggcgccatcaggcggcaccccgtgcgggcggctttggtgctgccggcgctgatgctgctttatgtactggtgctgattccgttcacgcccggcattggcgacttgcgcaaggccaagtctgaaacgccctcggtgctgctggcttctgatggcacggtgctggccgagtacaggcgtatcaaccggcagtgggtgacgctggacaagatttcgcccaacgtcgttaacgcgctgatcgccacagaagaccaccgattttacgagcaccacggcatcgacttccggcgtatcgcgggggcggtgctcagtaccttgtcgggcgatttgcagggtggctcgaccatcacgcagcagctggcgcgcaacttgtaccccgaggagatcggccgcgccaccagcatcacgcgcaaggtcaaggaggcgatcaccgcgctgaagatcgaggcggtgtattccaagcgcgagatcctggagacctatctcaacaccgtgccttttttgtacaacgccttcggcatcgaaatggccgcgcgcacctatttcgacaagtcggcctacaagctggatgtgctggagagcgccacgctgatcggcatgctcaagggcacgagttattacaacccggtgttgaacccggagcgcgccgtgcagcgccgcaacctggtgctggcgcagatggccaagcacggcaagctggacccggcccgggttgaggtgctggccaaacggccgctcaagctagactttgagcggcagaccgaggcgctgggcccggcgccgcacgtggcccaacacttgcgcaaatggctgattgcctgggccgaccacaagggcttcgacattcattcggacggcctgcgggtgcgcaccaccctcgacgccaagatccagaaggcggccaaccaggcggtggcccggcagatggcgcaattgcaaacgctggcagacggccggcgcaaggcggggcaggagcggcccgtgctgcaggccggcttcctcgcgctcgacccgcgcaacggcgccgtgcgggcctgggtgggcagccgcgactttgcgcaggagcagtttgaccatgtgagccaggcgcggcgccagccgggctcgaccttcaagccctttgtttatggcgcggccttcatgctggggctggacccgctggacaccttgatcgaccagcctgtggccatctcgcagcagggcgccggggtgtggacgcccagcgatgcaacgccgcccacttacatgcccaccaccctgcgcgacgggctggtgtattccaaaaacaccatcacggcccagctgatgcagaaggtggggccagccaaagtaggggcgctggcgcaggccatgggcgtgcggcagagcaagctggacctggtgccgtcactcgcgctgggcaccagccccgtcacgctgctggagatggtcaccgcctacggctccattgccaatggcggcagttatatgccgccggtgctggtgctgcgcgtggaagaccgcaacggccggctgctggagcagttcgagcccgtcagggagcgcgaaccggccatgccgcgtgcgcatgcgctgactttggtgaatgcgatgcgcggtgtgattgacgagggcacgggcacggccattcgccagcgctatggcatccaggccgacgtggccggcaagaccggcaccacgcaagacaacaccgacggctggttcatcatgatgaactcgcaactggtggccggcgcccgggtcggctttaacgacaacagcgtgaccatgggcacctgggggcagggtgcccgcagcgcgctgcccatggtgggcgaggtttttcagcaaggctttcgcaaccgctggcttgaccagaacgctgaattcgacattccgcgcccacggcccgctccgccggagcaggcgccggtcatggagatcatgaatggcttgtttggcaggatctttcggcagttgcaggggaactga

SEQ ID NO: 50337 - protein, 675 aa, Polaromonas sp. JS666
MTPALHRAATFTAEQFHRLMGAIRRHPVRAALVLPALMLLYVLVLIPFTPGIGDLRKAKSETPSVLLASDGTVLAEYRRINRQWVTLDKISPNVVNALIATEDHRFYEHHGIDFRRIAGAVLSTLSGDLQGGSTITQQLARNLYPEEIGRATSITRKVKEAITALKIEAVYSKREILETYLNTVPFLYNAFGIEMAARTYFDKSAYKLDVLESATLIGMLKGTSYYNPVLNPERAVQRRNLVLAQMAKHGKLDPARVEVLAKRPLKLDFERQTEALGPAPHVAQHLRKWLIAWADHKGFDIHSDGLRVRTTLDAKIQKAANQAVARQMAQLQTLADGRRKAGQERPVLQAGFLALDPRNGAVRAWVGSRDFAQEQFDHVSQARRQPGSTFKPFVYGAAFMLGLDPLDTLIDQPVAISQQGAGVWTPSDATPPTYMPTTLRDGLVYSKNTITAQLMQKVGPAKVGALAQAMGVRQSKLDLVPSLALGTSPVTLLEMVTAYGSIANGGSYMPPVLVLRVEDRNGRLLEQFEPVREREPAMPRAHALTLVNAMRGVIDEGTGTAIRQRYGIQADVAGKTGTTQDNTDGWFIMMNSQLVAGARVGFNDNSVTMGTWGQGARSALPMVGEVFQQGFRNRWLDQNAEFDIPRPRPAPPEQAPVMEIMNGLFGRIFRQLQGN

SEQ ID NO: 50338 - DNA, 2271 bp, Streptococcus pyogenes M49 591
  CDS (1)..(2271)
atgcatcaaaaaacgcgtttaacgccacaacacaatcaaaagcagtattcgccaaatgccaatcatttggactcatcagctaccaaaaactcagaacaagaccctgcaatagctctgcaacgcagtagagcctatgaaggaagccctaaaagtcggcccgcttggttgcaaaagttggaagctgttttgccgtctcctcaacatccaattcggcgtttttggcgccgctatcatatcggaaaactgctaatgattctgattggaactcttgtcttactcttaggatcatacttgttttacttatcaaaaacagctaaagtatctgatttacaagatgccttgaaggctacaactgttatttatgatcacaaaggagagtatgcaggcagtttatctggtcaaaaagggagttatgtcgagctcaacgctatttcagatgatcttgagaatgctgttattgccactgaggataggactttttacagtaatagcggtattaatcttaaacgcttcttattggcggtagttacggcgggccgctttggaggtggctcaacgattacacagcaactggctaaaaatgcttatctctcacaagatcagacaattaaacgaaaggccagagagttttttttggcgttagagttgaccaaaaaatacagtaaaaaagatattcttactatgtaccttaacaactcctattttggaaatggagtttggggagttgaagatgccagtcaaaaatattttggaaccacagctgctaacttaacattggatgaagctgccacattagcaggtatgctcaaaggacctgaaatatataacccttaccattctctaaaaaatgctactcaccgtagagatactgttttaggagcgatggttgatgccaaaaagattacccaaacaaaagctcaacaagctagagcagtagggctaaaaaatcgcttagctgatacttatgttggtaagacagatgactacaaatacccatcctactttgatgctgttattagtgaagcaatagcaacttatggcctttcagaaaaagacattgttaataatggatacaaagtttacaccgagctagatcaaaattaccaaactggcatgcagacgacttttaacaacgatgaactatttcctgtttcagcttatgacggtagctctgctcaagcagctagtgttgctttagatcctaaaacaggaggtgttagaggtctgattggtcgtgtgaatagtagtgaaaatccgactttcagaagctttaactatgcgactcaagcaaaacgtagtcccgcatcaacaatcaaaccactcgtggtttacgcgccagccgttgcttcaggatggtcaattgaaaaagaactaccaaataccgttcaagattttgatggctatcagccacataattatggaaattatgaatcagaagatgttcctatgtatcaagcattagcaaactcttataatattccagcagtttctacattgaacgatatcggaatcgataaagcctttacctatggtaaaacatttgggttagatatgagctctgccaaaaaagagttgggggtagctttaggtggcagcgtgacaactaatccattggagatggctcaggcatatgctgcctttgccaataatggagtaatccatcctgcgcacttgattaaccggattgaaaatgccaggggtgaagtgcttaaaacctttactgataaggctaaacgtgttgtcagccagtctgttgcagataagatgacagccatgatgctaggtaccttttcaaatggaacagcagtcaatgctaacgtatatggctatacactagctggtaaaacagggacgacagaaaccaacttcaatcccgacttagcaggcgatcagtgggttattggttatacgccagatgttgttattagtcaatgggtaggatttaatcagaccgatgaaaatcattatctaacggattcaagtgcaggcacggcttcagctatttttagcactcaggcatcttacattttgccttataccaagggcagccaatttcatgtagataatgcctacgctcaaaatggtatttcagctgtttatggagtcaatgaaacaggtaatcaatcaggagttgacactcaatctattattgatggtttaagaaaatcagcacaagaagcttcgcaatcactatcaaaagcagtcgatcagtcagggttacgtgataaagcccaatctatttggaaagagattgttgactattttagatag

SEQ ID NO: 50339 - protein, 756 aa, Streptococcus pyogenes M49 591
MHQKTRLTPQHNQKQYSPNANHLDSSATKNSEQDPAIALQRSRAYEGSPKSRPAWLQKLEAVLPSPQHPIRRFWRRYHIGKLLMILIGTLVLLLGSYLFYLSKTAKVSDLQDALKATTVIYDHKGEYAGSLSGQKGSYVELNAISDDLENAVIATEDRTFYSNSGINLKRFLLAVVTAGRFGGGSTITQQLAKNAYLSQDQTIKRKAREFFLALELTKKYSKKDILTMYLNNSYFGNGVWGVEDASQKYFGTTAANLTLDEAATLAGMLKGPEIYNPYHSLKNATHRRDTVLGAMVDAKKITQTKAQQARAVGLKNRLADTYVGKTDDYKYPSYFDAVISEAIATYGLSEKDIVNNGYKVYTELDQNYQTGMQTTFNNDELFPVSAYDGSSAQAASVALDPKTGGVRGLIGRVNSSENPTFRSFNYATQAKRSPASTIKPLVVYAPAVASGWSIEKELPNTVQDFDGYQPHNYGNYESEDVPMYQALANSYNIPAVSTLNDIGIDKAFTYGKTFGLDMSSAKKELGVALGGSVTTNPLEMAQAYAAFANNGVIHPAHLINRIENARGEVLKTFTDKAKRVVSQSVADKMTAMMLGTFSNGTAVNANVYGYTLAGKTGTTETNFNPDLAGDQWVIGYTPDVVISQWVGFNQTDENHYLTDSSAGTASAIFSTQASYILPYTKGSQFHVDNAYAQNGISAVYGVNETGNQSGVDTQSIIDGLRKSAQEASQSLSKAVDQSGLRDKAQSIWKEIVDYFR

SEQ ID NO: 50340 - DNA, 1935 bp, Campylobacter lari RM2100
  CDS (1)..(1935)
atgataaaaattttaaaaatatttctttctttttgtgtagtatgtgcggttggaatttttatatttattgcatatttgttttcagattctgatttaaatcaatacacctttaaagattacaaaccacctcttacaacacaaatttttgataaaaatggaaaattagttgcaaatgttttcgagcaacaccgcttttacgctccttatgaagagttgcctccaagacttatagaagctttagtggccattgaagatactagcttttttgaacatggtggggttaatatagatgcgatttttagagcagctattaaaatcataagaagtggtggaaaaaccatggaaggagcttccactcttacgcaacaattcataaaaaacacagaattaaccccagagcgtactttgagtagaaagctaaaagaagctttacttgcatataaaatagaaaatactttaactaaagagcaaattttagaaagatatttaaatttcatcttctttggacatggatattatggagtaaaaactgctgcgcttgggtattttagaaaaaatttagatgatcttagcttgaaagaaattgccattttggtaggtatgccaaaggctccaagcacttatgatcctactagacatttagatctttctttagctagagcaaacagcgtagtacaaagaatgtataatcttggttggatttctaaagaagagtatgaaaatgctttaaaagaaattccaaaagtatatgatgatactttaacacaaaatgcagccccttatgttactcaagaagttttaaaacaactaagtggtataaaagatcttaaaagtggtggttataaaatagagcttgctatcgatcttgatgtgcaaaatattgcaagagaggctttaaaatttggctatgacgagataataaaaagagacaaagatgcaaatttaagtacacttaatggagctatgatagtagcaaatcaccaaaatggagatatattagccttagtaggtggggtaaattacacaaaaagtaatttcaaccgcgccactcaaagcttaagacagcctggaagttcttttaagccttttttataccaaattgccattgacatgggttattctcctatgagtaaagttgctgatatttcaagaatttttgaaagcaccaaagaagatgagaaagattggaaacctaaaaattatgggggaaaatttctagggcttataagtttaaaagaagcactaactggatcaaggaacctagctaccataaatttagctcttgccttagggcttgatgtaatccatgataaacttcaatttatgggctttgagaatataccggttgatttatctatagttttgggtagctttgggatttctatttatgattatgctaaactttatacagtatttggaaattatggcgtgcaaaaagatttaatactcattaaaagagtaatcgataaaaatggcaaaataatagtagagtttaactccggagaaagaaaaatcagcgaacccgaacaagcctttttagttaatgatatgatgcaaaatgttgttaaaaaaggtactggacgcaatgctagggtagaagggattgagatagctggaaaaacaggtacttcaaataaaagcgtagatgcttggttttgtggcttaactccagaaatagaagctattatttggtatggaaatgatgataataaacctatgaaacaaatcgaaggtggtgcaaggactgctgctccggtttttaaagaatttttaacaaaatacctagaactttatcctgatagcgctagaaaatttatcatcccaaaaggagtttatcaaggaatttatgaaaaacaaagagagtattacaccaatacttctccatttccaaaaaacaaccctgctctatctgaaaacaatgagataattttttaa

SEQ ID NO: 50341 - protein, 644 aa, Campylobacter lari RM2100
MIKILKIFLSFCVVCAVGIFIFIAYLFSDSDLNQYTFKDYKPPLTTQIFDKNGKLVANVFEQHRFYAPYEELPPRLIEALVAIEDTSFFEHGGVNIDAIFRAAIKIIRSGGKTMEGASTLTQQFIKNTELTPERTLSRKLKEALLAYKIENTLTKEQILERYLNFIFFGHGYYGVKTAALGYFRKNLDDLSLKEIAILVGMPKAPSTYDPTRHLDLSLARANSVVQRMYNLGWISKEEYENALKEIPKVYDDTLTQNAAPYVTQEVLKQLSGIKDLKSGGYKIELAIDLDVQNIAREALKFGYDEIIKRDKDANLSTLNGAMIVANHQNGDILALVGGVNYTKSNFNRATQSLRQPGSSFKPFLYQIAIDMGYSPMSKVADISRIFESTKEDEKDWKPKNYGGKFLGLISLKEALTGSRNLATINLALALGLDVIHDKLQFMGFENIPVDLSIVLGSFGISIYDYAKLYTVFGNYGVQKDLILIKRVIDKNGKIIVEFNSGERKISEPEQAFLVNDMMQNVVKKGTGRNARVEGIEIAGKTGTSNKSVDAWFCGLTPEIEAIIWYGNDDNKPMKQIEGGARTAAPVFKEFLTKYLELYPDSARKFIIPKGVYQGIYEKQREYYTNTSPFPKNNPALSENNEIIF

SEQ ID NO: 50342 - DNA, 2541 bp, Citrobacter freundii
  CDS (1)..(2541)
atggcggggaatgaccgcgagccaattggacgtaaagggaaaccctcgcgtccggtgaaacaaaaggtgagccgtcgtcaactcagagatgaagagtatgacgacgattatgatgatgatgactatgaggatgaagaaccgatgccgcgtaagggtaaaggcaaagggcgtaagcctcgtggtaaacgcggctggttctggctgctggtaaaactgtcgattgtttttttggtgctgatcgccatttacggcgtttatctggaccaaaaaatccgcagccgtatagatggtaaagtctggcagcttcctgcggcagtatatggccgtatggttaaccttgagccagaaatgccgatcggcaagaacgagatggtagaactgctggaggctacgcagtatcgtcaggtgacgaagatgacgcgccctggcgaattcaccgtgcaggcgaaaagcatcgagatgatccgtcgtccgtttgattttccggacagtaaagaagggcaggtgcgcgcgcgtctgacctttgatggcgaccatctggataccatcgagaatatggataacaaccgccagtttggtttcttccgtctcgatccgcgactgattaccatgctctcttcgcctaacggtgagcagcgcctgtttgtcccgcgcagtggattcccggatctgctggtggacacgctgctggcgaccgaagatcgtcacttctatgagcatgacggtatcagcctctattccattggccgtgcggtgctggcgaacctgacggcggggcgcacggtacaaggggccagtacgctgacccagcaactggtgaaaaacctgttcctgtccagcgaacgttcctattggcgtaaggccaacgaagcctatatggcgctgatcatggatgccggttacagcaaagaccgcattcttgagctgtacatgaacgaagtctatctcggtcaaagcggtgacaatgagatccgcggcttcccgctggcgagcctctactactttggccgtccggtggaagagctgagcctcgaccagcaggcgctgctggtagggatggttaaaggagcgtcaatctataacccgtggcgtaacccgaagctggcactggagcgtcgtaacctggtgctgcgtttactacaacagcagcagattatcgaccaggatctgtatgacatgctgagcgcgcgtccgttaggcgtacagccgcgtggtggggtgatctcaccgcagcccgcctttatgcagatggtgcgccaggagctacaggcgaagctgggcgataaagttaaagatctctccggcgtgaagattttcaccacctttgattccgtggcgcaggatgctgcagaaaaagcggcggtggaaggtattccggtgctgaagaaacaacgtaagctgagcgatctggaaaccgcgattgtggtggttgaccgcttcagcggcgaagtgcgtgccatggtcggtggggcagaaccgcagttcgctggttataaccgtgcgatgcaggcacgtcgttcgattggttctttggctaaaccagcgacctatctgaccgcgctcagccagccgaaactgtaccgtctgaatacctggattcggcatgccccgattgcgctgcgccagcctaacggccaggtgtggtcgccgcagaacgatgaccgtcgctatagcgaaaccggaaaagtgatgctggtggatgcgttaacgcgctcaatgaacgtgccaacggtaaatctggggatggcgctgggcctgcctgccgtcaccgatacctggctgaagctgggcgcgccgaaagatcagcttaatccggttccggccatgctgctgggggcgttgaacctgacgccgatcgaagtggcgcaggcgttccagactatcgccagcggcgggaaccgcgcgccgctgtcggcgttgcgttcggtgattgccgaagatggtacggtgctgtatcagagcttcccacaggccgagcgttcggttccggcgcaggcggcgtatatgacgctgtggaccatgcaacaggtggttcagcgtggtacgggccgccagcttggcgcgaaatatcctgggcttcatctggcagggaaaaccgggaccactaacaacaacgtggatacctggtttgccgggatcgacggcagccaggtaaccatcacctgggtgggccgtgataacaaccagccaaccaagctgtacggtgccagcggtgcgatgtcgatttatcagcgttatctggccaaccagacgccaacaccgctggtgctgacgccgccggaagatgtggtggatatgggcgtggactacgacggtaacttcgtttgtagcggggggatgcgtacgcttccggtatggactaccgatcctgattcgctgtgtcagcagggtgaaatgatgcaacagccgaccgggaatccgttcgatcagtcaacgccgcagcagcagcctcaacagcagcagcaacaaccggcgcagcaggaaaagaaagatagcgacggcgtcgctggctggataaaggatatgttcggcagtaactga

SEQ ID NO: 50343 - protein, 846 aa, Citrobacter freundii
MAGNDREPIGRKGKPSRPVKQKVSRRQLRDEEYDDDYDDDDYEDEEPMPRKGKGKGRKPRGKRGWFWLLVKLSIVFLVLIAIYGVYLDQKIRSRIDGKVWQLPAAVYGRMVNLEPEMPIGKNEMVELLEATQYRQVTKMTRPGEFTVQAKSIEMIRRPFDFPDSKEGQVRARLTFDGDHLDTIENMDNNRQFGFFRLDPRLITMLSSPNGEQRLFVPRSGFPDLLVDTLLATEDRHFYEHDGISLYSIGRAVLANLTAGRTVQGASTLTQQLVKNLFLSSERSYWRKANEAYMALIMDAGYSKDRILELYMNEVYLGQSGDNEIRGFPLASLYYFGRPVEELSLDQQALLVGMVKGASIYNPWRNPKLALERRNLVLRLLQQQQIIDQDLYDMLSARPLGVQPRGGVISPQPAFMQMVRQELQAKLGDKVKDLSGVKIFTTFDSVAQDAAEKAAVEGIPVLKKQRKLSDLETAIVVVDRFSGEVRAMVGGAEPQFAGYNRAMQARRSIGSLAKPATYLTALSQPKLYRLNTWIRHAPIALRQPNGQVWSPQNDDRRYSETGKVMLVDALTRSMNVPTVNLGMALGLPAVTDTWLKLGAPKDQLNPVPAMLLGALNLTPIEVAQAFQTIASGGNRAPLSALRSVIAEDGTVLYQSFPQAERSVPAQAAYMTLWTMQQVVQRGTGRQLGAKYPGLHLAGKTGTTNNNVDTWFAGIDGSQVTITWVGRDNNQPTKLYGASGAMSIYQRYLANQTPTPLVLTPPEDVVDMGVDYDGNFVCSGGMRTLPVWTTDPDSLCQQGEMMQQPTGNPFDQSTPQQQPQQQQQQPAQQEKKDSDGVAGWIKDMFGSN

SEQ ID NO: 50344 - DNA, 2184 bp, Staphylococcus aureus
  CDS (1)..(2184)
atgacggaaaacaaaggatcttctcagcctaagaaaaacggtaataatggtgggaaatccaactcaaaaaagaatagaaatgtgaagagaacgattattaagattattggcttcatgattattgcattttttgttgttcttttactaggtatcttattgtttgcttattatgcttggaaagcacctgcttttaccgaagctaaattacaagatccgattcctgcaaagatatatgacaagaacggagaacttgttaaaacattagataatggccaaagacatgagcatgtaaatttaaaagacgtgccgaaatcaatgaaagacgcagtacttgcaactgaagacaatcgtttctacgaacatggcgcacttgattataaacgtttattcggtgcaattggtaagaacttgactggtggatttggttctgaaggtgcctcaacattaacacaacaagttgttaaagatgcatttttatcacaacataaatctattggacgtaaagctcaagaagcatacttatcatatcgtttagaacaagagtatagtaaagatgatatcttccaagtatatctaaacaaaatttactattctgatggcgtaacaggtattaaagctgctgctaagtattactttaataaagatttaaaagatttaaacttagcggaagaagcttatttagccggtttacctcaggttccaaacaactataatatttatgatcatccaaaagctgctgaagatcgtaaaaacactgttttatacttaatgcattatcataaacgcattacagataaacagtgggaagatgctaagaaaatcgatttaaaagcgaacttagtaaatcgtactgctgaagaacgtcaaaacattgatacaaatcaagattctgagtataattcatacgttaactttgtaaaatctgaattaatgaataataaagaattcaaagatgaaaatttaggtaatgtattacaaagtggtattaaaatttatacaaacatggataaagatgttcaaaaaacattacaaaatgatgttgataatggtagcttctacaagaataaagaccaacaagttggtgcaacgattcttgatagtaaaactggtggtttagttgctatatctggtggacgtgatttcaaagacgtcgttaacagaaaccaagcaacagatcctcaccctactggttcatctttaaaacctttcttagcgtatggacctgccattgaaaatatgaaatgggcaacaaaccatgcgattcaagatgaatcttcatatcaagttgatggttctacatttagaaactatgatacgaagagtcacggtactgtatctatttatgatgctttacgacaaagtttcaatatcccagctttaaaagcatggcaatcagttaagcaaaatgctggtaacgatgcacctaagaaattcgctgccaaacttggcttaaactacgaaggcgatattggtccatctgaagtacttggtggttctgcttcagaattctcaccaacacaattagcatcagcatttgctgcaatcgctaacggtggtacttataacaacgcgcattcaattcaaaaagtagttactcgtgacggtgaaacaatcgaatacgatcatactagccataaagcgatgagtgattacactgcatacatgttagctgagatgctaaaaggtacatttaaaccatatggttctgcatatggccatggtgtagctggagtaaatatgggtgctaagacaggtactggtacttacggtgctgaaacttattcacaatataatttacctgataatgcagcgaaagcagtgtggattaacggctttacacctcaatacactatgtcagtgtggatgggcttcagtaaagttaaacaatatggtgaaaactcatttgtgggacatagccaacaagaatatccacagttcttatatgaaaatgtgatgtcaaaaatttcatctagagatggcgaagactttaaacgtcctagctcagtaagtggtagtatcccatcaatcaatgtttctggtagtcaagataacaacactacaaatcgtagtacacacggtggtagtgacacatcagcaaacagcagtggtactgcacaatcaaataacaatactagatctcaacaatctagaaacagcggtggattaacaggtatattcaactaa

SEQ ID NO: 50345 - protein, 727 aa, Staphylococcus aureus
MTENKGSSQPKKNGNNGGKSNSKKNRNVKRTIIKIIGFMIIAFFVVLLLGILLFAYYAWKAPAFTEAKLQDPIPAKIYDKNGELVKTLDNGQRHEHVNLKDVPKSMKDAVLATEDNRFYEHGALDYKRLFGAIGKNLTGGFGSEGASTLTQQVVKDAFLSQHKSIGRKAQEAYLSYRLEQEYSKDDIFQVYLNKIYYSDGVTGIKAAAKYYFNKDLKDLNLAEEAYLAGLPQVPNNYNIYDHPKAAEDRKNTVLYLMHYHKRITDKQWEDAKKIDLKANLVNRTAEERQNIDTNQDSEYNSYVNFVKSELMNNKEFKDENLGNVLQSGIKIYTNMDKDVQKTLQNDVDNGSFYKNKDQQVGATILDSKTGGLVAISGGRDFKDVVNRNQATDPHPTGSSLKPFLAYGPAIENMKWATNHAIQDESSYQVDGSTFRNYDTKSHGTVSIYDALRQSFNIPALKAWQSVKQNAGNDAPKKFAAKLGLNYEGDIGPSEVLGGSASEFSPTQLASAFAAIANGGTYNNAHSIQKVVTRDGETIEYDHTSHKAMSDYTAYMLAEMLKGTFKPYGSAYGHGVAGVNMGAKTGTGTYGAETYSQYNLPDNAAKAVWINGFTPQYTMSVWMGFSKVKQYGENSFVGHSQQEYPQFLYENVMSKISSRDGEDFKRPSSVSGSIPSINVSGSQDNNTTNRSTHGGSDTSANSSGTAQSNNNTRSQQSRNSGGLTGIFN

SEQ ID NO: 50346 - DNA, 2292 bp, uncultured bacterium 311
  CDS (1)..(2292)
atgaaactttcgttaaaactaattacttatttaagtttaattatttttctagttattagcattgcttacgtatcaatactcgattctaaagttgttaataaattggatggggttttatggacagttcccgcaaaagtatatgccagacccttagaattagctgaaggaggaaagatcaatgtagatagtttaaaaaaggaattggaaatactctcgtatgaactaacaaaaggtattccagatactcctggggagttctcccaaagtcagcggtctgtaaatatattcattagaggttttggatctcaggaaccgggtctatatagattgaagattgagaatgacaaaattgattctataaaaaggaaagatggcatttctatagacctgattcaactcgaaccactttcgataggaggaatgtttccctctcatctacaagacagaatattgttgaatttctcgcaagtgccaaaagatttagaagaaatgatcttagttgtagaagatagaaatttttatagtcacaaagggatatcacttaggtccatcatgagggcttttatcaagaataccagagctctgggtatagaggagggaggaagcacgatcactcaacaattggccaaaagcttgtttttttctcctgaacaaacaataagaaggaagatcaaagaagctattgctgccttgttgatagagatacattattctaaacaagaaattcttctggcttatataaatgatgtttttatagctcaatctggaagacgagcgattcatggttttggtttggcctcacaattcttttttggaaccgacttaaaaaatttaagcttggatcaaaaagccctattagttggcatgttaaaaggcccttctctttatagtccaataaataatcctgacagagctaaaactagaagggatttggttttatctttaataaaaaatgattctcttataactgaagaagagtatctagatttaaagggtagatcccttaaagtgataccaccttcctttaaaagcttatcaaaatatcctgcctttaatgacatagtcactttagacctaagaaagaattttgatgatagtgatttgagaactaaaggattaaaaattattacaaacttagacccagttgtacaagactatcttgaggagagcatcaaggacactaagcttaaacttaaaaggagatatggcagtcaacttaatggattagaaggggcaggaatagttatagattcatttagcggagaagttgtagcggccatagggagtacgaaacctaataattacgggtttaatagggccattaatgccgttcgaccaatcggatctctagttaagccattcatatacttatcggctttgcagcattacagcaaatataacctctctactttgctggatgactcaaagttatcagtttctttacctggaggtaaactgtgggaacccaataattttgataaaaaatttcacggtaatatcccattacatgtggctttatccgagtcttataatgttgctaccacaagactgggaatggatttggggtattctgttgtccaagaaacttttactaagttaggtattaaaaagaaaatacccaagtatccttcaatttttgtgggatcttttgaaatgactcctttagaggctattcaagcttaccaaacaattgcttcagaaggcttttactcgcctctgaattctattcggacagttgagagctctgaagatgtattgtctttgtcttatccttacaaagtggagcaaagatttaggccagaaccaatctaccttttaaaatttttactaaagcaaacttttataagtggaacagctagaggcttttcatcgcgagtcattgaaaaatggaaaacaggaggtaaaaccggaacatcagatgaccaaagggacagttggtttgtgggctacgccggcaattatttgatgctcgtatggttggggtttgacgataacagaaagtctcccctaaccggtagaacgggagccctacaagtctggaaaaactttatgagtagattagatccaatagcttatgaggtcaggaagccttcaagaataagatacgaatgggtagatgcaaaagatggacttttaagtggggagagttgcaaggggtcaattcttataccttttgtagaaggtactgagcccgaaatgattcctcaaaacagaaagaaatgtagaattagtgaagagtcttataccacaaaggttcttaataagataaaagaagccatagaagtaaagtga

SEQ ID NO: 50347 - protein, 763 aa, uncultured bacterium 311
MKLSLKLITYLSLIIFLVISIAYVSILDSKVVNKLDGVLWTVPAKVYARPLELAEGGKINVDSLKKELEILSYELTKGIPDTPGEFSQSQRSVNIFIRGFGSQEPGLYRLKIENDKIDSIKRKDGISIDLIQLEPLSIGGMFPSHLQDRILLNFSQVPKDLEEMILVVEDRNFYSHKGISLRSIMRAFIKNTRALGIEEGGSTITQQLAKSLFFSPEQTIRRKIKEAIAALLIEIHYSKQEILLAYINDVFIAQSGRRAIHGFGLASQFFFGTDLKNLSLDQKALLVGMLKGPSLYSPINNPDRAKTRRDLVLSLIKNDSLITEEEYLDLKGRSLKVIPPSFKSLSKYPAFNDIVTLDLRKNFDDSDLRTKGLKIITNLDPVVQDYLEESIKDTKLKLKRRYGSQLNGLEGAGIVIDSFSGEVVAAIGSTKPNNYGFNRAINAVRPIGSLVKPFIYLSALQHYSKYNLSTLLDDSKLSVSLPGGKLWEPNNFDKKFHGNIPLHVALSESYNVATTRLGMDLGYSVVQETFTKLGIKKKIPKYPSIFVGSFEMTPLEAIQAYQTIASEGFYSPLNSIRTVESSEDVLSLSYPYKVEQRFRPEPIYLLKFLLKQTFISGTARGFSSRVIEKWKTGGKTGTSDDQRDSWFVGYAGNYLMLVWLGFDDNRKSPLTGRTGALQVWKNFMSRLDPIAYEVRKPSRIRYEWVDAKDGLLSGESCKGSILIPFVEGTEPEMIPQNRKKCRISEESYTTKVLNKIKEAIEVK

SEQ ID NO: 50348 - DNA, 2196 bp, Streptococcus pneumoniae
  CDS (1)..(2196)
atgaaattagataaattatttgagaaatttctttctctttttaaaaaagaaacaagtgaactagaggactctgattctactatcttacgtcgctctcgtagtgatcgaaaaaaattagcccaagtaggtccgattcgaaaattctggcgtcgttatcatctaacaaagattatccttatactaggtttgagtgcaggattgctagttggaatctatttgtttgctgtagccaagtcgaccaatgtcaatgatttgcaaaatgccttgaaaactcggactcttatttttgaccgtgaagaaaaagaggctggtgccttgtctggtcaaaagggaacctatgttgagctgactgacatcagtaaaaacttgcagaatgctgttattgcgacagaagaccgttctttctataaaaatgacgggattaactatggccgtttcttcttggctattgtcactgctggacgttcaggtggtggctctaccattacccaacagctggctaaaaacgcctatttatcgcaggatcaaactgttgagagaaaagcgaaagaatttttccttgccttagaattaagcaaaaaatatagtaaggagcaaattctaaccatgtaccttaacaacgcttattttggaaatggtgtgtggggtgtagaagatgcgagtaagaaatactttggagtttctgcatcagaagtgagtctggatcaagctgcgactctggcagggatgctcaaggggccggaactgtataatcccttgaattctgtagaagattctactaatcggcgcgatactgtcttgcagaatatggttgcagcaggatatattgataaaaaccaagaaaccgaagctgctgaagttgatatgacttcgcaattgcacgataagtatgaaggaaaaatctcagattaccgttacccctcttattttgatgcggtggttaatgaagctgtttccaagtataatctaacagaggaagagattgtcaataatggctaccgcatttacacagagctggaccaaaactaccaagcaaatatgcagattgtttatgaaaacatatcgctatttccgagggcagaggatggaacgtttgctcaatcaggaagtgtagctctcgaaccgaaaacagggggagttcgtggagttgtcggtcaagttgctgacaatgataaaactggattccggaatttcaactatgcaacccaatcaaagcgtagtcctggttctacaattaagcctttagttgtttatacgccagcagttgaagcaggctgggctttgaataagcagttggataaccataccatgcagtatgccagctataaggttgataactatgcagggatcaaaacgagtcgagaagttcctatgtatcaagccttggcagaatcgcttaatctacctgctgttgccactgttaatgatttgggtgtcgacaaggcttttgaggcaggcgaaaaattcggactcaacatggaaaaggttgaccgtgttcttggtgtcgccttgggaagcggtgttgaaaccaaccctcttcaaatggctcaagcatacgccgcctttgcaaatgaaggtttaatgcctgaagctcattttattagtagaattgaaaatgctagtggacaagttattgcgagtcataaaaattcacaaaaacgggtgattgataagtctgtagctgacaagatgaccagtatgatgttggggactttcaccaacggtaccggtattagttcatcgcctgcagactatattatggcagggaaaactggaacaactgaagcagtttttaatccggagtacacaagtgaccagtgggtaattggttatactccggatgtagtgattagccactggcttggctttccgaccactgatgaaaaccactatctagctggctctacttcaaacggtgcagctcatgtctttagaaacattgccaataccattttaccttatacgtcaggaagtacctttacggttgaaaatgcttataagcaaaatggaattgcaccagccaatacaaaaagacaagtacaaaccaatgataatagccagacagatgataatttgtctgatattcgagggcgtgcgcaaagtctagtagatgaggctagccgggctatctcagatgcgaagattaaggaaaaggctcaaacaatatgggattcgatagtcaatctatttcgctaa

SEQ ID NO: 50349 - protein, 731 aa, Streptococcus pneumoniae
MKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETEAAEVDMTSQLHDKYEGKISDYRYPSYFDAVVNEAVSKYNLTEEEIVNNGYRIYTELDQNYQANMQIVYENISLFPRAEDGTFAQSGSVALEPKTGGVRGVVGQVADNDKTGFRNFNYATQSKRSPGSTIKPLVVYTPAVEAGWALNKQLDNHTMQYASYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIASHKNSQKRVIDKSVADKMTSMMLGTFTNGTGISSSPADYIMAGKTGTTEAVFNPEYTSDQWVIGYTPDVVISHWLGFPTTDENHYLAGSTSNGAAHVFRNIANTILPYTSGSTFTVENAYKQNGIAPANTKRQVQTNDNSQTDDNLSDIRGRAQSLVDEASRAISDAKIKEKAQTIWDSIVNLFR

SEQ ID NO: 50350 - DNA, 2196 bp, Streptococcus pneumoniae
  CDS (1)..(2196)
atgaaattagataaattatttgagaaatttctttctctttttaaaaaagaaacaagtgaactagaggactctgattctactatcttacgtcgctctcgtagtgatcgaaaaaaattagcccaagtaggtccgattcgaaaattctggcgtcgttatcatctaacaaagattatccttatactaggtttgagtgcaggattgctagttggaatctatttgtttgctgtagccaagtcgaccaatgtcaatgatttgcaaaatgccttgaaaactcggactcttatttttgaccgtgaagaaaaagaggctggtgccttgtctggtcaaaagggaacctatgttgagctgactgacatcagtaaaaacttgcagaatgctgttattgcgacagaagaccgttctttctataaaaatgacgggattaactatggccgtttcttcttggctattgtcactgctggacgttcaggtggtggctctaccattacccaacagctggctaaaaacgcctatttatcgcaggatcaaactgttgagagaaaagcgaaagaatttttccttgccttagaattaagcaaaaaatatagtaaggagcaaattctaaccatgtaccttaacaacgcttattttggaaatggtgtgtggggtgtagaagatgcgagtaagaaatattttggagtttctgcatcagaagtgagtctggatcaagctgcgactctggcagggatgctcaaggggccggaactgtataatcccttgaattctgtagaagattctactaatcggcgcgatactgtcttgcagaatatggttgcagcaggatatattgataaaaaccaagaaaccgaagctgctgaagttgatatgacttcgcaattgcacgataagtatgaaggaaaaatctcagattaccgttacccctcttattttgatgcggtggttaatgaagctgtttccaagtataatctaacagaggaagagattgtcaataatggctaccgcatttacacagatctggaccaaaactaccaagcaaatatgcagattgtttatgaaaacacatcgctatttccgagggcagaggatggaacgtttgctcaatcaggaagtgtagctctcgaaccgaaaacagggggagttcgtggagttgtcggtcaagttgctgacaatgataaaactggattccggaatttcaactatgcaacccaatcaaagcgtagtcctggttctacaattaagcctttagttgtttatacgccagcagttgaagcaggctgggctttgaataagcagttggataaccataccatgcagtatgacagctataaggttgataactatgcagggatcaaaacgagtcgagaagttcctatgtatcaagccttggcagaatcgcttaatctacctgctgttgccactgttaatgatttgggtgtcgacaaggcttttgaggcaggcgaaaaattcggactcaacatggaaaaggtcgaccgtgttcttggtgtcgccttgggaagcggtgttgaaaccaaccctcttcaaatggctcaagcatacgctgcctttgcaaatgaaggtttaatgcctgaagctcattttattagtagaattgaaaatgctagtggacaagttattgcgagtcataaaaattcacaaaaacgggtgattgataagtctgtagctgacaagatgaccagtatgatgttggggactttcaccaacggtaccggtattagttcatcgcctgcagactatattatggcagggaaaactggaacaactgaagcagttttcaatccggagtacacaagtgaccagtgggtaattggttatactccggatgtagtgattagccactggcttggctttccgaccactgatgaaaatcactatctagctggctctacttcaaacggtgcagctcatgtctttagaaacattgccaatactattttaccttatacgccaggaagtacctttacggttgaaaatgcttataagcaaaatggaattgcaccagccaatacaaaaagacaagtacaaaccaatgataatagccagacagatgataatttgtctgatattcgagggcgtgcgcaaagtctagtagatgaggctagccgggctatctcagatgcgaagattaaggaaaaggctcaaacaatatgggattcgatagtcaatctatttcgctaa

SEQ ID NO: 50351 - protein, 731 aa, Streptococcus pneumoniae
MKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETEAAEVDMTSQLHDKYEGKISDYRYPSYFDAVVNEAVSKYNLTEEEIVNNGYRIYTDLDQNYQANMQIVYENTSLFPRAEDGTFAQSGSVALEPKTGGVRGVVGQVADNDKTGFRNFNYATQSKRSPGSTIKPLVVYTPAVEAGWALNKQLDNHTMQYDSYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIASHKNSQKRVIDKSVADKMTSMMLGTFTNGTGISSSPADYIMAGKTGTTEAVFNPEYTSDQWVIGYTPDVVISHWLGFPTTDENHYLAGSTSNGAAHVFRNIANTILPYTPGSTFTVENAYKQNGIAPANTKRQVQTNDNSQTDDNLSDIRGRAQSLVDEASRAISDAKIKEKAQTIWDSIVNLFR

SEQ ID NO: 50352 - DNA, 2160 bp, Streptococcus pneumoniae
  CDS (1)..(2160)
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgccaacggtggaatttaccacaaacccatgtatatcaataaggtcgtcttcagtgacggtagtgaaaaagaattttcagatgtaggtacacgagctatgaaagaaacaactgcttacatgatgaccgaaatgatgaaaactgtcttggcatacggaactggtcgtggagcctatctcccatggttagcgcaagctggtaagacaggtacttctaactacacagatgatgaaattgaaaaacacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctctatgatgacctacctgtctgaaggaagcaatccagaagattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50353 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDSIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEQETGYNLLTTGMDVYTNVDQEAQKHLWDIYNSDQYVSYPDDDLQVASTVVDVSNGKVIAQLGARHQASNVSFGTNQAVETNRDWGSAMKPITDYAPAIEYGVYDSTATMVNDIPYNYPGTSTPVYNWDRAYFGNITLQYALQQSRNVTAVETLNKVGLDRAKTFLNGLGIDYPSMHYANAISSNTTESNKQYGASSEKMAAAYAAFANGGIYHKPMYINKVVFSDGSEKEFSDVGTRAMKETTAYMMTEMMKTVLAYGTGRGAYLPWLAQAGKTGTSNYTDDEIEKHIKNTGYVAPDEMFVGYTRKYSMAVWTGYSNRLTPIVGDGFLVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 50354 - DNA, 2160 bp, Streptococcus pneumoniae
  CDS (1)..(2160)
atgaataaatacattcttatgcgaatattaaagtatactggaatctttttcctaactctctttatcgcattatttctattgggtgggggtgttttcctctattttgtaagcaaagctccagccctatcagatagtaagttagttgcgacaacttctagcaagatttacgacaacaataacgaactcattgccgatctgggctctgaacgccgagtaaacgctcaggccaacgaaatccctactgatttagtcaaagccatcgtgtctatcgaggaccatcgcttctttgatcacagaggggtagatacgattcggatcatgggtgccttcttacgtaacttacaaagcaactctttacaaggagggtcaaccttaacccagcagttgattaagttaacctatttctcaacatcaacttcggatcaaaacctctcccgaaaagcacaagaagcatggttggctgttcaattggaacaaaaagctaccaaacaagaaatccttacctactacatcaataaggtctatatgtcaaatggtaactatggaatgcagacagcagcccaaaattactatggaaaagacttaaaagacctctctctgcctcaattagctttgctagcaggtatgcctcaggcaccaaaccaatacgatccttactctcatccagaatcagcattggagcgtcgtaacttggttctttcagaaatgaaagggcaagattacattagtgctgagcaatatgaaaaagctatcaacacacctatcactgatggtttacaaagtcttaagtcgactgctacttatccagcatatatggataactatctaaaagaggttatcgaccaagtagaacgagaaactggctataaccttctaactactgggatggatgtttacacaaatgtagaccaagaggctcaaaaacgtctgtgggatatctacaactccgagcaatacgtctcttaccctgacgatgatttgcaagtcgcatctacggtcgtagatgtttccaatggtaaagtcatcgcccaacttggagctcgtcaccaagcaagtaacgtttcatttggtaccaaccaagctgtggaaaccaatcgtgactggggttcaacaatgaaaccaatcaccgattatgcacctgccatagaatacggtgtatatgattccactgcaactatggttaatgatattccttataactatccgggaacaagcacacctgtctacaactgggatcgagcatattttggtaatattactctgcaatatgcccttcaacaatcacgtaatgttacagcagttgaaacattaaacaaggttggtttagatcgagccaaaactttcctaaatggcttaggtatcgattacccaagcatacactatgctaacgccatttcaagtaatacaacagaatctaacaaacattacggtgcaagtagtgaaaaaatggctgctgcttatgccgcctttgctaatggtggtatttaccacaaaccaatgtatatcaataaaatcgtctttagtgatggtagtgagaaagaattttctgatgctggtacacgagctatgaaagaaactactgcctatatgatgaccgaaatgatgaaaactgttttagcttacggaaccggacgtggtgcttacctaccatggcttccacaagcaggtaagacaggtacttctaactatactgatgacgaaatcgaaaaacatatcaagaatactggctacgtagctccagatgaaatgtttgtaggctatactcgtaagtattctatggctgtatggactggttactcaaatcgtttaactccaattgttggagatggtttcctagttgctgctaaggtttatcgctcaatgatatcgtatctatcagaagatgaccaacctggagattggacgatgccagacggcctgttccgaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50355 - protein, 719 aa, Streptococcus pneumoniae
MNKYILMRILKYTGIFFLTLFIALFLLGGGVFLYFVSKAPALSDSKLVATTSSKIYDNNNELIADLGSERRVNAQANEIPTDLVKAIVSIEDHRFFDHRGVDTIRIMGAFLRNLQSNSLQGGSTLTQQLIKLTYFSTSTSDQNLSRKAQEAWLAVQLEQKATKQEILTYYINKVYMSNGNYGMQTAAQNYYGKDLKDLSLPQLALLAGMPQAPNQYDPYSHPESALERRNLVLSEMKGQDYISAEQYEKAINTPITDGLQSLKSTATYPAYMDNYLKEVIDQVERETGYNLLTTGMDVYTNVDQEAQKRLWDIYNSEQYVSYPDDDLQVASTVVDVSNGKVIAQLGARHQASNVSFGTNQAVETNRDWGSTMKPITDYAPAIEYGVYDSTATMVNDIPYNYPGTSTPVYNWDRAYFGNITLQYALQQSRNVTAVETLNKVGLDRAKTFLNGLGIDYPSIHYANAISSNTTESNKHYGASSEKMAAAYAAFANGGIYHKPMYINKIVFSDGSEKEFSDAGTRAMKETTAYMMTEMMKTVLAYGTGRGAYLPWLPQAGKTGTSNYTDDEIEKHIKNTGYVAPDEMFVGYTRKYSMAVWTGYSNRLTPIVGDGFLVAAKVYRSMISYLSEDDQPGDWTMPDGLFRNGEFVFKNGARSTWNSPAPQQPPSTESSSSSSDSSTSQSSSTTPSTNNSTTTNPNNNTQQSNTTPDQQNQNPQPAQP

SEQ ID NO: 50356 - DNA, 2112 bp, Streptococcus pneumoniae
  CDS (1)..(2112)
atgaacaaaccaacgattctgcgcctaatcaagtatctgaacattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatgggctacaaagtctcaaatcagcaagtaattaccctgcttacatggataattacctcaaggaagtcatcaatcaagttgaagaagaaacaggctataacctgctcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcatcgcccaacttggagctcgtcaccaagcaagtaacgtttcatttggtaccaaccaagctgtggaaaccaatcgtgactggggttctactatgaaatcaatcactgactatgctcccgctttagaatatggagtctatgactctactgcttctattgtacatgatgttccttataactatcctggaactgatactccactctacaactgggatcatgtctactttggaaacattacaatccagtatgctcttcaacaatcacgaaatgtcacagccgttgagactttgaataaggtcggtctagatagagctaaaacctttcttaatggtcttggtatcgactatccaagcatgcattatgcaaacgccatttcaagtaacacaactgaatccaacaaacagtacggagcaagtagtgaaaaaatggctactgcctacgccgcctttgctaatggtggtatttaccacaaaccaatgtatatcaataaaatcgtcttcagtgatggtagtgaaaaagaattttctgatgctggtacacgagctatgaaagaaactactgcctatatgatgaccgaaatgatgaaaactgttttagcttacggaatcggacgtggtgcttacctaccatggcttccacaagcaggtaagacaggtacttctaactatactgacgacgaaattgaaaagtatatcaagaacactggctacgtagctccagatgaaacgtttgtaggttatactcgtaagtattctatggctgtatggactggttactcaaatcgtttaactccaatcgttggagatggtttcctagttgctgctaaggtttatcgctcaatgatatcgtatctatcagaagatgaccaacctggagattggacaatgccagatggcttgtatagaaatggagaattcgtcttccagaacaacgcaaagaacacatggaataattcagtaacacaacaaacacaaacagtagaaactccaagcacaaataatagtacgactaccaatcctaacaataatacgcaacaatcaaatacaacccctgatcaacaaaatcagaatcctcaaccagcacaaccataa

SEQ ID NO: 50357 - protein, 703 aa, Streptococcus pneumoniae
MNKPTILRLIKYLNISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQASNVSFGTNQAVETNRDWGSTMKSITDYAPALEYGVYDSTASIVHDVPYNYPGTDTPLYNWDHVYFGNITIQYALQQSRNVTAVETLNKVGLDRAKTFLNGLGIDYPSMHYANAISSNTTESNKQYGASSEKMATAYAAFANGGIYHKPMYINKIVFSDGSEKEFSDAGTRAMKETTAYMMTEMMKTVLAYGIGRGAYLPWLPQAGKTGTSNYTDDEIEKYIKNTGYVAPDETFVGYTRKYSMAVWTGYSNRLTPIVGDGFLVAAKVYRSMISYLSEDDQPGDWTMPDGLYRNGEFVFQNNAKNTWNNSVTQQTQTVETPSTNNSTTTNPNNNTQQSNTTPDQQNQNPQPAQP

SEQ ID NO: 50358 - DNA, 2223 bp, Streptococcus gordonii
  CDS (1)..(2223)
atgaaaaagctaaatgatatttttgaaaccttaattcaacattttaagaaagaagattcaccggctgagtctgcggaggagacagatacaagtgctgaaccacgtctgtctcgatccggtcgctcggctaagcgaacatcttcaaaaggccaaggccccttccgacgtttttggcgtagataccatctgaccaagattatcttgattttaggtctgggatttgggctggtgacgggaggttatctcttttatgtggccaagaccaccaatgtcaacgacttgcaaaatgccttgaaggcaactacgatgatctatgataaagatggtcaagaagcgggtagtttgacaggtcaaaaagggacctatgtcgaattggatcagatcagtaaggacttgcagaacgctgtcattgcgaccgaagaccgctccttctacaaaaatagcggaatcaattatggtcgtttcttcttagcaattttgacagcgggccgatcgggcggtggttcgaccatcactcagcagttggccaaaaatgcatatctttctcaggaccagaccattgagcggaaggccaaggagtttttcctagctctagaattaactaaaaaatacagtaaggatcagattctgaccatgtatctgaacaattcttactttggtaatggtgtctggggagtagaggatgccagcaagaaatactttggagtatcagctagccaactgtctctcgatcaagcagctacactggccggaatgctcaaggggcctgagatttacaatcccttgtattcagttgaaaatgcgaccaatcgccgagatacagttctgaataatatggttgcagccggctatattgacaaagcaacagctgatcaagcagcagccaacggtcttggtagccagttggtggatgcctatgctggcaaatccgaagattatcgctatccatcctattttgatgctgttattaacgaagccattcatgactatggtctaaaagaggaagatatcatcaaaaatggctatcgcatctatactgagttggatcaaaactaccaggccagcatgcaggttatttacagtaacgagagtctcttccctgtttcagaagcagatggaacacgagcagaatcgggaagtgtggccttggatcccaagactggaggggtgagagccctggtcggtcgagtcaacagccaggcggccggtttccgttcctttaactatgcaacccagtcagctcgtagtccaggttcgaccattaaaccactggttgtatatagccctgcgatcgctgctggttggtcgaccgataaagagctagacaatactacgacgacctatggatcttatacggtcaataactatggtggcattcaaactagcccgacagtgcctatgtatcaggctttggcggattctctgaatatcccagcggtagcaacagttaaagagttgggtatagagaaagcttttgaatatggtcaaaagtttggtttgaatatgaaaaaggttgagcaaaatctcagtgtagcattgggagcaggtgtgaataccaatcctctccaaatggctcaggcctactccgcttttgcgaatgatggtgtcatgcatgatgcccacttgatcactaagattgaaaacgctagtggtcaaatcgttaagacccacaagtctagctccactcgagtcctcaatcaatcgactgcgaaaaagatgaccagtatgatgttagggaccttctcaaacggaacgggtatctacgcagcgccatataattatacgatggcaggtaagacagggacaactgagacagacttcaaccctgacttatctggagaccagtgggtcatcggctacacacctgatgttgttatcagtcagtggctaggatttccaaagacagatgaaaaccactacctgacaggaaccagtgctaacgaggcttctgtgattttccgaaatgtagccaatagcgtcctgccatacacggaaggaaccaaattctctgaaaagaatacctatgctcaaaatggtattgctccggtagacacctatggcactggaaataccgagaatcaaggtggcaatgatttcttacaggatgtacaggacaaggcaaaagaaatagtcgatcaggctaaaaatgctatcgaagaggcagatattccaggtaaagctaagaatgcttgggatacagtcaagagctggtttggttggtaa

SEQ ID NO: 50359 - protein, 740 aa, Streptococcus gordonii
MKKLNDIFETLIQHFKKEDSPAESAEETDTSAEPRLSRSGRSAKRTSSKGQGPFRRFWRRYHLTKIILILGLGFGLVTGGYLFYVAKTTNVNDLQNALKATTMIYDKDGQEAGSLTGQKGTYVELDQISKDLQNAVIATEDRSFYKNSGINYGRFFLAILTAGRSGGGSTITQQLAKNAYLSQDQTIERKAKEFFLALELTKKYSKDQILTMYLNNSYFGNGVWGVEDASKKYFGVSASQLSLDQAATLAGMLKGPEIYNPLYSVENATNRRDTVLNNMVAAGYIDKATADQAAANGLGSQLVDAYAGKSEDYRYPSYFDAVINEAIHDYGLKEEDIIKNGYRIYTELDQNYQASMQVIYSNESLFPVSEADGTRAESGSVALDPKTGGVRALVGRVNSQAAGFRSFNYATQSARSPGSTIKPLVVYSPAIAAGWSTDKELDNTTTTYGSYTVNNYGGIQTSPTVPMYQALADSLNIPAVATVKELGIEKAFEYGQKFGLNMKKVEQNLSVALGAGVNTNPLQMAQAYSAFANDGVMHDAHLITKIENASGQIVKTHKSSSTRVLNQSTAKKMTSMMLGTFSNGTGIYAAPYNYTMAGKTGTTETDFNPDLSGDQWVIGYTPDVVISQWLGFPKTDENHYLTGTSANEASVIFRNVANSVLPYTEGTKFSEKNTYAQNGIAPVDTYGTGNTENQGGNDFLQDVQDKAKEIVDQAKNAIEEADIPGKAKNAWDTVKSWFGW

SEQ ID NO: 50360 - DNA, 1980 bp, Helicobacter pylori
  CDS (1)..(1980)
atgctaaaaaagattttttatggttttatcgttttatttttgattgtcatggggttgttagccattcttatcgctcaagtttgggtaactacggataaggatattgctaaaattaaagattatcgcccgggcgtcgcttcacagattttagaccgaaaagggcgtttgatcgctaatatttatgataaggaatttcgtttttatgcgcgttttgaagaaatccctccacgatttattgaaagccttttagcggtagaagacactctcttttttgaacatggggggatcaatttagacgctatcatgcgcgccatgattaaaaacgctaaaagcggtcgttacactgaagggggtagcaccctaacccaacaactcgttaaaaacatggtgctcacacgggaaaaaaccctaaccagaaagctcaaagaagctatcatttctttacgcattgaaaaagtcttaagcaaagaagaaattttagagcgttatttgaaccaaactttttttgggcatgggtattatggcgtgaaaaccgcaagcttagggtattttaaaaaaccccttgacaaactcacgcttaaagaaatcaccatgttagtcgccttgccaagggctccgagtttttatgaccctaccaaaaatttagaattttcactctctagggctaatgatattttaaggcggttgtattctttaggctggatttcttctaacgagctcaaaggcgctctcaatgaagtgccaatcgtctataatcaaacttccacgcaaaacatcgccccctatgtcgtagatgaagtgttgaagcaattggatcaattagacgggttaaaaactcaaggctataccataaagctcacgatagatttggattaccaacgcttagcgctagagtccttgcgttttgggcatcaaaaaatcttagaaaaaatcgctaaagaaaagccaaaaactaacgcatctaatgaaaatgaagacaacttaaacgctagcatgatagttacagacacaagcaccggtaagattttagctttagtgggggggattgattataaaaaaagcgctttcaatcgcgccacgcaagccaaacggcagtttgggagcgcgataaagccttttgtgtatcaaatcgcttttgataatggctattccaccacttccaaaatccctgataccgcgcgaaactttgaaaatggcaattatagtaaaaacagcgaacaaaaccacgcatggcaccccagcaattattctcgcaagtttttagggcttgtaaccttgcaagaagccttgagccattcgttaaatctggctacgattaatttaagcgatcagcttggctttgaaaaaatctatcaatctttaagcgatatggggtttaaaaacctccctaaagatttatctattgtgttagggagctttgctatctcacccattgatgcggctgaaaagtattctttattttctaattacggcaccatgctcaaacccatgctcattgaaagcatcactaaccaacaaaacgatgtcaaaactttcacgcctatggaaaccaaaaagatcacttccaaagaacaggcttttttaaccctttcagtgctgatgaatgcggtagaaaatggcacagggagtttggctcgcattaaaggtttagaaatcgccggtaaaaccgggacttctaacaacaatattgacgcctggttcattggctttacccccaccttacaaagcgtgatgtggtttgggagagacgataacacgcctattagcaagggagcgacaggaggcgttgtgagcgcgcctgtgtattcgtatttcatgcgtaacattttagcgattgaaccttctttaaaaagaaagtttgatgtccccaaaggcttgcgtaaagaaatcgtggataaaatcccctactactcaacccctaattccatcacccccacccccaaaagaacagatgatagcgaggaacgcttgttgttctaa

SEQ ID NO: 50361 - protein, 659 aa, Helicobacter pylori
MLKKIFYGFIVLFLIVMGLLAILIAQVWVTTDKDIAKIKDYRPGVASQILDRKGRLIANIYDKEFRFYARFEEIPPRFIESLLAVEDTLFFEHGGINLDAIMRAMIKNAKSGRYTEGGSTLTQQLVKNMVLTREKTLTRKLKEAIISLRIEKVLSKEEILERYLNQTFFGHGYYGVKTASLGYFKKPLDKLTLKEITMLVALPRAPSFYDPTKNLEFSLSRANDILRRLYSLGWISSNELKGALNEVPIVYNQTSTQNIAPYVVDEVLKQLDQLDGLKTQGYTIKLTIDLDYQRLALESLRFGHQKILEKIAKEKPKTNASNENEDNLNASMIVTDTSTGKILALVGGIDYKKSAFNRATQAKRQFGSAIKPFVYQIAFDNGYSTTSKIPDTARNFENGNYSKNSEQNHAWHPSNYSRKFLGLVTLQEALSHSLNLATINLSDQLGFEKIYQSLSDMGFKNLPKDLSIVLGSFAISPIDAAEKYSLFSNYGTMLKPMLIESITNQQNDVKTFTPMETKKITSKEQAFLTLSVLMNAVENGTGSLARIKGLEIAGKTGTSNNNIDAWFIGFTPTLQSVMWFGRDDNTPISKGATGGVVSAPVYSYFMRNILAIEPSLKRKFDVPKGLRKEIVDKIPYYSTPNSITPTPKRTDDSEERLLF

SEQ ID NO: 50362 - DNA, 2184 bp, Staphylococcus aureus
  CDS (1)..(2184)
atgacggaaaacaaaggatcttctcagcctaagaaaaatggtaataatggtgggaaatccaactcaaaaaagaatagaaatgtgaagagaacgattattaagattattggcttcatgattattgcatttttcgttgttcttttactaggtatcttattgtttgcttattatgcttggaaagcacctgcttttaccgaagctaaattacaagatccgattcctgcaaagatatatgacaagaacggagaacttgttaaaacattagataatggccaaagacatgagcatgtaaatttaaaagacgtgccgaaatcaatgaaagacgcagtacttgcaactgaagacaatcgtttctacgaacatggcgcacttgattataaacgtttattcggtgcaattggtaagaacttgactggtggatttggttctgaaggtgcctcaacattaacacaacaagttgttaaagatgcatttttatcacaacataaatctattggacgtaaagctcaagaagcatacttatcatatcgtttagaacaagagtatagtaaagatgatatcttccaagtatatctaaataaaatttactattctgatggcgtaacgggtattaaagctgctgctaagtattactttaataaagatttaaaagatttaaacttagcggaagaagcttatttagccggtttacctcaggttccaaacaactataatatttatgatcatccaaaagctgctgaagatcgtaaaaacactgttttatacttaatgcattatcataaacgcattacagataaacagtggcaagatgctaagaaaatcgatttaaaagcgaacttagtaaatcgtactcctgaagaacgtcaaaacattgatacaaatcaagattctgagtataattcatacgttaactttgtaaaatctgaattaatgaataataaagcattcaaagatgaaaatttaggtaatgtattacaaagtggtattaaaatttatacaaacatggataaagatgttcaaaaaacattacaaaatgatgctgataatggtagcttctacaagaataaagaccaacaagttggtgcaacgattcttgatagtaaaactggtggtttagttgctatatctggtggacgtgatttcaaagacgtcgttaacagaaaccaagcaacagatcctcaccctactggttcatctttaaaacctttcttagcgtatggacctgccattgaaaatatgaaatgggcaacaaaccatgcgattcaagatgaatcttcatatcaagttgatggttctacatttagaaactatgatacgaagagtcacggtactgtatctatttatgatgctttacgacaaagtttcaatatcccagctttaaaagcttggcaatcagttaagcaaaatgctggtaacgatgcacctaagaaattcgctgccaaacttggcttaaactacgaaggcgatattggtccatctgaagtacttggtggttctgcttcagaattctcaccaacacaattagcatcagcatttgctgcaatcgctaacggtggtacttataacaacgcgcattcaattcaaaaagtagttactcgtgatggtgaaacaatcgaatacgatcatactagccataaagcgatgagtgattacactgcatacatgttagctgagatgctaaaaggtacatttaaaccatatggttctgcatatggccatggtgtatctggagtaaatatgggtgctaagacaggtactggtacttacggtgctgaaacttattcacaatataatttacctgataatgcagcgaaagtcgtgtggattaacggctttacacctcaatacactatgtcagtgtggatgggcttcagtaaagttaaacaatatggtgaaaactcatttgtgggacatagccaacaagaatatccacagttcttatatgaaaatgtgatgtcaaaaatttcatctagagatggcgaagactttaaacgtcctagctcagtaagtggtagtatcccatcaatcaatgtttctggtagtcaagataacaacactacaaatcgtagtacacacggtggtagtgacacatcagcaaacagtagtggtactgcacaatcaaataacaatactagatctcaacaatctagaaacagcggtggattaacaggtatattcaactaa

SEQ ID NO: 50363 - protein, 727 aa, Staphylococcus aureus
MTENKGSSQPKKNGNNGGKSNSKKNRNVKRTIIKIIGFMIIAFFVVLLLGILLFAYYAWKAPAFTEAKLQDPIPAKIYDKNGELVKTLDNGQRHEHVNLKDVPKSMKDAVLATEDNRFYEHGALDYKRLFGAIGKNLTGGFGSEGASTLTQQVVKDAFLSQHKSIGRKAQEAYLSYRLEQEYSKDDIFQVYLNKIYYSDGVTGIKAAAKYYFNKDLKDLNLAEEAYLAGLPQVPNNYNIYDHPKAAEDRKNTVLYLMHYHKRITDKQWQDAKKIDLKANLVNRTPEERQNIDTNQDSEYNSYVNFVKSELMNNKAFKDENLGNVLQSGIKIYTNMDKDVQKTLQNDADNGSFYKNKDQQVGATILDSKTGGLVAISGGRDFKDVVNRNQATDPHPTGSSLKPFLAYGPAIENMKWATNHAIQDESSYQVDGSTFRNYDTKSHGTVSIYDALRQSFNIPALKAWQSVKQNAGNDAPKKFAAKLGLNYEGDIGPSEVLGGSASEFSPTQLASAFAAIANGGTYNNAHSIQKVVTRDGETIEYDHTSHKAMSDYTAYMLAEMLKGTFKPYGSAYGHGVSGVNMGAKTGTGTYGAETYSQYNLPDNAAKVVWINGFTPQYTMSVWMGFSKVKQYGENSFVGHSQQEYPQFLYENVMSKISSRDGEDFKRPSSVSGSIPSINVSGSQDNNTTNRSTHGGSDTSANSSGTAQSNNNTRSQQSRNSGGLTGIFN

SEQ ID NO: 50364 - DNA, 1983 bp, Helicobacter pylori
  CDS (1)..(1983)
atgctaaaaaagattttttatggttttatcgttttatttttaattatcgtagggttgttagccattcttatcgctcaagtttgggtgagcacaaataaggatattgctaaaattaaagattatcgcccgagcgtcgcttcacagattttagacagaaaagggcgtttgatcgctaatatctatgataaggaattccgtttttatgtgcgttttgaagaaatccccccacgatttattgaaagccttttagcggtagaagacaccctcttttttgaacatggggggatcaatttagacgctatcatgcgcgctatgattaaaaacgctaaaagcggtcgttacaccgaggggggtagcaccctaacccaacaactcgttaaaaacatggtgctcacacgagaaaaaaccctaaccagaaaactcaaagaagctatcatttccatacgcattgaaaaagtcttaagcaaagaagaaattttagagcgctatttgaaccaaactttttttgggcatgggtattatggcgtcaaaaccgcaagtttagggtattttaaaaaaccccttgacaaactcacgcttaaagaaatcaccatgttagtcgccctgcctagggctccaagtttttatgaccctaccaaaaatttagaattttcactctctagggctaatgatattttaaggcggttgtattctttaggctggatttcttctaacgagctcaaaggcgctctcaatgaagtgccaatcgtctataaccaaacttccacgcaaaacatcgctccctatgtcgtggatgaagtgttgaaacaattggatcaattagacgggttaaaaactcaaggctataccataaagctcacgatagatttggattaccaacgcttagcgttagagtccttgcgttttgggcatcaaaaaatcttagaaaaaatcgctaaagaaaagccaaaaactaacgcctctaatgaagatgaagacaacttgaacgctagcatgatagttacagacacaagcaccggtaagattttagctttagtaggggggattgattataaaaaaagcgcttttaatcgcgccacgcaagccaaacggcaatttgggagcgcgataaagccttttgtgtatcaaatcgcttttgataatggctattccacgacttctaaaatccctgataccgcgcgaaattttgaaaatggcaattatagcaaaaacagcgaacaaaaccacgcatggcaccctagcaattattctcgcaagtttttagggcttgtaaccttacaagaagctttgagccattcgttaaatctagccacgatcaatttaagcgatcagcttggctttgaaaaaatttatcaatctttaagcgatatggggtttaaaaacctccctaaagaagacttgtctattgtgttagggagctttgctatctcaccgattgaagcggccgaaaagtattctttattttctaattacggcaccatgctcaaacccatgctcattgaaagcatcactgaccaacaaaacgatgtcaaaactttcacgcccatggaaactaaaaagatcacttctaaagaacaggcttttttaaccctttcagtgctgatgaatgcggtagaaaacggcacggggagtttggctcgcattaaaggtttagaaattgccggtaaaagcgggacttctaacaactatattgatgcttggttcattggctttacccccaccttacagagcgtgatctggtttgggagagacgataacacacctattggcaaaggagcggcaggaggcgttgtgagtgcgcctgtgtattcgtatttcatgcgcaatattttagcgattgaaccttctttaaaaagaaagtttgatgtccccaaaggtctgcgtaaagaaatcgtggataaaatcccctactactcaacccctaattccatcacccccaccccacaaaaaaccgacgatggtgaagaacccttattgttctaa

SEQ ID NO: 50365 - protein, 660 aa, Helicobacter pylori
MLKKIFYGFIVLFLIIVGLLAILIAQVWVSTNKDIAKIKDYRPSVASQILDRKGRLIANIYDKEFRFYVRFEEIPPRFIESLLAVEDTLFFEHGGINLDAIMRAMIKNAKSGRYTEGGSTLTQQLVKNMVLTREKTLTRKLKEAIISIRIEKVLSKEEILERYLNQTFFGHGYYGVKTASLGYFKKPLDKLTLKEITMLVALPRAPSFYDPTKNLEFSLSRANDILRRLYSLGWISSNELKGALNEVPIVYNQTSTQNIAPYVVDEVLKQLDQLDGLKTQGYTIKLTIDLDYQRLALESLRFGHQKILEKIAKEKPKTNASNEDEDNLNASMIVTDTSTGKILALVGGIDYKKSAFNRATQAKRQFGSAIKPFVYQIAFDNGYSTTSKIPDTARNFENGNYSKNSEQNHAWHPSNYSRKFLGLVTLQEALSHSLNLATINLSDQLGFEKIYQSLSDMGFKNLPKEDLSIVLGSFAISPIEAAEKYSLFSNYGTMLKPMLIESITDQQNDVKTFTPMETKKITSKEQAFLTLSVLMNAVENGTGSLARIKGLEIAGKSGTSNNYIDAWFIGFTPTLQSVIWFGRDDNTPIGKGAAGGVVSAPVYSYFMRNILAIEPSLKRKFDVPKGLRKEIVDKIPYYSTPNSITPTPQKTDDGEEPLLF

SEQ ID NO: 50366 - DNA, 1980 bp, Helicobacter pylori
  CDS (1)..(1980)
atgctaaaaaagattttttatggttttatggttttggttttaattatcatagggttattggccattcttatcgctcaagtctgggtaactacggataaggatattgccaaaattaaagattatcgcccgggcgtcgcttcacagattttagaccgaaaagggcgtttgatcgctaatatttatgataaggaatttcgtttttatgcgcgttttgaagaaatccccccacgatttattgaaagccttttagcggtagaagacaccctcttttttgagcatggggggatcaatttggacgctatcatgcgcgctatgattaaaaacgctaaaagcggtcgttacaccgaagggggtagcactctaacccaacaactcgttaaaaacatggtgctcacacgagaaaaaaccctgaccagaaagctcaaagaagccatcatttctatacgcattgaaaaagtcttaagcaaagaagaaattttagagcgttatttgaaccaaactttttttgggcatgggtattatggcgtgaaaaccgcaagtttagggtattttaaaaaaccccttgacaaactcacgcttaaagaaatcaccatgttagtcgccttacctagggctccgaatttttatgatcctaccaaaaatttagaattttcactctctagggctaatgatattttaaggcggttgtattctttaggctggatttcttctaacgagctcaaaggcgctctcaatgaagtgccaatcgtctataaccaaacttccacgcaaaatatcgctccctatgttgtagatgaagtgttgaagcaattggatcaattagacgggttaaaaactcaaggctataccataaaactcacgatagatttggattaccaacgcttagcgttagagtccttgcgttttgggcatcaaaaaatcttagaacaaatcgctaaagaaaagccaaaaactaacgcatctaatgaagatgaagacaacttgaacgccagcatgatcgttacagacacgagcaccggtaagattttagctttagtgggggggattgattataaaaaaagcgctttcaatcgcgccacgcaagccaaacggcagtttgggagcgcgataaagccttttgtgtatcaaatcgcttttgataatggctattccacgacttctaaaatccctgataccgcgcgaaactttgaaaatggcaattatagtaaaaacagcgcgcaaaaccacgcatggcaccccagaaattattctcgcaagtttttagggcttgtaaccttgcaagaagccttgagccattcgttaaatctggctacgatcaatttaagcgatcagcttggctttgaaaaaatttatcaatctttaagcgatatggggtttaaaaacctccctaaagacttgtctatcgtgttagggagctttgctatctcacccattgatgtggctgaaaagtattctctattttctaattacggctccatgctcaaacccatgctcattgaaagcattaccgatcagcaaaacaatatcaaaactttcacgcccattgaaaccaaaaagatcacctccaaagaacaggcttttttaaccctttcagtactgatgaatgcggtagaaaatggcacagggagtttggctcgcattaaaggcttggaaatcgctggtaaaacggggtcttctaacaactatattgacgcttggttcattggctttacccccaccctacaaagcgtgatctggtttgggagagacgataacacgcctattggcaaaggagcgacaggaggcgttgtgagtgcacctgtgtattcgtacttcatgcgtaatattctaagcattgaaccttctttaaaaagaaagtttgatgtccccaaaggattgcgtaaagaaatcgtggataaaatcccttactattcaacccccaattccatcacccccacccccaaaagaacagacgatagcgaagaacccttattattctaa

SEQ ID NO: 50367 - protein, 659 aa, Helicobacter pylori
MLKKIFYGFMVLVLIIIGLLAILIAQVWVTTDKDIAKIKDYRPGVASQILDRKGRLIANIYDKEFRFYARFEEIPPRFIESLLAVEDTLFFEHGGINLDAIMRAMIKNAKSGRYTEGGSTLTQQLVKNMVLTREKTLTRKLKEAIISIRIEKVLSKEEILERYLNQTFFGHGYYGVKTASLGYFKKPLDKLTLKEITMLVALPRAPNFYDPTKNLEFSLSRANDILRRLYSLGWISSNELKGALNEVPIVYNQTSTQNIAPYVVDEVLKQLDQLDGLKTQGYTIKLTIDLDYQRLALESLRFGHQKILEQIAKEKPKTNASNEDEDNLNASMIVTDTSTGKILALVGGIDYKKSAFNRATQAKRQFGSAIKPFVYQIAFDNGYSTTSKIPDTARNFENGNYSKNSAQNHAWHPRNYSRKFLGLVTLQEALSHSLNLATINLSDQLGFEKIYQSLSDMGFKNLPKDLSIVLGSFAISPIDVAEKYSLFSNYGSMLKPMLIESITDQQNNIKTFTPIETKKITSKEQAFLTLSVLMNAVENGTGSLARIKGLEIAGKTGSSNNYIDAWFIGFTPTLQSVIWFGRDDNTPIGKGATGGVVSAPVYSYFMRNILSIEPSLKRKFDVPKGLRKEIVDKIPYYSTPNSITPTPKRTDDSEEPLLF

SEQ ID NO: 50368 - DNA, 2382 bp, Enterococcus hirae
  CDS (1)..(2382)
atggcaaatgagcaaacaagaacttccagacgaaacagtccctcttcttctaaaaagacgagtcaaacaagaaataaaacttctggcaaaggttccgggcataagaagcgtgggcttttcatctgtatcatcttgattttattttctttgatttgtatcgctttcctagccggtgtcggattattttggttttatgcaaaagatgctccaaaattaacggacactgcattagatgcgactgtttcttctaaactttacacacaaaatggcgaattatttgaagatttaggagcagaaaaaagagaaaagattaccgcaaacgaattgccgaaaacgttagaaaacgccatcgtttctgttgaagatcgacgtttctataaacatatcgggatcgacccagttcggatcgtcggctctgcactttctaactttacttctggcggacttcaaggtggtagtacattgacccaacaattgattaagctctcctacttctctaccaacgcttcagatcaaaccttgaaacgaaaagcacaagaagcttggttagctgtaaaattagaacaacaaaaatcaaaacaagaaatattgacttactatgtgaacaaagtctatatgtccaacggattatacggaatggaaacggcagcagaaaattattttggtaaaagattaccagaactttcattaccacagactgctttgttagctggaatgccacaagcgccttctgcctatgacccataccaatatccagaacaagccaaaaaacggcgagatactgttttatataccatgttacaaaacaagaaaatctctcaatcagaatatgatgctgcagtgaatacaccaatcgatgatggtcttcaagagatgaaaaaagaagatgataattcaaaaatcgttgataattatgtcaaagaagtcatcaatgaagttcaagaaaaaacggataaaaatgtatttactgatggattggatatctatactaacttagatctagacgcacaaaaacatctttatgatattgtcaacactgatgactatgtcaactatccagatgatgaaatgcaagttgcttctacgttgatcgatgtcaatactggtcaagtaaaagcacaaattggcggtcgccatattgcagaagatgtcacactaggtatgaacttagctgttaatacttctcgtgacttcggttcgacaatgaaaccagtcacagattatggcccagcttttgaatatctaaaatactctacaggaaaaacgatcagtgatgctccttataactatgaaggaacctcaacaccagtaggcaactgggataaccgttttatggggacgatcaccttaagacaagccttgtatctttccagaaacgttccagctgtcaaattgttcaatgaagtcggcgcagataaagttagcacctttttaaaagatcttggaattgaatatagtacgatccatcaatcaaatgcgatttcaagtaacacagaaaaacaagacggcacaaaatatggcgcttcttccttgaaaatggcggctgcctatgctgctttcgctaatggaggaacgtattataaaccacaatatgtcaataagatcgtcttccaagacggcacagaagaaacgttcgatcccgatggtaatacagctatgtctccagaaacagcctatatggtcacagatattttaaaagatacattaacaaaaggaactgggacgaatgcgttgattcctggattataccaagctggaaaaaccgggacttccaactatacggatgatgagtacgcaaaattaggaacttctagcggtgtgtatcctgatattttatttgctggttatacaccaaactacgccatctcagtatggaccggttataacaacaaaatgacacctgtcacctctgcttcgtctcatgttgcttctgatgtttatcgagaattaatgaaatatgtatcatccagcgtcacaaatagcgattggcaaatgcctagcggactggtaagatctggcggtgaattatactttaccaatcaactcaagaaaacaccaagtacgacgatcccttcaacaacggtgccatcttcatcagtgacactggtacctgaaagttcgacaccggtatcttcttcgtcggaatcgacagaaacttcaacaactgagtcatctgccgaatcttcgacatcggtagatagttcaagtgacaaaagtgattcaagtagttcagctgaaacgccagaaaatagcagcagtagtcaaagctcttcatcttcggcaactcctgagtcatccacgacaccaccagcgcaaacacctccggagaacaatgcacagtccggacagtcctctagtcgttcaacgtcttctggcacataa

SEQ ID NO: 50369 - protein, 793 aa, Enterococcus hirae
MANEQTRTSRRNSPSSSKKTSQTRNKTSGKGSGHKKRGLFICIILILFSLICIAFLAGVGLFWFYAKDAPKLTDTALDATVSSKLYTQNGELFEDLGAEKREKITANELPKTLENAIVSVEDRRFYKHIGIDPVRIVGSALSNFTSGGLQGGSTLTQQLIKLSYFSTNASDQTLKRKAQEAWLAVKLEQQKSKQEILTYYVNKVYMSNGLYGMETAAENYFGKRLPELSLPQTALLAGMPQAPSAYDPYQYPEQAKKRRDTVLYTMLQNKKISQSEYDAAVNTPIDDGLQEMKKEDDNSKIVDNYVKEVINEVQEKTDKNVFTDGLDIYTNLDLDAQKHLYDIVNTDDYVNYPDDEMQVASTLIDVNTGQVKAQIGGRHIAEDVTLGMNLAVNTSRDFGSTMKPVTDYGPAFEYLKYSTGKTISDAPYNYEGTSTPVGNWDNRFMGTITLRQALYLSRNVPAVKLFNEVGADKVSTFLKDLGIEYSTIHQSNAISSNTEKQDGTKYGASSLKMAAAYAAFANGGTYYKPQYVNKIVFQDGTEETFDPDGNTAMSPETAYMVTDILKDTLTKGTGTNALIPGLYQAGKTGTSNYTDDEYAKLGTSSGVYPDILFAGYTPNYAISVWTGYNNKMTPVTSASSHVASDVYRELMKYVSSSVTNSDWQMPSGLVRSGGELYFTNQLKKTPSTTIPSTTVPSSSVTLVPESSTPVSSSSESTETSTTESSAESSTSVDSSSDKSDSSSSAETPENSSSSQSSSSSATPESSTTPPAQTPPENNAQSGQSSSRSTSSGT

SEQ ID NO: 50370 - DNA, 2148 bp, Mycobacterium smegmatis
  CDS (1)..(2148)
gtgcgacgcggttctgcgatcgccgtcgccgtgatggtgctgctgccgctgatcaccttcggcatggcgtacatgatcgtcgacgtccccgagcccggcgacatccgtacgccgcaggtgtcgacgatcctcgcgagcgacggcagcgagatcgcgcggatcgtgccgccggaaggcaaccgggtcgacgtcaagatcgaccagatcccggtgcatgttcgcgacgcggtgatggccgccgaggaccgtgacttctactcgaatccgggcttctcgtggaccggcttcctgcgcgcgatcaagaacaacctgttcggtggcggtggtctgcagggtggatcgaccatcacgcagcagtacgtcaagaacgcgctggtcggtgacgagcggtccggtatcggcggtttgatccgcaaggccaaggagctggtcatctcgaccaagatgtccggcgaatggtccaaggacgccgtgctgcaggcctacctcaacatcatctacttcggccgcggcgcctatgggatctcggcggcgtccaaggcgtacttcgacaaacccgtcgagcagctcgacgtcgccgagggggccctgctggccgcgctgatccagcggccgtcgaccctggatcccgcggtggatcccgaaggtgccgccgaccggtggaactgggtgctcgacggcatggtcgacatcggggcgctgtcgcaggccgaccgcgacgcgcaggtgttcccgccgacggtgccccccgactacgccttccagcagaaccagacgacgggccccaacggtctgatcgagcgccaggtcaccaacgagctgctggacctcttcgacatcaacgagcagacgttgaacaccgagggtctgcagatcaccaccacgatcgaccccaaggctcaggaggccgcggtcgacgccgtcgacaagtacctcgaaggccaggacccggacatgcgggcggcggtcgtgtcgatcgacccgcgcaccggaggcatcaaggcgtactacggcggttccgacgccaacgggttcgacttcgcgcaggcgggcctgccgacgggttcgtcgttcaaggtgttcgcgctcgtcgcggcgctgcagcagggcatcggcctgggctatcagatcgacagcggaccgctcgaggtcaacggaatcaagatcggcaacgtcgagggtgaaggctgcggaacctgctcgatcgccgaggcgctcaagcggtcgctgaacaccagctactaccggctcatgctcaagctggagaacggcccggccgacgtcgccgaggccgcgcacgacgcgggtgtcgccgagagcttccccggcgtcgagcacacgctgagcgaggacggcaagggcggcccgcccaacaacggtgtggtgctgggccagtaccagtcacgcgtgctggacatggcgtcggcgtacgccacgctcgcggcgtcaggcgtctaccacaagccgcacttcgtggagaaggtcgtcaactcctccgggcaggtgctgttcgacgcctccaaagaggacaacggcgaagaacgcatcgacaaggccgttgccgacaacgtgacgtcggccatgcaacccatcgcaggctggtcgcggggccacaacctggccggcggacgcccgtcggcggccaagaccggcaccgtccagctcggcgacaccggcgacaaccgcgacgcctggatggtcggctacacgccgtcgctgtccaccgcggtgtgggtcggcaccaccgagggcgtcaagccgctggtcaacaagtggggttcgccgatctacgggtccgggctgccgtcggacatctggaaggccacgatggacggcgccctggagggcaccgacgtcgagtccttccccaagcccaccgagatcggtggctacgccggtgtgccacaggccccggccgcgccgccgccgtcggcaggcccgccgaccgatccggggcagccctcggtgaccgtgatccagccgaccatcgaggtggcgccgggcatcacgatcccgatcggcccgccgaccaccgtgccggtcggacccccgccgggcgcacctggtgctcccgtcggccccggcgcgcccgaggtccccgtggcgcctggtgccccaggcgtccccggagccccgccgcctccgtga

SEQ ID NO: 50371 - protein, 715 aa, Mycobacterium smegmatis
MRRGSAIAVAVMVLLPLITFGMAYMIVDVPEPGDIRTPQVSTILASDGSEIARIVPPEGNRVDVKIDQIPVHVRDAVMAAEDRDFYSNPGFSWTGFLRAIKNNLFGGGGLQGGSTITQQYVKNALVGDERSGIGGLIRKAKELVISTKMSGEWSKDAVLQAYLNIIYFGRGAYGISAASKAYFDKPVEQLDVAEGALLAALIQRPSTLDPAVDPEGAADRWNWVLDGMVDIGALSQADRDAQVFPPTVPPDYAFQQNQTTGPNGLIERQVTNELLDLFDINEQTLNTEGLQITTTIDPKAQEAAVDAVDKYLEGQDPDMRAAVVSIDPRTGGIKAYYGGSDANGFDFAQAGLPTGSSFKVFALVAALQQGIGLGYQIDSGPLEVNGIKIGNVEGEGCGTCSIAEALKRSLNTSYYRLMLKLENGPADVAEAAHDAGVAESFPGVEHTLSEDGKGGPPNNGVVLGQYQSRVLDMASAYATLAASGVYHKPHFVEKVVNSSGQVLFDASKEDNGEERIDKAVADNVTSAMQPIAGWSRGHNLAGGRPSAAKTGTVQLGDTGDNRDAWMVGYTPSLSTAVWVGTTEGVKPLVNKWGSPIYGSGLPSDIWKATMDGALEGTDVESFPKPTEIGGYAGVPQAPAAPPPSAGPPTDPGQPSVTVIQPTIEVAPGITIPIGPPTTVPVGPPPGAPGAPVGPGAPEVPVAPGAPGVPGAPPPP

SEQ ID NO: 50372 - DNA, 2160 bp, Streptococcus pneumoniae
  CDS (1)..(2160)
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaggaaagaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacggcagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctcaatgataacgtatctatcagaagatactcatccagaagactggacgatgccagacggacttttcagaaacggggaatttgtattcaaaaatggagctcgcccaatatggactgaaccctctactcaacaatcctcaacagctgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50373 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDSIRILGAFLRNLQSNSLQGGSTLTQQLIKLTYFSTSTSDQTISRKAQEAWLAIQLEQKATRKEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEQETGYNLLTTGMDVYTNVDQEAQKHLWDIYNSDQYVSYPDDDLQVASTVVDVSNGKVIAQLGARHQASNVSFGTNQAVETNRDWGSAMKPITDYAPAIEYGVYDSTATMVNDIPYNYPGTSTPVYNWDRAYFGNITLQYALQQSRNVTAVETLNKVGLDRAKTFLNGLGIDYPSMHYANAISSNTTESNKQYGASSEKMAAAYAAFANGGTYYKPMYIHKVVFSDGSKKEFSNVGTRAMKETAAYMMTDMMKTVLTYGTGRGAYLPWLPQAGKTGTSNYTDEEVENHIKNTGYVAPDEMFVGYTRKYSMAVWTGYSNRLTPIVGDGFLVAAKVYRSMITYLSEDTHPEDWTMPDGLFRNGEFVFKNGARPIWTEPSTQQSSTAESSSSSSDSSTSQSSSTTPSTNNSTTTNPNNNTQQSNTTPDQQNQNPQPAQP

SEQ ID NO: 50374 - DNA, 2160 bp, Streptococcus pneumoniae
  CDS (1)..(2160)
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaagcaatcgtttctatcgaagaccatcgcttcttcgaccacagggggattgataccatccgtatcctgggagctttcttgcgcaatctgcaaagcaattccctccaaggtggatcaactctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacggctgcccaaaactattacggcaaagatttgagagaactatcactacctcaacttgccctactagcaggaatgccacaggctccgaatcaatacgatccctattctcatccagaagctgcccttgaccgtcgtaacttggtactttcagagatgaaaggtcaaggctacatttctgccgaacagtatgagaaggctatcaatacccctattactgatggactccaaagtttgaaatcagtcaatagctatccagcatatatggacaattatctcaaagaggttatcgaccaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatccacggtcgtagatgtttcaaatggtaaagtcatcgcccaacttggagctcgtcaccaagcaagtaacgtttcatttgggaccaaccaagctgtggaaaccaatcgtgactggggttcaacaatgaaaccaatcaccgattatgcacctgccatagaatacggtgtatatgattccactgcaactatggttaatgatattccttataactatccgggaacaagcacacctgtctacaactgggatcgagcatattttggtaatattactctgcaatatgcccttcaacaatctcgtaacgtacctgccgttgagacactaaacaaggttggtttagatagagccaaaaacttcctaaatggtttaggaattgactatccagatatgcattattctaacgccatatcaagtaacacaactgaatccaacaaacagtacggtgcaagtagtgaaaaaatggctgctgcttttgccgcctttgctaatggtggtatttaccacaaaccaatgtatatcaataaaatcgtctttagtgatggtagtgaaaaagaattttctgatgctggtacacgagctatgaaagaaactactgcctatatgatgaccgaaatgatgaaaacagtcttgagttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50375 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLRELSLPQLALLAGMPQAPNQYDPYSHPEAALDRRNLVLSEMKGQGYISAEQYEKAINTPITDGLQSLKSVNSYPAYMDNYLKEVIDQVEQETGYNLLTTGMDVYTNVDQEAQKHLWDIYNSDQYVSYPDDDLQVASTVVDVSNGKVIAQLGARHQASNVSFGTNQAVETNRDWGSTMKPITDYAPAIEYGVYDSTATMVNDIPYNYPGTSTPVYNWDRAYFGNITLQYALQQSRNVPAVETLNKVGLDRAKNFLNGLGIDYPDMHYSNAISSNTTESNKQYGASSEKMAAAFAAFANGGIYHKPMYINKIVFSDGSEKEFSDAGTRAMKETTAYMMTEMMKTVLSYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWSSPAPQQPPSTESSSSSSDSSTSQSSSTTPSTNNSTTTNPNNNTQQSNTTPDQQNQNPQPAQP

SEQ ID NO: 50376 - DNA, 2160 bp, Streptococcus pneumoniae
  CDS (1)..(2160)
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcactcaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatggactacaaagtctcaaatcagcaagtaattaccctgcttacatggataattacctcaaggaagtcatcaatcaagttgaagaagaaacaggctataacctgctcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatacccctgtttataactgggataggggctactttggcaacatcaccttgcaatacgccctgcaacaatcgcgaaacgtcccagccgtggaaactctaaacaaggtcggactcaaccgcgccaagactttcctaaatggtctcggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgaaatgatgaaaacagtcttgagttatggaactggacgaaatgcctatcttgcttggctccctcaggctggtaaaacaggaacctctaactatacagatgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctatctgtctgaaggaagcaatccagaggattggaatataccagaggagctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50377 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGVYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTEMMKTVLSYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEELYRNGEFVFKNGARSTWNSPAPQQPPSTESSSSSSDSSTSQSSSTTPSTNNSTTTNPNNNTQQSNTTPDQQNQNPQPAQP

SEQ ID NO: 50378 - DNA, 2160 bp, Streptococcus pneumoniae
  CDS (1)..(2160)
atgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgattccatccgtatcctgggagctttcttgcgcaatctgcaaagtaattccctccaaggtggatcaactctcacccaacagttgattaagttgacttacttttcaacctcgacttccgaccagactatttctcgtaaggctcaggaagcttggttagcgattcagttagaacaaaaagcaaccaaacaggaaatcttgacctactatataaataaggtctacatgtctaatggcaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggttacatctctgctgaacagtatgagaaagcagtcaatacaccaattactgatggactacaaagtctcaaatcagcaagtaattaccctgcttacatggataattacctcaaggaggtcatcaatcaagtagaacaagaaactggctataaccttctaactactgggatggatgtttacacaaatgtagaccaagaagctcaaaaacatctgtgggatatctacaactccgatcaatacgtctcttaccctgacgatgatttgcaagtcgcatctacggtcgtagatgtttcaaatggtaaagtcatcgcccaacttggagctcgtcaccaagcaagtaacgtttcatttggtaccaaccaagctgtggaaaccaatcgtgactggggttctgctatgaaaccaatcaccgattatgcacctgccatagaatacggtgtttatgattccactgcaactatggttaatgatattccttataactatccgggaacaagcacacctgtctacaactgggatagagcatatttcggtaatattactctgcaatatgctcttcaacaatcacgaaatgtcacagccgttgagactttgaataaggtcggtctagatagagctaaaaccttccttaatggtcttggtatcgactatccaagcatgcattatgcaaacgccatttcaagtaatacaacagaatctaataaacaatacggagcaagtagtgaaaaaatggctgctgcttatgctgcctttgcaaatggtggcacttactataaaccaatgtatatccataaagtcgtcttcagtgatggaagtaaaaaagagttctctaatgtcggaactcgtgccatgaaggaaacgacagcctatatgatgaccgacatgatgaaaacagtcttgacttatggaactgggcgtggagcctatcttccttggcttcctcaagctggtaaaacaggaacctctaactatacagatgaggaagttgaaaaccacatcaagaacactggctatgtagctccagatgaaatgtttgttggttatactcgtaagtattctatggctgtatggacaggttattcgaatcgtttaactcctatcgttggagatggtttcctagttgcagctaaagtttatcgctctatgatgacctacctgtctgaaggaagcaatccagaggattggaatataccagaggggctctacagaaatggagaattcgtatttaaaaatggtgctcgttctacgtggagctcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 50379 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDSIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEQETGYNLLTTGMDVYTNVDQEAQKHLWDIYNSDQYVSYPDDDLQVASTVVDVSNGKVIAQLGARHQASNVSFGTNQAVETNRDWGSAMKPITDYAPAIEYGVYDSTATMVNDIPYNYPGTSTPVYNWDRAYFGNITLQYALQQSRNVTAVETLNKVGLDRAKTFLNGLGIDYPSMHYANAISSNTTESNKQYGASSEKMAAAYAAFANGGTYYKPMYIHKVVFSDGSKKEFSNVGTRAMKETTAYMMTDMMKTVLTYGTGRGAYLPWLPQAGKTGTSNYTDEEVENHIKNTGYVAPDEMFVGYTRKYSMAVWTGYSNRLTPIVGDGFLVAAKVYRSMMTYLSEGSNPEDWNIPEGLYRNGEFVFKNGARSTWSSPAPQQPPSTESSSSSSDSSTSQSSSTTPSTNNSTTTNPNNNTQQSNTTPDQQNQNPQPAQP

SEQ ID NO: 50380 - DNA, 2181 bp, Aquifex aeolicus
  CDS (1)..(2181)
atgaaaaagttagtaataggtattttaggaatagttatagccttatttgtcggactgcttgtcttcctcatacccatctacaaaaaccttcccgatccgaaactcttggagagctggacaccgcctcaagcctcggaggtttacgatgcaaagggaaggttgtacgggacgataggcatccagaagaggttttacgtgagtatagacaaaattcccgaacacgttataaacgccttcgttgcgactgaggacagaaacttctggcatcacttcgggattgaccctgtggcaatagtaagggctgcaattgtgaactacagagccggcaggatagttcagggaggtagtacgataacccagcaactcgctaaaaacttattcctaactagagaaaggacactggagagaaagataaaggaggcactccttgccataaagattgagagaacctttgacaaaaagaagataatggaattgtatttaaaccagatatatctagggagcggagcttacggcgttgaagcggcagctcaggtatacttcggaaaacacgtttgggaactttccttagatgaggcagcgctcctagcagctctgccaaaagcccccgcaaagtacaaccccttttaccaccccgagagggcactccagagaagaaatctcgtactgaaacggatgctagaagaaggttatatcactccagagcagtacgaggaggcggtgaataaacccctgacggtaaaaaaagaaaacaagtacaaattctccgattacttcctcgatatggtgaagagttacgtttttaacaagtatggggaaattgcatataagggcaggttaaagatatacacaacgatagatttggactaccagaaaatcgctcaaaaatcgcttgaggaaggtttgaagagagtagcaaagattataggacttcctttccttccaaagtccgaagaagatatggagctcgcttatgagaaagaagcacagttaaagagattaaaaagaggaaagatctacgtagctaagatcttgaagtacgacggaaatttcatgaaagtagaaatccacggcaaaaaattaaagggagaaataaaagggcttaacaccgaaggacataagtatgttttcgtgaaatacctcggaggaaatagggcggagataattcctgaccttgaggggagtttagtcagcatagacgtaaaaactggagaaataaaggctatagtgggaggaaggagttacgcctactctcagttcaacagagctgtaaaagccctaagacaacccggttcagctataaagcccgtgatatacctgtccgcacttctgaagggaatgactcaaatttccacgattgacgcttcttccaaaccgtactacgacccctcaaagggcgaagactggattcccaaaaactatgacgaaaaagaatacggaaacgttaccctcaggtatgctcttgcacacagtataaataccgcggcagtaaacttgctggacaaagtgggttttgaactagtcctggaagttggcaagaaagtaggattagacaatttaaaaccttactactctttagctctgggaacggtagaggtcacgcccctgcaactcactgcggcttatcaagtctttgcaaacctcggaacggagtgtaaacctttctttataaagaagatagtggatgaaaacggagaagtgctagaagaaaacgtaccagagtgtgaggaagtccttccaaagcctgaaacgagagtacccgtggatatgctcagagccgtggtgctggaaggtacagcgaggagggcgagtgtactggacaggatagtagccggaaaaacgggaactaccgacgattttcaggatgcatggtttgtaggcttttctccatacatagtgacgggtgtatgggtggggtacgacgtgaaaaagtctctcggaaagcatatgtcgggttcaagggtagcacttccaatatggatagactacatgaaagttgttacaaggatgtatccaaacgaggactttgaactccctcctgaaaatatagtagtaaatataaaccctaaagaccttgttctcgcggatgagacttgcgaaggtgtccctatggttttcgtaaagggaacagaacctcatataacgtgctctgacttgaatgccatactgggactcagatga

SEQ ID NO: 50381 - protein, 726 aa, Aquifex aeolicus
MKKLVIGILGIVIALFVGLLVFLIPIYKNLPDPKLLESWTPPQASEVYDAKGRLYGTIGIQKRFYVSIDKIPEHVINAFVATEDRNFWHHFGIDPVAIVRAAIVNYRAGRIVQGGSTITQQLAKNLFLTRERTLERKIKEALLAIKIERTFDKKKIMELYLNQIYLGSGAYGVEAAAQVYFGKHVWELSLDEAALLAALPKAPAKYNPFYHPERALQRRNLVLKRMLEEGYITPEQYEEAVNKPLTVKKENKYKFSDYFLDMVKSYVFNKYGEIAYKGRLKIYTTIDLDYQKIAQKSLEEGLKRVAKIIGLPFLPKSEEDMELAYEKEAQLKRLKRGKIYVAKILKYDGNFMKVEIHGKKLKGEIKGLNTEGHKYVFVKYLGGNRAEIIPDLEGSLVSIDVKTGEIKAIVGGRSYAYSQFNRAVKALRQPGSAIKPVIYLSALLKGMTQISTIDASSKPYYDPSKGEDWIPKNYDEKEYGNVTLRYALAHSINTAAVNLLDKVGFELVLEVGKKVGLDNLKPYYSLALGTVEVTPLQLTAAYQVFANLGTECKPFFIKKIVDENGEVLEENVPECEEVLPKPETRVPVDMLRAVVLEGTARRASVLDRIVAGKTGTTDDFQDAWFVGFSPYIVTGVWVGYDVKKSLGKHMSGSRVALPIWIDYMKVVTRMYPNEDFELPPENIVVNINPKDLVLADETCEGVPMVFVKGTEPHITCSDLNAILGLR

SEQ ID NO: 50382 - DNA, 2745 bp, Bacillus subtilis
  CDS (1)..(2745)
atgtcagatcaatttaacagccgtgaagctcgacgaaaagcgaacagcaaatcgagtccttcaccgaaaaaaggcaagaaacgaaaaaagggcggattgtttaaaaagacccttttcactttactcattctgtttgttttaggcgtagtcggcggtgctgttacatttgccgtcatggtttctgatgcgccgtcccttgatgaaagcaaattgaagacgccttattcatcaacgatttatgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgcattagttgccaactttaaagacggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttactgatttaagcaaattgactgtcgaacaggctgcgacgcttgcaggaatgccgcagagcccaacagcgtacaacccggtcaaaaacccggataaagcggaaaaacgacggaacatcgtactcagtctgatgaaaaagcaaggatttatttctgattctcaatataacaaagcgaaaaaagtggcagtgaaagacgaaggcgtcgtgtcacagaaggaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcggatttactgaaggcatgcagggcggtgtgacgcttctcgataccaaaaacggagaagtccgagcgattggtgcgggacgcaatcagcctgtcggaggctttaactatgctactcaaactaaggcacagcctggttcgaccataaaaccgattttggactacggaccagttattgaaaataagaaatggtccacatacgaacaaattgatgactcagcttatacgtattctaacggaaaaccgattcgtgattgggaccgcaaatatctagggcctatctcaatgcgttacgctctggcccaatcaagaaatatacctgctttaaaagcattccaggcagtcggtaaagatactgctgtagactttgcaaatggactcgggcttggtttaacaaaagataatgtaacagaggcctattctattggcggtttcggtgggaacgatggtgtttctcctctgacaatggcaggtgcatacagcgcgtttggaaataacggaacgtataatgaaccgcattttgtaaaatctatcgaatttaacgatggcacgaagcttgacttaacaccaaaatcaaaatcagccatgagtgattatactgcgtttatgattacagatatgctgaaaacagctgtgaagacaggtactggacagcttgcacaagtacctggtgtagaagttgcaggaaaaacaggaacgactaactttgatgataatgaagtcaaaaggtacaatatcgctagcggtggcgcccgagattcttggttcgttggctacacaccgcaatatacagctgccgtctggacgggaatgggagaaaacgaggctggaaagaaatcactttcagctgaagagcaaaaagttgcaaagcgcatcttcgcccagctcatcgccgatgtcgatgacggaagcggatcatttgagaagcctgacagcgtagtggaagccaccgtagaaaaaggttctaatccggcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattacgacggagatgcgacctttgctgttaagcaatctgttgacggcggcagctactcggaaattcaaaacagctctgcaaaagaggcagttatttcgggtgtgcagccaggatctgtatacaaattcgaagtaacagccgtcagtgatgatggcaaaagtacagcttccacatcttatgaggtgccaaaagctgaagacgatgaagataaaaaagaccagcaacaaacggatgatgaaaaacaagatgatgagaagactcaggatgatacacaaactgatgattctcaaaaagatgacggtcagacggatcaagatcagacagatgattcaacaaacgatcaagacaaaaaacaagacaatacgaacaccaatccgtccgacaacaataaccaagaccaatcaaacgataatgataacgacaacagtaacaaccaggatacgtcggatggtgattcgaactctggtaagaatgattcaacaggttctgacacgaataaaaataaaacagacacatctaataaaacacaaacaaactcatcatccattgaaaaaacaaattaa

SEQ ID NO: 50383 - protein, 914 aa, Bacillus subtilis
MSDQFNSREARRKANSKSSPSPKKGKKRKKGGLFKKTLFTLLILFVLGVVGGAVTFAVMVSDAPSLDESKLKTPYSSTIYDKNGKEIAEVGAEKRTYVSIDEIPDVVKEAFIATEDARFYEHHGIDPVRIGGALVANFKDGFGAEGGSTITQQVVKNSLLSHQKTLKRKVQEVWLSIQLERNYSKDEILEMYLNRIYFSPRAYGIGKAAEEFFGVTDLSKLTVEQAATLAGMPQSPTAYNPVKNPDKAEKRRNIVLSLMKKQGFISDSQYNKAKKVAVKDEGVVSQKEYEKASTNKYSAFVEEVMKEIDEKSDVDPSADGLKIYTTLDTKAQDKLDELMDGDTVGFTEGMQGGVTLLDTKNGEVRAIGAGRNQPVGGFNYATQTKAQPGSTIKPILDYGPVIENKKWSTYEQIDDSAYTYSNGKPIRDWDRKYLGPISMRYALAQSRNIPALKAFQAVGKDTAVDFANGLGLGLTKDNVTEAYSIGGFGGNDGVSPLTMAGAYSAFGNNGTYNEPHFVKSIEFNDGTKLDLTPKSKSAMSDYTAFMITDMLKTAVKTGTGQLAQVPGVEVAGKTGTTNFDDNEVKRYNIASGGARDSWFVGYTPQYTAAVWTGMGENEAGKKSLSAEEQKVAKRIFAQLIADVDDGSGSFEKPDSVVEATVEKGSNPAKLAGPNTPSDKKLTEYFVKGTAPSTVSKTYEKEEKEETAKLSGLNVKYDKDNQSLTLSWNYDGDATFAVKQSVDGGSYSEIQNSSAKEAVISGVQPGSVYKFEVTAVSDDGKSTASTSYEVPKAEDDEDKKDQQQTDDEKQDDEKTQDDTQTDDSQKDDGQTDQDQTDDSTNDQDKKQDNTNTNPSDNNNQDQSNDNDNDNSNNQDTSDGDSNSGKNDSTGSDTNKNKTDTSNKTQTNSSSIEKTN

SEQ ID NO: 50384 - DNA, 2553 bp, Escherichia coli
  CDS (1)..(2553)
gtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccaccggagatggtgaaagcctttatcgcgacagaagacagccgcttctacgagcatcacggcgttgacccggtggggatcttccgtgcagcaagcgtggcgctgttctccggtcacgcgtcacaaggggcaagtaccattacccagcagctggcgagaaacttcttcctcagtccagaacgcacgctgatgcgtaagattaaggaagtcttcctcgcgattcgcattgaacagctgctgacgaaagacgagatcctcgagctttatctgaacaagatttaccttggttaccgcgcctatggtgtcggtgctgcggcacaagtctatttcggaaaaacggtcgaccaactgacgctgaacgaaatggcggtgatagccgggctgccgaaagcgccttccaccttcaacccgctctactcgatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtgcagcaggccgcgcagcaggcggtacgtaataacgtgctggactacgacatgcgccacggctatcgcggcccggcaaatgtgctgtggaaagtgggcgagtcggcgtgggataacaacaagattaccgatacgctgaaggcgctgccaacctatggtccgctgctgcctgccgcagtcaccagcgccaatcctcagcaagcgacggcgatgctggcggacgggtcgaccgtcgcattgagtatggaaggcgttcgctgggcgcgtccttaccgttcggatactcagcaaggaccgacgccgcgtaaagtgaccgatgttctgcaaacgggtcagcaaatctgggttcgtcaggttggcgatgcatggtggctggcacaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttctcgctgggatgcaagtgccggttctgactggcagccgaagaactcaccaccgcagtatgctggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacactccgctggcattcctgattaagagtgctttgaacaccaatatctttggtgagccaggctggcagggtactggctggcgtgcaggtcgtgatttgcagcgtcgcgatatcggcgggaaaaccgggaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcagttagctaatggtggcaacagccgcgaagagtatttcatcgaaggtacgcagccgacacaacaggcagtgcacgaggtgggaacgaccattatcgataatggcgaggcacaggaattgttctga

SEQ ID NO: 50385 - protein, 850 aa, Escherichia coli
MKFVKYFLILAVCCILLGAGSIYGLYRYIEPQLPDVATLKDVRLQIPMQIYSADGELIAQYGEKRRIPVTLDQIPPEMVKAFIATEDSRFYEHHGVDPVGIFRAASVALFSGHASQGASTITQQLARNFFLSPERTLMRKIKEVFLAIRIEQLLTKDEILELYLNKIYLGYRAYGVGAAAQVYFGKTVDQLTLNEMAVIAGLPKAPSTFNPLYSMDRAVARRNVVLSRMLDEGYITQQQFDQTRTEAINANYHAPEIAFSAPYLSEMVRQEMYNRYGESAYEDGYRIYTTITRKVQQAAQQAVRNNVLDYDMRHGYRGPANVLWKVGESAWDNNKITDTLKALPTYGPLLPAAVTSANPQQATAMLADGSTVALSMEGVRWARPYRSDTQQGPTPRKVTDVLQTGQQIWVRQVGDAWWLAQVPEVNSALVSINPQNGAVMALVGGFDFNQSKFNRATQALRQVGSNIKPFLYTAAMDKGLTLASMLNDVPISRWDASAGSDWQPKNSPPQYAGPIRLRQGLGQSKNVVMVRAMRAMGVDYAAEYLQRFGFPAQNIVHTESLALGSASFTPMQVARGYAVMANGGFLVDPWFISKIENDQGGVIFEAKPKVACPECDIPVIYGDTQKSNVLENNDVEDVAISREQQNVSVPMPQLEQANQALVAKTGAQEYAPHVINTPLAFLIKSALNTNIFGEPGWQGTGWRAGRDLQRRDIGGKTGTTNSSKDAWFSGYGPGVVTSVWIGFDDHRRNLGHTTASGAIKDQISGYEGGAKSAQPAWDAYMKAVLEGVPEQPLTPPPGIVTVNIDRSTGQLANGGNSREEYFIEGTQPTQQAVHEVGTTIIDNGEAQELF

SEQ ID NO: 50386 - DNA, 2397 bp, Neisseria flavescens
  CDS (1)..(2397)
atgattaaaaagattataacgacctgcatgggtctcaataatggactggctcttttcggtgtaggtctgattgcaattgcaattctggtaacctatccaaaactgccgtctttggactctttacaacactacaaaccaaaattgccgctgacgatttattcttcagacggccaagtcattggcgtttacggcgaacaacggcgtgaatttaccaaaatcgacgacttccccaaaattttgaaagacgcagtgattgccgccgaagacaaacgcttctacgaccactggggtgtggacgtttggggcgtggctcgcgccgtaatcggcaacgtcatggccggcggtgttcaatccggtgccagtacgattacgcaacaggttgccaaaaacttctacctgagcagcgagcgttcattcacccgtaaattcaacgaagccctgctggcctacaaaatcgagcagtctttgagcaaagacaagattttggagctgtacttcaaccaaatctatttgggtcaacgcgcttatggttttgcctccgccgcccaaacttatttcaataaaaatgttaatgatttaacattagccgaagccgccatgttggccggcttgcctaaagcaccttccgcctacaatccgattgtaaaccctgagcgtgccaaactgcgccaagcttatattctgaacaatatgctggaagaaggcatgatcaccctgcagcaacgcgatcaggctttgaaagaagagttgcattacgagcgttttgtacaaaacattgatcaaagcgccctgtatgttgccgagatggcgcgtcaggagctgtttgaaaaatacggcgaagatgcctacacacaaggcttcaaggtatataccaccgtcgataccgcacaccagcgcgtcgccaccgaagccctgcgtaaagttttgcgcaatttcgaccgcggcagcagctaccgcggtgcagaaaactacatcgacctgagcaaaagcgataacgtagaagaaactgtcagccaatatctttctacactttacaccgtcgataaaatgattccggcggttgtcttggaagcctcacgcaaaggtgtacagattcagttgccaagtggccgtaaagtcacgctgaacaaccacgctttaggctttgccgcccgtgccgtcaacaacgaaaaaatgggggatgaccgtatccgtcgcggctccgtcattcgcgttaaaggcagcggcgatacctttaccgtcgttcaagagcctttgttgcaaggtgcattggtgtctttagatgcgaaaaccggtgcagtccgtgcattggtcggcggctacgactaccacagcaaaaccttcaaccgcgcaactcaagccatgcgccaacccggctcgacgttcaaaccgttcatttattccgccgctttggcaaaaggcatgactgcctccaccatgattaacgatgcgccgatctccctgccgggcaaaggtgcaaacggtaaagcgtggaacccgaaaaactctgacggccgctatgccggttacatcacgctgcgtcaggctttgaccgcgtcgaaaaacatggtgtccatccgcatcctgatgtctatcggcatcggctacgcgcaacaatacatccaacgcttcggcttcaagccgtctgaaatccctgccagcctgtctatggctttgggtgcaggcgaaaccactccgttgcgtattgcagaaggttacagcgtctttgccaacggcggttacaaagtatctgcccacgtcatcgacaaaatctacgacagccaaggccgtctgagagcgcaaatgcaacctttggtagccggtgaaaatgcaccccaagccattgacccgcgcaacgcctacatcatgtacaaaatcatgcaggacgttgtccgtgtcggtaccgcacgcggtgcagccaccctgggccgctccgacatcgccggtaaaaccggtaccaccaacgacaacaaagacgcatggtttgtcggcttcaaccctaacgttgtgactgccgtctatatcggtttcgacaaaccgcgcagcatgggccgtgcaggctacggtggtacaatcgccgtaccggtttgggtagaatacatcggcttcgccctgaaaggcaccagcgtcaaaccgatgaaagcccctgaaggcgtggttacaaacggcggcgaagtgtatatgcgcgaacgcatgaccaccagctccgacctggccttggacaacagcggcattcgtccgcgtcctacccaacctgcccgtcgtgccgttccgaatgaaaaccgccgccgtgccgagagcaacactgcgccagcccgtgaagaatcagacgaaaccccagttctgccaagcaataccggcaacaataacagacaacaactggactctctgttctaa

SEQ ID NO: 50387 - protein, 798 aa, Neisseria flavescens
MIKKIITTCMGLNNGLALFGVGLIAIAILVTYPKLPSLDSLQHYKPKLPLTIYSSDGQVIGVYGEQRREFTKIDDFPKILKDAVIAAEDKRFYDHWGVDVWGVARAVIGNVMAGGVQSGASTITQQVAKNFYLSSERSFTRKFNEALLAYKIEQSLSKDKILELYFNQIYLGQRAYGFASAAQTYFNKNVNDLTLAEAAMLAGLPKAPSAYNPIVNPERAKLRQAYILNNMLEEGMITLQQRDQALKEELHYERFVQNIDQSALYVAEMARQELFEKYGEDAYTQGFKVYTTVDTAHQRVATEALRKVLRNFDRGSSYRGAENYIDLSKSDNVEETVSQYLSTLYTVDKMIPAVVLEASRKGVQIQLPSGRKVTLNNHALGFAARAVNNEKMGDDRIRRGSVIRVKGSGDTFTVVQEPLLQGALVSLDAKTGAVRALVGGYDYHSKTFNRATQAMRQPGSTFKPFIYSAALAKGMTASTMINDAPISLPGKGANGKAWNPKNSDGRYAGYITLRQALTASKNMVSIRILMSIGIGYAQQYIQRFGFKPSEIPASLSMALGAGETTPLRIAEGYSVFANGGYKVSAHVIDKIYDSQGRLRAQMQPLVAGENAPQAIDPRNAYIMYKIMQDVVRVGTARGAATLGRSDIAGKTGTTNDNKDAWFVGFNPNVVTAVYIGFDKPRSMGRAGYGGTIAVPVWVEYIGFALKGTSVKPMKAPEGVVTNGGEVYMRERMTTSSDLALDNSGIRPRPTQPARRAVPNENRRRAESNTAPAREESDETPVLPSNTGNNNRQQLDSLF

SEQ ID NO: 50388 - DNA, 2397 bp, Neisseria lactamica
  CDS (1)..(2397)
atgattaaaaagattatgactacctgttttggtttggtttttggattgtgtgtatttgcggtggggctgcttgccattgccattttggcaacctatccgaaactgccttccttggattcgttgcagcattaccagcctaaaatgccgctgactgtttattcggcagacggcaaaattatcggcatatatggggagcagcggcgcgaatttacaaaaatcggcgatttccccgaggtattgcggaatgcggttattgctgccgaggacaaacggttttatcagcattggggggtggacgtttggggcgttgcccgcgctgttgtcggcaatatcgtgtccggcagcatgcagtctggtgcgagtacgattacgcagcaggtggcgaagaatttttatttgagcagcgaaaagacgtttacacgcaaattcaacgaggcgctgcttgcttataaaatcgagcagtccttaagtaaggataaaatccttgagctgtatttcaatcaaatttatttgggtcagcgcgcttatggtttcgcatcggccgcgcaaatttatttcaataaggatgtcagggacttgacccttgcggaggcggctatgctcgcaggcctgcccaaagctccgtccgcctataatccgattgtcaatccggaacgtgccaaattgcgccagaagtatattttgaacaatatgcttgaggaaaagatgattaccttgcaacagcgcgaccaagctttgaatgaagagctgcattatgagcggtttgtgcagaaaatcgaccagagtgctttatatgttgcggaaatggtacgtcaggagctgtatgagaaatacggtgaagatgcttatacgcagggtttgaaggtttacacgacggtgcgtaccgatcatcagaaagcagcaacagaggcattgcgtaaagcgttgcggaatttcgatcgcggcagcagttatcgtggtgcggaaagctatattgatctgggcagggacgaggatgccgaagaggcggtcagccaatatctttcggggctttataccgtcgataaaatggttcccgccgttgtattggatgtgaccaagaagaaaaatgtcgtcatacagctgcccggcggtaagcgggttacgcttgacaggcgcgccttgggttttgcggcccgcgcggtcgataatgaaaaaatgggggaagaccgtatccgcaggggcgcggttatccgagtcagaaataacggagggcgttgggcggtggttcaagagccgctcctgcaaggtgctttggtttcgctggatgccaaaaccggtgcggtgcgcgcgctggtcggcggttatgacttccacagcaaaacattcaaccgtgccacccaagctatgcggcagccgggttcgacatttaagccgtttgtttattctgccgccttgtctaaggggatgaccgcgtccacaatgatcaatgacgcgccgatttccctgccgggtaaagggccgaacggttcggtttggacacctaaaaattcagacggcagatattcgggatatatcactttaaggcaggcgctgacggcttccaaaaatatggtttccatccgtattttgatgtctatcggtgtcggttacgcgcaacagtatatccggcgtttcggcttcaaaccgtccgagctgcccgtcagcctgtctatggctctgggtacgggcgagacgacgccgttgaggatagcggaggcatacagtgtgtttgcaaacgggggttatagggtttcttcgtacgtcatcgataaaatttatgacagcgagggcaggttgcgcgcacaaatgcagcctttggtggcggggcaaaatgcgcctcaggcaatcgatccgcgcaatgcctatattatgtataagattatgcaggatgtcgtccgtgtcggtactgcaaggggcgcgtccgcgctgggcaggtcggacattgccggtaaaacgggcacgaccaacgacaataaagatgcgtggtttgtcgggtttaacccggatgtggttactgccgtatatatcggttttgataagcctaagagtatggggcgtgccggctacggcggtacgattgccgtgccggtttgggtggattatatgcgttttgcgctgaaaggcaggccgggcaaggggatgaaaatgcccgatggcgtagtcgccggcaacggcgaatactatatgaaggagcatatggtgacagaccccggtttgatgctggataacggcggtgccgcaccgcaaccgtcccgtcgggtaaaagaagatgacgggggcgcggcagaaggcggacggcaggaggcggatgacgaatcccgccaagatatgcaggaaacgcccgtgcttccgagtaatacggattccaagcggcagcagttggattccctgttttaa

SEQ ID NO: 50389 - protein, 798 aa, Neisseria lactamica
MIKKIMTTCFGLVFGLCVFAVGLLAIAILATYPKLPSLDSLQHYQPKMPLTVYSADGKIIGIYGEQRREFTKIGDFPEVLRNAVIAAEDKRFYQHWGVDVWGVARAVVGNIVSGSMQSGASTITQQVAKNFYLSSEKTFTRKFNEALLAYKIEQSLSKDKILELYFNQIYLGQRAYGFASAAQIYFNKDVRDLTLAEAAMLAGLPKAPSAYNPIVNPERAKLRQKYILNNMLEEKMITLQQRDQALNEELHYERFVQKIDQSALYVAEMVRQELYEKYGEDAYTQGLKVYTTVRTDHQKAATEALRKALRNFDRGSSYRGAESYIDLGRDEDAEEAVSQYLSGLYTVDKMVPAVVLDVTKKKNVVIQLPGGKRVTLDRRALGFAARAVDNEKMGEDRIRRGAVIRVRNNGGRWAVVQEPLLQGALVSLDAKTGAVRALVGGYDFHSKTFNRATQAMRQPGSTFKPFVYSAALSKGMTASTMINDAPISLPGKGPNGSVWTPKNSDGRYSGYITLRQALTASKNMVSIRILMSIGVGYAQQYIRRFGFKPSELPVSLSMALGTGETTPLRIAEAYSVFANGGYRVSSYVIDKIYDSEGRLRAQMQPLVAGQNAPQAIDPRNAYIMYKIMQDVVRVGTARGASALGRSDIAGKTGTTNDNKDAWFVGFNPDVVTAVYIGFDKPKSMGRAGYGGTIAVPVWVDYMRFALKGRPGKGMKMPDGVVAGNGEYYMKEHMVTDPGLMLDNGGAAPQPSRRVKEDDGGAAEGGRQEADDESRQDMQETPVLPSNTDSKRQQLDSLF

SEQ ID NO: 50390 - DNA, 2283 bp, Buchnera aphidicola
  CDS (1)..(2283)
atgttttttaattttaaaaaatattttcttataaaagtatttttttttgtattaattttaacgctttgttatgggttatatttatacgttaagataaatcgattcataaatggaaaagtatggaattttcccacttcaatatatggacgtatagttaatttagaaccaggaaattcatattctcaaaaagaagtattacacttgttgaaaagcacaatgtatagaaaagtagatttagttatgttgccaggagaatacagtataaaaaataatactatagaatttatacgacgtgcttttgattttcctgatatacgagaagatgaatttcatgcgcgattgtattttaataaagatactttagtaaaaattaaaaacattgacaacaatcatgattttagtttttttcgtttagagcccaaactaattgctatgttaaaatctcctgaagcaaaaaaacgaatgtttattcctcgcaatcaatacccggaaatgttagttaaaacattactagctattgaagataagtatttttatgagcatgatggaattcacttatcatctataggtcgagcttttttagtaaatctaatggctggccgcacaattcaaggtggtagtactctcactcaacaacttataaaaaatttatttttaaccaatactcgttcaatattacgaaaaataaatgaaatctatatggctttaattttagatagattttatacaaaagatcgaattttagaattgtatttaaatgaagtttatttaggacaagatggtgatgaacaaattagaggttttcctcttgctagtatttattattttggtagaccaataaatgaattgaatttagaacaatatgctttattagttggtatggtcaaaggtgcctctttatatagtccttggactaatcctaatcttgcattaaaaagaagaaatttggttttatttttattgtataaacaaaaatatattacaagaaaaatttataaagatttatgtaaacgatctttaaatgttcagcctaaagggaatattatttcatctcatccttcttttatacaacttgtatgtgaagaatttcacaaaaaaatttataatcctattaaaaattttccgggaacaaagatatttactactcttgattatacttcacaaaatgcagtagaacaagcagtaaaaatcgaaatacctatattaaaaagaaaaaaaagactaaaggatttagaagttgctatgatcgttatagatagatttacaggagaagttcaagctcttattggcagttctaaaccagaatttaatggttacaatcgtgctttaaaaactcggcgttctattggttcattatctaaacctataacatacttaactgctttatcacaaccagagaaatatcatttaaatacttggatttctaattatcctctttcgattaaattagatagtggtcaatattggacaccaaaaaataataatttttcttttagtaaaaaagtgctcttgttagacgcattaattcattcaattaatattcccacagttaatctcagtataaatataggtttgaaaaaattagttgatagctggttgcttttaggcatttctaaaaaatacattactcctctgccatcaatatctttaggtgctatcaatttaacaccttttgaaatagcacaagtttttcaaataattggaagtggtggttataagtcgtctttatcatcagtaagatcaattatatctgatgatggtaaagtgctttatcagaatttgcctcaatcaatacatatagaatcttctgaagcttcttatttaacactatacggtatgcaacaagtagttaagagtggaactgcaaaatcattaggaaccatttttaaagaattttctttagctggaaaaactggtactacaaataatttagttgataattggtttgtcggaattgacgggaaacaaattgtcattacttggataggaagagataataaccacacaacaagattatatagttcttctggtgcaatgcaaatttacaagagataccttcaatatcagcgtccagtaccactagtattaaaagctccaaacaatattaatatgttttatattaacaatctaggagaattattttgtaaaaaaaataatcagcacaatcgaatgctaccaatatggtcgataaaaaataaaaaaatttgtaatgataaattatcagaacgtttttccataaaaaagaaaaaaaattttttgttttggttgaaaaacttgttttaa

SEQ ID NO: 50391 - protein, 760 aa, Buchnera aphidicola
MFFNFKKYFLIKVFFFVLILTLCYGLYLYVKINRFINGKVWNFPTSIYGRIVNLEPGNSYSQKEVLHLLKSTMYRKVDLVMLPGEYSIKNNTIEFIRRAFDFPDIREDEFHARLYFNKDTLVKIKNIDNNHDFSFFRLEPKLIAMLKSPEAKKRMFIPRNQYPEMLVKTLLAIEDKYFYEHDGIHLSSIGRAFLVNLMAGRTIQGGSTLTQQLIKNLFLTNTRSILRKINEIYMALILDRFYTKDRILELYLNEVYLGQDGDEQIRGFPLASIYYFGRPINELNLEQYALLVGMVKGASLYSPWTNPNLALKRRNLVLFLLYKQKYITRKIYKDLCKRSLNVQPKGNIISSHPSFIQLVCEEFHKKIYNPIKNFPGTKIFTTLDYTSQNAVEQAVKIEIPILKRKKRLKDLEVAMIVIDRFTGEVQALIGSSKPEFNGYNRALKTRRSIGSLSKPITYLTALSQPEKYHLNTWISNYPLSIKLDSGQYWTPKNNNFSFSKKVLLLDALIHSINIPTVNLSINIGLKKLVDSWLLLGISKKYITPLPSISLGAINLTPFEIAQVFQIIGSGGYKSSLSSVRSIISDDGKVLYQNLPQSIHIESSEASYLTLYGMQQVVKSGTAKSLGTIFKEFSLAGKTGTTNNLVDNWFVGIDGKQIVITWIGRDNNHTTRLYSSSGAMQIYKRYLQYQRPVPLVLKAPNNINMFYINNLGELFCKKNNQHNRMLPIWSIKNKKICNDKLSERFSIKKKKNFLFWLKNLF

SEQ ID NO: 50392 - DNA, 2346 bp, Haemophilus influenzae
  CDS (1)..(2346)
atgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgattagaaagtgtgaaaattgccgataatctcgcttttgatgaagtcattcaaattttattagataacgaatatcgccaaacgaccatggttgccgcccctggcgatttcaaattagaagatgatagcattgtagtgcttcgccgcgcttttcctttccccgataaagcagagcctcagcgagttttgcgcttgcgttttagccataataagttatctcgcattgaagatttagtgacggtcaaaactgttgatgaatttcgtcttgcaccaaagttgattgcgatgttgcaatcagacaacgaagatcgccttgctattcctttacaaaattatccccgtttattaattgatacattaattttaacggaagatcgccgcttttatgaacataatggcattaatccagtggggattttacgtgcattaattgcgaatattcgtgctggtcaaacggtacagggcggaagtacgctcactcaacaattagtcaaaaatttatttttatcgcgcgaacgcaccattacacgcaaagccaacgaagccttgatgtcattggttttagattggcgttacgataaaaaccgaattctcgaaacctatctcaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccgtggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtaagctgggcgaacacaaaatatcgagcttacttggcgcacgtattttttccacaatggatttaaaacaacaagctcaagcagaaaatgcagtgggcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattctgtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttataccatctcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctatttggctaaataatggtcagaatttctgtggcgaaacatcatctccctctctcacgccaacaactgaaacagaaacaccaccacaagaaagcctgtgggacgtattggataatcccaatccacccgctcaataa

SEQ ID NO: 50393 - protein, 781 aa, Haemophilus influenzae
MTSQHSAKKSSKNTPKNNRTFKGFLLKFSFTALVLTIFYGGYLDWQIRSKMDGQIWHLPAEVYSRLESVKIADNLAFDEVIQILLDNEYRQTTMVAAPGDFKLEDDSIVVLRRAFPFPDKAEPQRVLRLRFSHNKLSRIEDLVTVKTVDEFRLAPKLIAMLQSDNEDRLAIPLQNYPRLLIDTLILTEDRRFYEHNGINPVGILRALIANIRAGQTVQGGSTLTQQLVKNLFLSRERTITRKANEALMSLVLDWRYDKNRILETYLNEIYLGQNGDTQIHGFELASQFYFGRSIREISLDQIALLVGMVKGPSLYNPWRNPQNALERRNIVLRLMLEHKMIGDELYQLLSQRPLGVQKKGQISRKYPAFIQTLQADLRRKLGEHKISSLLGARIFSTMDLKQQAQAENAVGNTVSQLQLKMKNPHLEGAMIITDYRTGEIRAVVGGLQTQYAGFNRALMAKRQIGSLVKPSIYLTALSNPEQFRLNTPINNQPITINVKGSPPWQPRNYDKKYSDSVMLMDALARSLNIPTVNIGMKVGLSKVIDTQKAMGWDNVEIPKVPAMLLGSYTISPYDVTKLYQTLANQGGRIALTTVDSIADRQGNLIFQHDKSAKQVVPQEAAFQTLFAMQQTVERGTARSLQKDYADLHLAGKTGTTNESRDTWFVGIDGKNISTVWLGRDDNGETKLTGASGALQIYKDYLNRTNIEKLAITPPTTVKWVGINQYGDWDCESYRTIPIWLNNGQNFCGETSSPSLTPTTETETPPQESLWDVLDNPNPPAQ

SEQ ID NO: 50394 - DNA, 2334 bp, Vibrio cholerae
  CDS (1)..(2334)
atgacgagaaaaagtagtaacagatcgcgtggccgtaaagcgcgcagtggtaaaagtgcctcttcctccaagctgcaaatctggctgggaaggatttggagtatcggctggaaattagcgctgacgctggccgcagtgctggtttttattggtatctatctcgattcgatgatcaaacagcgctttgaaggtcagctgtttgatctgccgaccgtggtctatgcccgtattttaacgcttgagcccggcaacggcctcagtttgcaagaactgcgcaatgagctggatgtcctcaattaccgcaaagtggcacagccccgtttccccggtgaatacgcgtcttcttccagtcgaattgagctgatccgccgtccgtttgaattcgcggatggtccagagccggatcgccgagtgatgcttacctttgatggcagtggtttgaacaaaatcgaatcattagagcaaaaacgcgagctaggctacctgcgtttagagccaaaactgatgggcatgctggaaaaagattcgccggagcagcgactctttttacgtcgcgatcaattccccgaagtgttggttgatgcactcttagtcaccgaagatcgtgatttttatcagcacgatggcgtatcaccacttgcgattggtcgcgctatggtggtcaaccttaaagcggggcgcacggtgcaagggggcagtaccttgacccagcagctggctaaaaacatcttcctttctagcgatcgcaccttgtggcgtaagctgcgcgaagcctatatggcgctgatcatcgattatcgttacagcaaagatcgtattcttgaagcctatcttaacgaagtttatttagggcaaagtggcgcagatgcgatccacggttttggtctggcttcacggctctattttggtcagccgctgcaagagctacggattgatcaattggcattgttggttggcatggttaaagggccttcttattacaacccgatgcgttatgccgagcgcgctcgcgagcggcgcgatctggtgctgaaactgatgatggagcacgatattctgacggcgccagagtaccagcaagcggtaactcgtccgttggatgtgcagaaaaccgcgcaaatcgctagccgtcagccagcgtatttccagcaagtttctattgagctgaaagaaaaactgggcgacaaatttaaagcggattcaggattgcgggtgtttacctcgctcgatccggtttcgcagtccaaactcgagcaagcgatccacgatcagatcccgcaattagcgaaaaccgcaggcaaagatctcgaagccgctgcgatcgctgtggatcgtcatagtggcgaaattcgtgccatggtcggcggtaagcgaaccggttacgatggttttaaccgcgtgctcaatgccagtcgacaaattggttcactggtgaaaccagcggtgtatctcacggcgttagcgcatcccgatcagtacaacctagccactacactggaagataaaccactcaccttaaaaggcagtgaaggcagcgcgtggactccgcgaaactacgatcgtcaatatcgtggagaggtgcccctttatttggcgctcgctcaatcgcttaatgtgccgaccgtggctttggggatgaagcttgggattgatcaagtctcagcaaccttgggtaagctcggcgtgaatcgcgacgaaattcgccctgtcccttcgatgttgctcggttcattctcactcacgccatatcaagtggcgcagatgtatcaaacgttgaccaattccggcaaaaaagccccgctgtcagcgctacgttctgtgctcgatttggaaggcaatgtgctgtatgaatctctgccgagagtgtcacaagcggtggatcagcaagccgcttggctgacgacttacgcgatgaaacaaggggtgcaagaggggactggacgttacttgaatgcgcagttcagcagtgcagcactggcggggaaaaccgggaccactaacgataaccgtgacagttggtttgtgggggtcgatggccgtgaagtgaccaccatttggcttggccgcgatgataaccagccaacgaagctcactggcgcgagtggggcattacgtgtttatgcgcagtatttgaaatatcgcattccagagaaattacagttaccttggccagaaggcataacgaccttcggctttgccaagcagacgcaaggtggattgaaactcgactgtgataatgcgtttaaactgcctatttgggacaatcaacagcagttaaaacagcagtgtgaaaaccgtccgaccgagtggatcaaaaagctgtttgagtggtaa

SEQ ID NO: 50395 - protein, 777 aa, Vibrio cholerae
MTRKSSNRSRGRKARSGKSASSSKLQIWLGRIWSIGWKLALTLAAVLVFIGIYLDSMIKQRFEGQLFDLPTVVYARILTLEPGNGLSLQELRNELDVLNYRKVAQPRFPGEYASSSSRIELIRRPFEFADGPEPDRRVMLTFDGSGLNKIESLEQKRELGYLRLEPKLMGMLEKDSPEQRLFLRRDQFPEVLVDALLVTEDRDFYQHDGVSPLAIGRAMVVNLKAGRTVQGGSTLTQQLAKNIFLSSDRTLWRKLREAYMALIIDYRYSKDRILEAYLNEVYLGQSGADAIHGFGLASRLYFGQPLQELRIDQLALLVGMVKGPSYYNPMRYAERARERRDLVLKLMMEHDILTAPEYQQAVTRPLDVQKTAQIASRQPAYFQQVSIELKEKLGDKFKADSGLRVFTSLDPVSQSKLEQAIHDQIPQLAKTAGKDLEAAAIAVDRHSGEIRAMVGGKRTGYDGFNRVLNASRQIGSLVKPAVYLTALAHPDQYNLATTLEDKPLTLKGSEGSAWTPRNYDRQYRGEVPLYLALAQSLNVPTVALGMKLGIDQVSATLGKLGVNRDEIRPVPSMLLGSFSLTPYQVAQMYQTLTNSGKKAPLSALRSVLDLEGNVLYESLPRVSQAVDQQAAWLTTYAMKQGVQEGTGRYLNAQFSSAALAGKTGTTNDNRDSWFVGVDGREVTTIWLGRDDNQPTKLTGASGALRVYAQYLKYRIPEKLQLPWPEGITTFGFAKQTQGGLKLDCDNAFKLPIWDNQQQLKQQCENRPTEWIKKLFEW

SEQ ID NO: 50396 - DNA, 19 bp, Primer
atggccgggaatgaccgcg

SEQ ID NO: 50397 - DNA, 28 bp, Primer
ttaattactaccaaacatatccttgatc

SEQ ID NO: 50398 - protein, 968 aa, consensus
  MISC_FEATURE (1)..(968): consensus for the disclosure of xaa see table XV
AXXXXEDXXFXXXHXGXXXXXXXXAXXXXXXXXXXXXXXXXXGXSTXTQQXXXXXXXXXXXXXXXXXXXXXXXXXXXXXXXXRKXXEXXXXXXXXXXXXKXXILXXYXNXXXXGXXXXXXXXXGXXXAXXXYFXXXXXXXXLXXXXXAXLXXXXXXPXXXXPXXXXXXXXXXXXXXXXXXXXXXXXXXXXXXXXXXXXXXRXXXVLXXMXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXTXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXAXXGGXXXXXXXXXXXXXXXXXXXXXXXNXAXXXXXXXXXXRXXGSXXKPXXXXXXXXXXXXXXXXXXXXXXXXXXXXXXXXXXXXXXXXXXXXXXXXXNXXXXXXXXXXGXXXXXXXXXXXXXXXXXXXXXXXXXAXXXSXNXXXXXXXXXXXXXXXXXXXXXXXXGXXXXXXXXXXXGXXXXXXXXXXXXXXXXXXXXXXXXXGXXXXXXXXXXXXXXXXXXXXXXYXXXXXXGXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTXXXXXXXXXXXXXXXXXXXXAGKTGTXXXXXXXXXXXXXXXXXXXXXXXXXXXDXWXXGXXXXXXXXXXXWXG

SEQ ID NO: 50399 - protein, 164 aa, consensus
  MISC_FEATURE (1)..(164): consensus for the disclosure of xaa see table XV
XXXXXXXXEXXXXXXXXXXXXXXXXXXXXXXXXXXXXXXXXXXXGXSXXXXQXXXXXXXXXXXXXXXXXXXXXXXXXXXXXXXXXKXXXXXXXXXXXXXXXKXXXXXXYXXXXXXXXXXXXXXXXGXXXXXXXXXXXXXXXXXXXXXXXXXXXXXXXXXXXXXX

SEQ ID NO: 50400 - protein, 44 aa, consensus
  MISC_FEATURE (1)..(44): consensus for the disclosure of xaa see table XV
XXXXXXXXXXXXXXXXXXXXXXXXXXXXXXXXXXXXXXXXSXXK

SEQ ID NO: 50401 - protein, 104 aa, consensus
  MISC_FEATURE (1)..(104): consensus for the disclosure of xaa see table XV
XXXXXXXSXNXXXXXXXXXXXXXXXXXXXXXXXXXXXXXXXXXXXXXXXXXXXXXXXXXXXXXXXXXGXXXXXXXXXXXXXXXXXXXXXXXGXXXXXXXXXXXX

SEQ ID NO: 50402 - protein, 71 aa, consensus
  MISC_FEATURE (1)..(71): consensus for the disclosure of xaa see table XV
XXXXXXXXXXXXXXXXXXXXKXGXXXXXXXXXXXXXXXXXXXXXXXXXXXXXXXXXXXXXXXXXXXXXXXG

SEQ ID NO: 50403 - DNA, 1425 bp, Escherichia coli K12; identical to SEQ ID NO: 28717
  CDS (1)..(1425)

SEQ ID NO: 50404 - protein, 474 aa, Escherichia coli K12; identical to SEQ ID NO: 28718

SEQ ID NO: 50405 - DNA, 1401 bp, Haemophilus influenzae; identical to SEQ ID NO: 28719
  CDS (1)..(1401)

SEQ ID NO: 50406 - protein, 466 aa, Haemophilus influenzae; identical to SEQ ID NO: 28720

SEQ ID NO: 50407 - DNA, 1350 bp, Bacillus subtilis; identical to SEQ ID NO: 28721
  CDS (1)..(1350)

SEQ ID NO: 50408 - protein, 449 aa, Bacillus subtilis; identical to SEQ ID NO: 28722

SEQ ID NO: 50409 - DNA, 1545 bp, Xylella fastidiosa; identical to SEQ ID NO: 28723
  CDS (1)..(1545)

SEQ ID NO: 50410 - protein, 514 aa, Xylella fastidiosa; identical to SEQ ID NO: 28724

SEQ ID NO: 50411 - DNA, 1251 bp, Nostoc sp. PCC 7120; identical to SEQ ID NO: 28725
  CDS (1)..(1251)

SEQ ID NO: 50412 - protein, 416 aa, Nostoc sp. PCC 7120; identical to SEQ ID NO: 28726

SEQ ID NO: 50413 - DNA, 1428 bp, Salmonella enterica subsp. enterica serovar Typhi; identical to SEQ ID NO: 28727
  CDS (1)..(1428)

SEQ ID NO: 50414 - protein, 475 aa, Salmonella enterica subsp. enterica serovar Typhi; identical to SEQ ID NO: 28728

SEQ ID NO: 50415 - DNA, 1290 bp, Nostoc sp. PCC 7120; identical to SEQ ID NO: 28729
  CDS (1)..(1290)

SEQ ID NO: 50416 - protein, 429 aa, Nostoc sp. PCC 7120; identical to SEQ ID NO: 28730

SEQ ID NO: 50417 - DNA, 1206 bp, Nostoc sp. PCC 7120; identical to SEQ ID NO: 28731
  CDS (1)..(1206)

SEQ ID NO: 50418 - protein, 401 aa, Nostoc sp. PCC 7120; identical to SEQ ID NO: 28732

SEQ ID NO: 50419 - DNA, 1545 bp, Agrobacterium tumefaciens; identical to SEQ ID NO: 28733
  CDS (1)..(1545)

SEQ ID NO: 50420 - protein, 514 aa, Agrobacterium tumefaciens; identical to SEQ ID NO: 28734

SEQ ID NO: 50421 - DNA, 1446 bp, Yersinia pestis; identical to SEQ ID NO: 28735
  CDS (1)..(1446)

SEQ ID NO: 50422 - protein, 481 aa, Yersinia pestis; identical to SEQ ID NO: 28736

SEQ ID NO: 50423 - DNA, 1572 bp, Agrobacterium tumefaciens; identical to SEQ ID NO: 28737
  CDS (1)..(1572)

SEQ ID NO: 50424 - protein, 523 aa, Agrobacterium tumefaciens; identical to SEQ ID NO: 28738

SEQ ID NO: 50425 - DNA, 1407 bp, Agrobacterium tumefaciens; identical to SEQ ID NO: 28739
  CDS (1)..(1407)

SEQ ID NO: 50426 - protein, 468 aa, Agrobacterium tumefaciens; identical to SEQ ID NO: 28740

SEQ ID NO: 50427 - DNA, 1425 bp, Brucella melitensis; identical to SEQ ID NO: 28741
  CDS (1)..(1425)

SEQ ID NO: 50428 - protein, 474 aa, Brucella melitensis; identical to SEQ ID NO: 28742

SEQ ID NO: 50429 - DNA, 1362 bp, Aquifex aeolicus; identical to SEQ ID NO: 28743
  CDS (1)..(1362)

SEQ ID NO: 50430 - protein, 453 aa, Aquifex aeolicus; identical to SEQ ID NO: 28744

SEQ ID NO: 50431 - DNA, 1500 bp, Neisseria meningitidis; identical to SEQ ID NO: 28745
  CDS (1)..(1500)

SEQ ID NO: 50432 - protein, 499 aa, Neisseria meningitidis; identical to SEQ ID NO: 28746

SEQ ID NO: 50433 - DNA, 1170 bp, Pseudomonas aeruginosa; identical to SEQ ID NO: 28747
  CDS (1)..(1170)

SEQ ID NO: 50434 - protein, 389 aa, Pseudomonas aeruginosa; identical to SEQ ID NO: 28748

SEQ ID NO: 50435 - DNA, 1407 bp, Sinorhizobium meliloti; identical to SEQ ID NO: 28749
  CDS (1)..(1407)

SEQ ID NO: 50436 - protein, 468 aa, Sinorhizobium meliloti; identical to SEQ ID NO: 28750

SEQ ID NO: 50437 - DNA, 1332 bp, Helicobacter pylori; identical to SEQ ID NO: 28751
  CDS (1)..(1332)

SEQ ID NO: 50438 - protein, 443 aa, Helicobacter pylori; identical to SEQ ID NO: 28752

SEQ ID NO: 50439 - DNA, 1419 bp, Caulobacter crescentus; identical to SEQ ID NO: 28753
  CDS (1)..(1419)

SEQ ID NO: 50440 - protein, 472 aa, Caulobacter crescentus; identical to SEQ ID NO: 28754

SEQ ID NO: 50441 - DNA, 1446 bp, Xylella fastidiosa; identical to SEQ ID NO: 28755
  CDS (1)..(1446)

SEQ ID NO: 50442 - protein, 481 aa, Xylella fastidiosa; identical to SEQ ID NO: 28756

SEQ ID NO: 50443 - DNA, 1458 bp, Treponema pallidum subsp. pallidum (syphilis spirochete); identical to SEQ ID NO: 28757
  CDS (1)..(1458)

SEQ ID NO: 50444 - protein, 485 aa, Treponema pallidum subsp. pallidum (syphilis spirochete); identical to SEQ ID NO: 28758

SEQ ID NO: 50445 - DNA, 1380 bp, Thermotoga maritima; identical to SEQ ID NO: 28759
  CDS (1)..(1380)

SEQ ID NO: 50446 - protein, 459 aa, Thermotoga maritima; identical to SEQ ID NO: 28760

SEQ ID NO: 50447 - DNA, 1371 bp, Vibrio cholerae; identical to SEQ ID NO: 28761
  CDS (1)..(1371)

SEQ ID NO: 50448 - protein, 456 aa, Vibrio cholerae; identical to SEQ ID NO: 28762

SEQ ID NO: 50449 - DNA, 1961 bp, Pseudomonas aeruginosa; identical to SEQ ID NO: 28763
  CDS (496)..(1920)

SEQ ID NO: 50450 - protein, 474 aa, Pseudomonas aeruginosa; identical to SEQ ID NO: 28764

SEQ ID NO: 50451 - DNA, 1593 bp, Caulobacter crescentus; identical to SEQ ID NO: 28765
  CDS (1)..(1593)

SEQ ID NO: 50452 - protein, 530 aa, Caulobacter crescentus; identical to SEQ ID NO: 28766

SEQ ID NO: 50453 - DNA, 1536 bp, Rickettsia conorii; identical to SEQ ID NO: 28767
  CDS (1)..(1536)

SEQ ID NO: 50454 - protein, 511 aa, Rickettsia conorii; identical to SEQ ID NO: 28768

SEQ ID NO: 50455 - DNA, 1452 bp, Borrelia burgdorferi (Lyme disease spirochete); identical to SEQ ID NO: 28769
  CDS (1)..(1452)

SEQ ID NO: 50456 - protein, 483 aa, Borrelia burgdorferi (Lyme disease spirochete); identical to SEQ ID NO: 28770

SEQ ID NO: 50457 - DNA, 1494 bp, Chlamydia trachomatis; identical to SEQ ID NO: 28771
  CDS (1)..(1494)

SEQ ID NO: 50458 - protein, 497 aa, Chlamydia trachomatis; identical to SEQ ID NO: 28772

SEQ ID NO: 50459 - DNA, 1431 bp, Helicobacter pylori; identical to SEQ ID NO: 28773
  CDS (1)..(1431)

SEQ ID NO: 50460 - protein, 476 aa, Helicobacter pylori; identical to SEQ ID NO: 28774

SEQ ID NO: 50461 - DNA, 1302 bp, Clostridium acetobutylicum; identical to SEQ ID NO: 28775
  CDS (1)..(1302)

SEQ ID NO: 50462 - protein, 433 aa, Clostridium acetobutylicum; identical to SEQ ID NO: 28776

SEQ ID NO: 50463 - DNA, 2009 bp, Brucella abortus; identical to SEQ ID NO: 28777
  CDS (275)..(1816)

SEQ ID NO: 50464 - protein, 513 aa, Brucella abortus; identical to SEQ ID NO: 28778

SEQ ID NO: 50465 - DNA, 1185 bp, Synechocystis sp; identical to SEQ ID NO: 28779
  CDS (1)..(1185)

SEQ ID NO: 50466 - protein, 394 aa, Synechocystis sp; identical to SEQ ID NO: 28780

SEQ ID NO: 50467 - DNA, 1251 bp, Synechocystis sp; identical to SEQ ID NO: 28781
  CDS (1)..(1251)

SEQ ID NO: 50468 - protein, 416 aa, Synechocystis sp; identical to SEQ ID NO: 28782

SEQ ID NO: 50469 - DNA, 1359 bp, Synechocystis sp; identical to SEQ ID NO: 28783
  CDS (1)..(1359)

SEQ ID NO: 50470 - protein, 452 aa, Synechocystis sp; identical to SEQ ID NO: 28784

SEQ ID NO: 50471 - DNA, 1740 bp, Lactococcus lactis; identical to SEQ ID NO: 28785
  CDS (230)..(1456)

SEQ ID NO: 50472 - protein, 408 aa, Lactococcus lactis; identical to SEQ ID NO: 28786

SEQ ID NO: 50473 - DNA, 1383 bp, Rhodobacter capsulatus; identical to SEQ ID NO: 28787
  CDS (1)..(1383)

SEQ ID NO: 50474 - protein, 460 aa, Rhodobacter capsulatus; identical to SEQ ID NO: 28788

SEQ ID NO: 50475 - DNA, 1392 bp, Haemophilus influenzae; identical to SEQ ID NO: 28789
  CDS (1)..(1392)

SEQ ID NO: 50476 - protein, 463 aa, Haemophilus influenzae; identical to SEQ ID NO: 28790

SEQ ID NO: 50477 - DNA, 1800 bp, Yersinia enterocolitica; identical to SEQ ID NO: 28791
  CDS (244)..(1680)

SEQ ID NO: 50478 - protein, 478 aa, Yersinia enterocolitica; identical to SEQ ID NO: 28792

SEQ ID NO: 50479 - DNA, 2027 bp, Azotobacter vinelandii; identical to SEQ ID NO: 28793
  CDS (483)..(1904)

SEQ ID NO: 50480 - protein, 473 aa, Azotobacter vinelandii; identical to SEQ ID NO: 28794

SEQ ID NO: 50481 - DNA, 1905 bp, Brucella abortus; identical to SEQ ID NO: 28795
  CDS (333)..(1835)

SEQ ID NO: 50482 - protein, 500 aa, Brucella abortus; identical to SEQ ID NO: 28796

SEQ ID NO: 50483 - DNA, 1466 bp, Campylobacter jejuni; identical to SEQ ID NO: 28797
  CDS (48)..(1466)

SEQ ID NO: 50484 - protein, 472 aa, Campylobacter jejuni; identical to SEQ ID NO: 28798

SEQ ID NO: 50485 - DNA, 1191 bp, Pseudomonas aeruginosa; identical to SEQ ID NO: 28799
  CDS (14)..(1183)

SEQ ID NO: 50486 - protein, 389 aa, Pseudomonas aeruginosa; identical to SEQ ID NO: 28800

SEQ ID NO: 50487 - DNA, 1488 bp, Burkholderia mallei ATCC 23344; identical to SEQ ID NO: 28801
  CDS (1)..(1488)

SEQ ID NO: 50488 - protein, 495 aa, Burkholderia mallei ATCC 23344; identical to SEQ ID NO: 28802

SEQ ID NO: 50489 - DNA, 1209 bp, Burkholderia pseudomallei K96243; identical to SEQ ID NO: 28803
  CDS (1)..(1209)

SEQ ID NO: 50490 - protein, 402 aa, Burkholderia pseudomallei K96243; identical to SEQ ID NO: 28804

SEQ ID NO: 50491 - DNA, 1458 bp, Burkholderia pseudomallei K96243; identical to SEQ ID NO: 28805
  CDS (1)..(1458)

SEQ ID NO: 50492 - protein, 485 aa, Burkholderia pseudomallei K96243; identical to SEQ ID NO: 28806

SEQ ID NO: 50493 - DNA, 1557 bp, Burkholderia pseudomallei K96243; identical to SEQ ID NO: 28807
  CDS (1)..(1557)

SEQ ID NO: 50494 - protein, 518 aa, Burkholderia pseudomallei K96243; identical to SEQ ID NO: 28808

SEQ ID NO: 50495 - DNA, 1419 bp, Burkholderia pseudomallei K96243; identical to SEQ ID NO: 28809
  CDS (1)..(1419)

SEQ ID NO: 50496 - protein, 472 aa, Burkholderia pseudomallei K96243; identical to SEQ ID NO: 28810

SEQ ID NO: 50497 - DNA, 1566 bp, Bacteroides fragilis; identical to SEQ ID NO: 28811
  CDS (19)..(1566)

SEQ ID NO: 50498 - protein, 515 aa, Bacteroides fragilis; identical to SEQ ID NO: 28812

SEQ ID NO: 50499 - DNA, 2358 bp, Bacillus licheniformis DSM 13; identical to SEQ ID NO: 28813
  CDS (501)..(1871)

SEQ ID NO: 50500 - protein, 456 aa, Bacillus licheniformis DSM 13; identical to SEQ ID NO: 28814

SEQ ID NO: 50501 - DNA, 1470 bp, Mannheimia succiniciproducens MBEL55E; identical to SEQ ID NO: 28815
  CDS (1)..(1470)

SEQ ID NO: 50502 - protein, 489 aa, Mannheimia succiniciproducens MBEL55E; identical to SEQ ID NO: 28816

SEQ ID NO: 50503 - DNA, 1425 bp, Borrelia garinii PBi; identical to SEQ ID NO: 28817
  CDS (1)..(1425)

SEQ ID NO: 50504 - protein, 474 aa, Borrelia garinii PBi; identical to SEQ ID NO: 28818

SEQ ID NO: 50505 - DNA, 1224 bp, Lactococcus lactis; identical to SEQ ID NO: 28819
  CDS (1)..(1224)

SEQ ID NO: 50506 - protein, 407 aa, Lactococcus lactis; identical to SEQ ID NO: 28820

SEQ ID NO: 50507 - DNA, 1557 bp, Rickettsia typhi; identical to SEQ ID NO: 28821
  CDS (1)..(1557)

SEQ ID NO: 50508 - protein, 518 aa, Rickettsia typhi; identical to SEQ ID NO: 28822

SEQ ID NO: 50509 - DNA, 1485 bp, Onchocerca volvulus endobacterium; identical to SEQ ID NO: 28823
  CDS (1)..(1485)

SEQ ID NO: 50510 - protein, 494 aa, Onchocerca volvulus endobacterium; identical to SEQ ID NO: 28824

SEQ ID NO: 50511 - DNA, 1455 bp, Desulfotalea psychrophila; identical to SEQ ID NO: 28825
  CDS (1)..(1455)

SEQ ID NO: 50512 - protein, 484 aa, Desulfotalea psychrophila; identical to SEQ ID NO: 28826

SEQ ID NO: 50513 - DNA, 1467 bp, Erwinia carotovora; identical to SEQ ID NO: 28827
  CDS (1)..(1467)

SEQ ID NO: 50514 - protein, 488 aa, Erwinia carotovora; identical to SEQ ID NO: 28828

SEQ ID NO: 50515 - DNA, 1371 bp, Erwinia carotovora; identical to SEQ ID NO: 28829
  CDS (1)..(1371)

SEQ ID NO: 50516 - protein, 456 aa, Erwinia carotovora; identical to SEQ ID NO: 28830

SEQ ID NO: 50517 - DNA, 1404 bp, Acinetobacter sp; identical to SEQ ID NO: 28831
  CDS (1)..(1404)

SEQ ID NO: 50518 - protein, 467 aa, Acinetobacter sp; identical to SEQ ID NO: 28832

SEQ ID NO: 50519 - DNA, 1518 bp, Bartonella quintana; identical to SEQ ID NO: 28833
  CDS (1)..(1518)

SEQ ID NO: 50520 - protein, 505 aa, Bartonella quintana; identical to SEQ ID NO: 28834

SEQ ID NO: 50521 - DNA, 1395 bp, Bartonella quintana; identical to SEQ ID NO: 28835
  CDS (1)..(1395)

SEQ ID NO: 50522 - protein, 464 aa, Bartonella quintana; identical to SEQ ID NO: 28836

SEQ ID NO: 50523 - DNA, 1512 bp, Bartonella quintana; identical to SEQ ID NO: 28837
  CDS (1)..(1512)

SEQ ID NO: 50524 - protein, 503 aa, Bartonella quintana; identical to SEQ ID NO: 28838

SEQ ID NO: 50525 - DNA, 1518 bp, Bartonella henselae; identical to SEQ ID NO: 28839
  CDS (1)..(1518)

SEQ ID NO: 50526 - protein, 505 aa, Bartonella henselae; identical to SEQ ID NO: 28840

SEQ ID NO: 50527 - DNA, 1392 bp, Bartonella henselae; identical to SEQ ID NO: 28841
  CDS (1)..(1392)

SEQ ID NO: 50528 - protein, 463 aa, Bartonella henselae; identical to SEQ ID NO: 28842

SEQ ID NO: 50529 - DNA, 1368 bp, Photobacterium profundum; identical to SEQ ID NO: 28843
  CDS (1)..(1368)

SEQ ID NO: 50530 - protein, 455 aa, Photobacterium profundum; identical to SEQ ID NO: 28844

SEQ ID NO: 50531 - DNA, 1455 bp, Parachlamydia sp; identical to SEQ ID NO: 28845
  CDS (1)..(1455)

SEQ ID NO: 50532 - protein, 484 aa, Parachlamydia sp; identical to SEQ ID NO: 28846

SEQ ID NO: 50533 - DNA, 1563 bp, Rhodopseudomonas palustris; identical to SEQ ID NO: 28847
  CDS (1)..(1563)

SEQ ID NO: 50534 - protein, 520 aa, Rhodopseudomonas palustris; identical to SEQ ID NO: 28848

SEQ ID NO: 50535 - DNA, 1506 bp, Rhodopseudomonas palustris; identical to SEQ ID NO: 28849
  CDS (1)..(1506)

SEQ ID NO: 50536 - protein, 501 aa, Rhodopseudomonas palustris; identical to SEQ ID NO: 28850

SEQ ID NO: 50537 - DNA, 1200 bp, Rhodopseudomonas palustris; identical to SEQ ID NO: 28851
  CDS (1)..(1200)

SEQ ID NO: 50538 - protein, 399 aa, Rhodopseudomonas palustris; identical to SEQ ID NO: 28852

SEQ ID NO: 50539 - DNA, 1392 bp, Rhodopseudomonas palustris; identical to SEQ ID NO: 28853
  CDS (1)..(1392)

SEQ ID NO: 50540 - protein, 463 aa, Rhodopseudomonas palustris; identical to SEQ ID NO: 28854

SEQ ID NO: 50541 - DNA, 1572 bp, Rhodopseudomonas palustris; identical to SEQ ID NO: 28855
  CDS (1)..(1572)

SEQ ID NO: 50542 - protein, 523 aa, Rhodopseudomonas palustris; identical to SEQ ID NO: 28856

SEQ ID NO: 50543 - DNA, 1401 bp, uncultured bacterium 580; identical to SEQ ID NO: 28857
  CDS (1)..(1401)

SEQ ID NO: 50544 - protein, 466 aa, uncultured bacterium 580; identical to SEQ ID NO: 28858

SEQ ID NO: 50545 - DNA, 1476 bp, uncultured bacterium 106; identical to SEQ ID NO: 28859
  CDS (1)..(1476)

SEQ ID NO: 50546 - protein, 491 aa, uncultured bacterium 106; identical to SEQ ID NO: 28860

SEQ ID NO: 50547 - DNA, 1143 bp, uncultured bacterium 105; identical to SEQ ID NO: 28861
  CDS (1)..(1143)

SEQ ID NO: 50548 - protein, 380 aa, uncultured bacterium 105; identical to SEQ ID NO: 28862

SEQ ID NO: 50549 - DNA, 1395 bp, Rhizobium sp; identical to SEQ ID NO: 28863
  CDS (1)..(1395)

SEQ ID NO: 50550 - protein, 464 aa, Rhizobium sp; identical to SEQ ID NO: 28864

SEQ ID NO: 50551 - DNA, 1449 bp, Desulfovibrio vulgaris; identical to SEQ ID NO: 28865
  CDS (1)..(1449)

SEQ ID NO: 50552 - protein, 482 aa, Desulfovibrio vulgaris; identical to SEQ ID NO: 28866

SEQ ID NO: 50553 - DNA, 1167 bp, Leptospira interrogans; identical to SEQ ID NO: 28867
  CDS (1)..(1167)

SEQ ID NO: 50554 - protein, 388 aa, Leptospira interrogans; identical to SEQ ID NO: 28868

SEQ ID NO: 50555 - DNA, 1494 bp, Wolbachia pipientis wMel; identical to SEQ ID NO: 28869
  CDS (1)..(1494)

SEQ ID NO: 50556 - protein, 497 aa, Wolbachia pipientis wMel; identical to SEQ ID NO: 28870

SEQ ID NO: 50557 - DNA, 1482 bp, Treponema denticola; identical to SEQ ID NO: 28871
  CDS (1)..(1482)

SEQ ID NO: 50558 - protein, 493 aa, Treponema denticola; identical to SEQ ID NO: 28872

SEQ ID NO: 50559 - DNA, 1395 bp, Geobacter sulfurreducens; identical to SEQ ID NO: 28873
  CDS (1)..(1395)

SEQ ID NO: 50560 - protein, 464 aa, Geobacter sulfurreducens; identical to SEQ ID NO: 28874

SEQ ID NO: 50561 - DNA, 1416 bp, Geobacter sulfurreducens; identical to SEQ ID NO: 28875
  CDS (1)..(1416)

SEQ ID NO: 50562 - protein, 471 aa, Geobacter sulfurreducens; identical to SEQ ID NO: 28876

SEQ ID NO: 50563 - DNA, 1221 bp, Lactobacillus johnsonii; identical to SEQ ID NO: 28877
  CDS (1)..(1221)

SEQ ID NO: 50564 - protein, 406 aa, Lactobacillus johnsonii; identical to SEQ ID NO: 28878

SEQ ID NO: 50565 - DNA, 1425 bp, Wolinella succinogenes; identical to SEQ ID NO: 28879
  CDS (1)..(1425)

SEQ ID NO: 50566 - protein, 474 aa, Wolinella succinogenes; identical to SEQ ID NO: 28880

SEQ ID NO: 50567 - DNA, 1368 bp, Vibrio vulnificus; identical to SEQ ID NO: 28881
  CDS (1)..(1368)

SEQ ID NO: 50568 - protein, 455 aa, Vibrio vulnificus; identical to SEQ ID NO: 28882

SEQ ID NO: 50569 - DNA, 1497 bp, Porphyromonas gingivalis; identical to SEQ ID NO: 28883
  CDS (1)..(1497)

SEQ ID NO: 50570 - protein, 498 aa, Porphyromonas gingivalis; identical to SEQ ID NO: 28884

SEQ ID NO: 50571 - DNA, 1320 bp, Gloeobacter violaceus; identical to SEQ ID NO: 28885
  CDS (1)..(1320)

SEQ ID NO: 50572 - protein, 439 aa, Gloeobacter violaceus; identical to SEQ ID NO: 28886

SEQ ID NO: 50573 - DNA, 1467 bp, Chromobacterium violaceum; identical to SEQ ID NO: 28887
  CDS (1)..(1467)

SEQ ID NO: 50574 - protein, 488 aa, Chromobacterium violaceum; identical to SEQ ID NO: 28888

SEQ ID NO: 50575 - DNA, 1413 bp, Chromobacterium violaceum; identical to SEQ ID NO: 28889
  CDS (1)..(1413)

SEQ ID NO: 50576 - protein, 470 aa, Chromobacterium violaceum; identical to SEQ ID NO: 28890

SEQ ID NO: 50577 - DNA, 1158 bp, Prochlorococcus marinus; identical to SEQ ID NO: 28891
  CDS (1)..(1158)

SEQ ID NO: 50578 - protein, 385 aa, Prochlorococcus marinus; identical to SEQ ID NO: 28892

SEQ ID NO: 50579 - DNA, 1125 bp, Synechococcus sp; identical to SEQ ID NO: 28893
  CDS (1)..(1125)

SEQ ID NO: 50580 - protein, 374 aa, Synechococcus sp; identical to SEQ ID NO: 28894

SEQ ID NO: 50581 - DNA, 1299 bp, Synechococcus sp; identical to SEQ ID NO: 28895
  CDS (1)..(1299)

SEQ ID NO: 50582 - protein, 432 aa, Synechococcus sp; identical to SEQ ID NO: 28896

SEQ ID NO: 50583 - DNA, 1527 bp, Rhodopirellula baltica; identical to SEQ ID NO: 28897
  CDS (1)..(1527)

SEQ ID NO: 50584 - protein, 508 aa, Rhodopirellula baltica; identical to SEQ ID NO: 28898

SEQ ID NO: 50585 - DNA, 1530 bp, Rhodopirellula baltica; identical to SEQ ID NO: 28899
  CDS (1)..(1530)

SEQ ID NO: 50586 - protein, 509 aa, Rhodopirellula baltica; identical to SEQ ID NO: 28900

SEQ ID NO: 50587 - DNA, 1890 bp, Rhodopirellula baltica; identical to SEQ ID NO: 28901
  CDS (1)..(1890)

SEQ ID NO: 50588 - protein, 629 aa, Rhodopirellula baltica; identical to SEQ ID NO: 28902

SEQ ID NO: 50589 - DNA, 1188 bp, Prochlorococcus marinus; identical to SEQ ID NO: 28903
  CDS (1)..(1188)

SEQ ID NO: 50590 - protein, 395 aa, Prochlorococcus marinus; identical to SEQ ID NO: 28904

SEQ ID NO: 50591 - DNA, 1176 bp, Prochlorococcus marinus; identical to SEQ ID NO: 28905
  CDS (1)..(1176)

SEQ ID NO: 50592 - protein, 391 aa, Prochlorococcus marinus; identical to SEQ ID NO: 28906

SEQ ID NO: 50593 - DNA, 1434 bp, Helicobacter hepaticus; identical to SEQ ID NO: 28907
  CDS (1)..(1434)

SEQ ID NO: 50594 - protein, 477 aa, Helicobacter hepaticus; identical to SEQ ID NO: 28908

SEQ ID NO: 50595 - DNA, 1419 bp, Haemophilus ducreyi; identical to SEQ ID NO: 28909
  CDS (1)..(1419)

SEQ ID NO: 50596 - protein, 472 aa, Haemophilus ducreyi; identical to SEQ ID NO: 28910

SEQ ID NO: 50597 - DNA, 1386 bp, Candidatus Blochmannia floridanus; identical to SEQ ID NO: 28911
  CDS (1)..(1386)

SEQ ID NO: 50598 - protein, 461 aa, Candidatus Blochmannia floridanus; identical to SEQ ID NO: 28912

SEQ ID NO: 50599 - DNA, 1137 bp, Bordetella pertussis; identical to SEQ ID NO: 28913
  CDS (1)..(1137)

SEQ ID NO: 50600 - protein, 378 aa, Bordetella pertussis; identical to SEQ ID NO: 28914

SEQ ID NO: 50601 - DNA, 1116 bp, Bordetella parapertussis; identical to SEQ ID NO: 28915
  CDS (1)..(1116)

SEQ ID NO: 50602 - protein, 371 aa, Bordetella parapertussis; identical to SEQ ID NO: 28916

SEQ ID NO: 50603 - DNA, 1488 bp, Bordetella parapertussis; identical to SEQ ID NO: 28917
  CDS (1)..(1488)

SEQ ID NO: 50604 - protein, 495 aa, Bordetella parapertussis; identical to SEQ ID NO: 28918

SEQ ID NO: 50605 - DNA, 1467 bp, Chlamydophila caviae; identical to SEQ ID NO: 28919
  CDS (1)..(1467)

SEQ ID NO: 50606 - protein, 488 aa, Chlamydophila caviae; identical to SEQ ID NO: 28920

SEQ ID NO: 50607 - DNA, 1419 bp, Streptomyces avermitilis; identical to SEQ ID NO: 28921
  CDS (1)..(1419)

SEQ ID NO: 50608 - protein, 472 aa, Streptomyces avermitilis; identical to SEQ ID NO: 28922

SEQ ID NO: 50609 - DNA, 1491 bp, Nitrosomonas europaea; identical to SEQ ID NO: 28923
  CDS (1)..(1491)

SEQ ID NO: 50610 - protein, 496 aa, Nitrosomonas europaea; identical to SEQ ID NO: 28924

SEQ ID NO: 50611 - DNA, 1323 bp, Enterococcus faecalis; identical to SEQ ID NO: 28925
  CDS (25)..(1323)

SEQ ID NO: 50612 - protein, 432 aa, Enterococcus faecalis; identical to SEQ ID NO: 28926

SEQ ID NO: 50613 - DNA, 1356 bp, Coxiella burnetii; identical to SEQ ID NO: 28927
  CDS (1)..(1356)

SEQ ID NO: 50614 - protein, 451 aa, Coxiella burnetii; identical to SEQ ID NO: 28928

SEQ ID NO: 50615 - DNA, 1368 bp, Enterobacter cloacae; identical to SEQ ID NO: 28929
  CDS (1)..(1368)

SEQ ID NO: 50616 - protein, 455 aa, Enterobacter cloacae; identical to SEQ ID NO: 28930

SEQ ID NO: 50617 - DNA, 1545 bp, Xylella fastidiosa; identical to SEQ ID NO: 28931
  CDS (1)..(1545)

SEQ ID NO: 50618 - protein, 514 aa, Xylella fastidiosa; identical to SEQ ID NO: 28932

SEQ ID NO: 50619 - DNA, 1377 bp, Xylella fastidiosa; identical to SEQ ID NO: 28933
  CDS (1)..(1377)

SEQ ID NO: 50620 - protein, 458 aa, Xylella fastidiosa; identical to SEQ ID NO: 28934

SEQ ID NO: 50621 - DNA, 1368 bp, Vibrio parahaemolyticus; identical to SEQ ID NO: 28935
  CDS (1)..(1368)

SEQ ID NO: 50622 - protein, 455 aa, Vibrio parahaemolyticus; identical to SEQ ID NO: 28936

SEQ ID NO: 50623 - DNA, 1161 bp, Pseudomonas syringae; identical to SEQ ID NO: 28937
  CDS (1)..(1161)

SEQ ID NO: 50624 - protein, 386 aa, Pseudomonas syringae; identical to SEQ ID NO: 28938

SEQ ID NO: 50625 - DNA, 1440 bp, Pseudomonas syringae; identical to SEQ ID NO: 28939
  CDS (1)..(1440)

SEQ ID NO: 50626 - protein, 479 aa, Pseudomonas syringae; identical to SEQ ID NO: 28940

SEQ ID NO: 50627 - DNA, 1479 bp, Pseudomonas putida; identical to SEQ ID NO: 28941
  CDS (1)..(1479)

SEQ ID NO: 50628 - protein, 492 aa, Pseudomonas putida; identical to SEQ ID NO: 28942

SEQ ID NO: 50629 - DNA, 1524 bp, Bradyrhizobium japonicum; identical to SEQ ID NO: 28943
  CDS (1)..(1524)

SEQ ID NO: 50630 - protein, 507 aa, Bradyrhizobium japonicum; identical to SEQ ID NO: 28944

SEQ ID NO: 50631 - DNA, 1272 bp, Bradyrhizobium japonicum; identical to SEQ ID NO: 28945
  CDS (1)..(1272)

SEQ ID NO: 50632 - protein, 423 aa, Bradyrhizobium japonicum; identical to SEQ ID NO: 28946

SEQ ID NO: 50633 - DNA, 1578 bp, Bradyrhizobium japonicum; identical to SEQ ID NO: 28947
  CDS (1)..(1578)

SEQ ID NO: 50634 - protein, 525 aa, Bradyrhizobium japonicum; identical to SEQ ID NO: 28948

SEQ ID NO: 50635 - DNA, 1587 bp, Bradyrhizobium japonicum; identical to SEQ ID NO: 28949
  CDS (1)..(1587)

SEQ ID NO: 50636 - protein, 528 aa, Bradyrhizobium japonicum; identical to SEQ ID NO: 28950

SEQ ID NO: 50637 - DNA, 1536 bp, Bacteroides thetaiotaomicron; identical to SEQ ID NO: 28951
  CDS (1)..(1536)

SEQ ID NO: 50638 - protein, 511 aa, Bacteroides thetaiotaomicron; identical to SEQ ID NO: 28952

SEQ ID NO: 50639 - DNA, 1410 bp, Escherichia coli O6; identical to SEQ ID NO: 28953
  CDS (1)..(1410)

SEQ ID NO: 50640 - protein, 469 aa, Escherichia coli O6; identical to SEQ ID NO: 28954

SEQ ID NO: 50641 - DNA, 1392 bp, Yersinia pestis; identical to SEQ ID NO: 28955
  CDS (1)..(1392)

SEQ ID NO: 50642 - protein, 463 aa, Yersinia pestis; identical to SEQ ID NO: 28956

SEQ ID NO: 50643 - DNA, 1374 bp, Wigglesworthia glossinidia brevipalpis; identical to SEQ ID NO: 28957
  CDS (1)..(1374)

SEQ ID NO: 50644 - protein, 457 aa, Wigglesworthia glossinidia brevipalpis; identical to SEQ ID NO: 28958

SEQ ID NO: 50645 - DNA, 1128 bp, Synechococcus elongatus; identical to SEQ ID NO: 28959
  CDS (1)..(1128)

SEQ ID NO: 50646 - protein, 375 aa, Synechococcus elongatus; identical to SEQ ID NO: 28960

SEQ ID NO: 50647 - DNA, 1170 bp, Synechococcus elongatus; identical to SEQ ID NO: 28961
  CDS (1)..(1170)

SEQ ID NO: 50648 - protein, 389 aa, Synechococcus elongatus; identical to SEQ ID NO: 28962

SEQ ID NO: 50649 - DNA, 1353 bp, Shewanella oneidensis; identical to SEQ ID NO: 28963
  CDS (1)..(1353)

SEQ ID NO: 50650 - protein, 450 aa, Shewanella oneidensis; identical to SEQ ID NO: 28964

SEQ ID NO: 50651 - DNA, 1518 bp, Chlorobium tepidum; identical to SEQ ID NO: 28965
  CDS (1)..(1518)

SEQ ID NO: 50652 - protein, 505 aa, Chlorobium tepidum; identical to SEQ ID NO: 28966

SEQ ID NO: 50653 - DNA, 1461 bp, Rhizobium etli; identical to SEQ ID NO: 28967
  CDS (1)..(1461)

SEQ ID NO: 50654 - protein, 486 aa, Rhizobium etli; identical to SEQ ID NO: 28968

SEQ ID NO: 50655 - DNA, 1368 bp, Pasteurella piscicida; identical to SEQ ID NO: 28969
  CDS (1)..(1368)

SEQ ID NO: 50656 - protein, 455 aa, Pasteurella piscicida; identical to SEQ ID NO: 28970

SEQ ID NO: 50657 - DNA, 1437 bp, Xanthomonas campestris; identical to SEQ ID NO: 28971
  CDS (1)..(1437)

SEQ ID NO: 50658 - protein, 478 aa, Xanthomonas campestris; identical to SEQ ID NO: 28972

SEQ ID NO: 50659 - DNA, 1437 bp, Xanthomonas axonopodis; identical to SEQ ID NO: 28973
  CDS (1)..(1437)

SEQ ID NO: 50660 - protein, 478 aa, Xanthomonas axonopodis; identical to SEQ ID NO: 28974

SEQ ID NO: 50661 - DNA, 1578 bp, Xanthomonas axonopodis; identical to SEQ ID NO: 28975
  CDS (1)..(1578)

SEQ ID NO: 50662 - protein, 525 aa, Xanthomonas axonopodis; identical to SEQ ID NO: 28976

SEQ ID NO: 50663 - DNA, 2077 bp, Klebsiella pneumoniae; identical to SEQ ID NO: 28977
  CDS (374)..(1807)

SEQ ID NO: 50664 - protein, 477 aa, Klebsiella pneumoniae; identical to SEQ ID NO: 28978

SEQ ID NO: 50665 - DNA, 1536 bp, Xanthomonas campestris; identical to SEQ ID NO: 28979
  CDS (1)..(1536)

SEQ ID NO: 50666 - protein, 511 aa, Xanthomonas campestris; identical to SEQ ID NO: 28980

SEQ ID NO: 50667 - DNA, 1473 bp, Ralstonia solanacearum; identical to SEQ ID NO: 28981
  CDS (1)..(1473)

SEQ ID NO: 50668 - protein, 490 aa, Ralstonia solanacearum; identical to SEQ ID NO: 28982

SEQ ID NO: 50669 - DNA, 1518 bp, Ralstonia solanacearum; identical to SEQ ID NO: 28983
  CDS (1)..(1518)

SEQ ID NO: 50670 - protein, 505 aa, Ralstonia solanacearum; identical to SEQ ID NO: 28984

SEQ ID NO: 50671 - DNA, 1368 bp, Salmonella typhimurium; identical to SEQ ID NO: 28985
  CDS (1)..(1368)

SEQ ID NO: 50672 - protein, 455 aa, Salmonella typhimurium; identical to SEQ ID NO: 28986

SEQ ID NO: 50673 - DNA, 1512 bp, Rhizobium meliloti; identical to SEQ ID NO: 28987
  CDS (1)..(1512)

SEQ ID NO: 50674 - protein, 503 aa, Rhizobium meliloti; identical to SEQ ID NO: 28988

SEQ ID NO: 50675 - DNA, 1398 bp, Rhizobium meliloti; identical to SEQ ID NO: 28989
  CDS (1)..(1398)

SEQ ID NO: 50676 - protein, 465 aa, Rhizobium meliloti; identical to SEQ ID NO: 28990

SEQ ID NO: 50677 - DNA, 1551 bp, Rhizobium loti; identical to SEQ ID NO: 28991
  CDS (1)..(1551)

SEQ ID NO: 50678 - protein, 516 aa, Rhizobium loti; identical to SEQ ID NO: 28992

SEQ ID NO: 50679 - DNA, 1542 bp, Rhizobium loti; identical to SEQ ID NO: 28993
  CDS (1)..(1542)

SEQ ID NO: 50680 - protein, 513 aa, Rhizobium loti; identical to SEQ ID NO: 28994

SEQ ID NO: 50681 - DNA, 1515 bp, Rhizobium loti; identical to SEQ ID NO: 28995
  CDS (1)..(1515)

SEQ ID NO: 50682 - protein, 504 aa, Rhizobium loti; identical to SEQ ID NO: 28996

SEQ ID NO: 50683 - DNA, 1287 bp, Rhizobium loti; identical to SEQ ID NO: 28997
  CDS (1)..(1287)

SEQ ID NO: 50684 - protein, 428 aa, Rhizobium loti; identical to SEQ ID NO: 28998

SEQ ID NO: 50685 - DNA, 1446 bp, Pseudomonas syringae; identical to SEQ ID NO: 28999
  CDS (1)..(1446)

SEQ ID NO: 50686 - protein, 481 aa, Pseudomonas syringae; identical to SEQ ID NO: 29000

SEQ ID NO: 50687 - DNA, 1380 bp, Pasteurella multocida; identical to SEQ ID NO: 29001
  CDS (1)..(1380)

SEQ ID NO: 50688 - protein, 459 aa, Pasteurella multocida; identical to SEQ ID NO: 29002

SEQ ID NO: 50689 - DNA, 1362 bp, Aeromonas hydrophila; identical to SEQ ID NO: 29003
  CDS (1)..(1362)

SEQ ID NO: 50690 - protein, 453 aa, Aeromonas hydrophila; identical to SEQ ID NO: 29004

SEQ ID NO: 50691 - DNA, 1503 bp, Myxococcus xanthus; identical to SEQ ID NO: 29005
  CDS (1)..(1503)

SEQ ID NO: 50692 - protein, 500 aa, Myxococcus xanthus; identical to SEQ ID NO: 29006

SEQ ID NO: 50693 - DNA, 1476 bp, Shigella sonnei; identical to SEQ ID NO: 29007
  CDS (1)..(1476)

SEQ ID NO: 50694 - protein, 491 aa, Shigella sonnei; identical to SEQ ID NO: 29008

SEQ ID NO: 50695 - DNA, 1512 bp, Bartonella henselae; identical to SEQ ID NO: 29009
  CDS (1)..(1512)

SEQ ID NO: 50696 - protein, 503 aa, Bartonella henselae; identical to SEQ ID NO: 29010

SEQ ID NO: 50697 - DNA, 1437 bp, Buchnera aphidicola; identical to SEQ ID NO: 29011
  CDS (1)..(1437)

SEQ ID NO: 50698 - protein, 478 aa, Buchnera aphidicola; identical to SEQ ID NO: 29012

SEQ ID NO: 50699 - DNA, 1515 bp, Rhizobium meliloti; identical to SEQ ID NO: 29013
  CDS (1)..(1515)

SEQ ID NO: 50700 - protein, 504 aa, Rhizobium meliloti; identical to SEQ ID NO: 29014

SEQ ID NO: 50701 - DNA, 1377 bp, Bacillus subtilis; identical to SEQ ID NO: 29015
  CDS (1)..(1377)

SEQ ID NO: 50702 - protein, 458 aa, Bacillus subtilis; identical to SEQ ID NO: 29016

SEQ ID NO: 50703 - DNA, 24 bp, Primer
atgaaaaaaaccacattagcactg

SEQ ID NO: 50704 - DNA, 25 bp, Primer
ttactgcattaacaggtagatggtg

SEQ ID NO: 50705 - protein, 406 aa, consensus; identical to SEQ ID NO: 29019
  MISC_FEATURE (1)..(406): consensus for the disclosure of xaa see table XV

SEQ ID NO: 50706 - protein, 66 aa, consensus; identical to SEQ ID NO: 29020
  MISC_FEATURE (1)..(66): consensus for the disclosure of xaa see table XV

SEQ ID NO: 50707 - protein, 37 aa, consensus; identical to SEQ ID NO: 29021
  MISC_FEATURE (1)..(37): consensus for the disclosure of xaa see table XV

SEQ ID NO: 50708 - protein, 30 aa, consensus; identical to SEQ ID NO: 29022
  MISC_FEATURE (1)..(30): consensus for the disclosure of xaa see table XV

SEQ ID NO: 50709 - protein, 34 aa, consensus; identical to SEQ ID NO: 29023
  MISC_FEATURE (1)..(34): consensus for the disclosure of xaa see table XV

SEQ ID NO: 50710 - protein, 68 aa, consensus; identical to SEQ ID NO: 29024
  MISC_FEATURE (1)..(68): consensus for the disclosure of xaa see table XV

SEQ ID NO: 50711 - DNA, 1293 bp, Escherichia coli; identical to SEQ ID NO: 36320
  CDS (1)..(1293)

SEQ ID NO: 50712 - protein, 430 aa, Escherichia coli; identical to SEQ ID NO: 36321

SEQ ID NO: 50713 - DNA, 1524 bp, Anopheles gambiae str. PEST; identical to SEQ ID NO: 36322
  CDS (1)..(1524)

SEQ ID NO: 50714 - protein, 507 aa, Anopheles gambiae str. PEST; identical to SEQ ID NO: 36323

SEQ ID NO: 50715 - DNA, 2106 bp, Anopheles gambiae str. PEST; identical to SEQ ID NO: 36324
  CDS (1)..(1392)

SEQ ID NO: 50716 - protein, 463 aa, Anopheles gambiae str. PEST; identical to SEQ ID NO: 36325

SEQ ID NO: 50717 - DNA, 2001 bp, Anopheles gambiae str. PEST; identical to SEQ ID NO: 36326
  CDS (1)..(2001)

SEQ ID NO: 50718 - protein, 666 aa, Anopheles gambiae str. PEST; identical to SEQ ID NO: 36327

SEQ ID NO: 50719 - DNA, 2034 bp, Danio rerio; identical to SEQ ID NO: 36328
  CDS (1)..(2034)

SEQ ID NO: 50720 - protein, 677 aa, Danio rerio; identical to SEQ ID NO: 36329

SEQ ID NO: 50721 - DNA, 1428 bp, Danio rerio; identical to SEQ ID NO: 36330
  CDS (1)..(1428)

SEQ ID NO: 50722 - protein, 475 aa, Danio rerio; identical to SEQ ID NO: 36331

SEQ ID NO: 50723 - DNA, 1923 bp, Danio rerio; identical to SEQ ID NO: 36332
  CDS (1)..(1923)

SEQ ID NO: 50724 - protein, 640 aa, Danio rerio; identical to SEQ ID NO: 36333

SEQ ID NO: 50725 - DNA, 2211 bp, Archaeoglobus fulgidus DSM 4304; identical to SEQ ID NO: 36334
  CDS (1)..(2211)

SEQ ID NO: 50726 - protein, 736 aa, Archaeoglobus fulgidus DSM 4304; identical to SEQ ID NO: 36335

SEQ ID NO: 50727 - DNA, 1596 bp, Archaeoglobus fulgidus DSM 4304; identical to SEQ ID NO: 36336
  CDS (1)..(1596)

SEQ ID NO: 50728 - protein, 531 aa, Archaeoglobus fulgidus DSM 4304; identical to SEQ ID NO: 36337

SEQ ID NO: 50729 - DNA, 1692 bp, Thermoplasma volcanium GSS1; identical to SEQ ID NO: 36338
  CDS (1)..(1692)

SEQ ID NO: 50730 - protein, 563 aa, Thermoplasma volcanium GSS1; identical to SEQ ID NO: 36339

SEQ ID NO: 50731 - DNA, 1617 bp, Aeropyrum pernix K1; identical to SEQ ID NO: 36340
  CDS (1)..(1617)

SEQ ID NO: 50732 - protein, 538 aa, Aeropyrum pernix K1; identical to SEQ ID NO: 36341

SEQ ID NO: 50733 - DNA, 1773 bp, Arabidopsis thaliana; identical to SEQ ID NO: 36342
  CDS (1)..(1773)

SEQ ID NO: 50734 - protein, 590 aa, Arabidopsis thaliana; identical to SEQ ID NO: 36343

SEQ ID NO: 50735 - DNA, 1710 bp, Arabidopsis thaliana; identical to SEQ ID NO: 36344
  CDS (1)..(1710)

SEQ ID NO: 50736 - protein, 569 aa, Arabidopsis thaliana; identical to SEQ ID NO: 36345

SEQ ID NO: 50737 - DNA, 1803 bp, Arabidopsis thaliana; identical to SEQ ID NO: 36346
  CDS (1)..(1803)

SEQ ID NO: 50738 - protein, 600 aa, Arabidopsis thaliana; identical to SEQ ID NO: 36347

SEQ ID NO: 50739 - DNA, 1755 bp, Arabidopsis thaliana; identical to SEQ ID NO: 36348
  CDS (1)..(1755)

SEQ ID NO: 50740 - protein, 584 aa, Arabidopsis thaliana; identical to SEQ ID NO: 36349

SEQ ID NO: 50741 - DNA, 1752 bp, Arabidopsis thaliana; identical to SEQ ID NO: 36350
  CDS (1)..(1752)

SEQ ID NO: 50742 - protein, 583 aa, Arabidopsis thaliana; identical to SEQ ID NO: 36351

SEQ ID NO: 50743 - DNA, 1830 bp, Arabidopsis thaliana; identical to SEQ ID NO: 36352
  CDS (1)..(1830)

SEQ ID NO: 50744 - protein, 609 aa, Arabidopsis thaliana; identical to SEQ ID NO: 36353

SEQ ID NO: 50745 - DNA, 1434 bp, Pseudomonas aeruginosa PAO1; identical to SEQ ID NO: 36354
  CDS (1)..(1434)

SEQ ID NO: 50746 - protein, 477 aa, Pseudomonas aeruginosa PAO1; identical to SEQ ID NO: 36355

SEQ ID NO: 50747 - DNA, 1356 bp, Pseudomonas aeruginosa PAO1; identical to SEQ ID NO: 36356
  CDS (1)..(1356)

SEQ ID NO: 50748 - protein, 451 aa, Pseudomonas aeruginosa PAO1; identical to SEQ ID NO: 36357

SEQ ID NO: 50749 - DNA, 1410 bp, Lactococcus lactis subsp. lactis Il1403; identical to SEQ ID NO: 36358
  CDS (1)..(1410)

SEQ ID NO: 50750 - protein, 469 aa, Lactococcus lactis subsp. lactis Il1403; identical to SEQ ID NO: 36359

SEQ ID NO: 50751 - DNA, 1344 bp, Streptococcus pyogenes M1 GAS; identical to SEQ ID NO: 36360
  CDS (1)..(1344)

SEQ ID NO: 50752 - protein, 447 aa, Streptococcus pyogenes M1 GAS; identical to SEQ ID NO: 36361

SEQ ID NO: 50753 - DNA, 1275 bp, Methanothermobacter thermautotrophicus str. Delta H; identical to SEQ ID NO: 36362
  CDS (1)..(1275)

SEQ ID NO: 50754 - protein, 424 aa, Methanothermobacter thermautotrophicus str. Delta H; identical to SEQ ID NO: 36363

SEQ ID NO: 50755 - DNA, 2331 bp, Halobacterium salinarum NRC-1; identical to SEQ ID NO: 36364
  CDS (1)..(2331)

SEQ ID NO: 50756 - protein, 776 aa, Halobacterium salinarum NRC-1; identical to SEQ ID NO: 36365

SEQ ID NO: 50757 - DNA, 1530 bp, Xylella fastidiosa 9a5c; identical to SEQ ID NO: 36366
  CDS (1)..(1530)

SEQ ID NO: 50758 - protein, 509 aa, Xylella fastidiosa 9a5c; identical to SEQ ID NO: 36367

SEQ ID NO: 50759 - DNA, 1434 bp, Xylella fastidiosa 9a5c; identical to SEQ ID NO: 36368
  CDS (1)..(1434)

SEQ ID NO: 50760 - protein, 477 aa, Xylella fastidiosa 9a5c; identical to SEQ ID NO: 36369

SEQ ID NO: 50761 - DNA, 1518 bp, Mycobacterium leprae TN; identical to SEQ ID NO: 36370
  CDS (1)..(1518)

SEQ ID NO: 50762 - protein, 505 aa, Mycobacterium leprae TN; identical to SEQ ID NO: 36371

SEQ ID NO: 50763 - DNA, 1719 bp, Mycobacterium leprae TN; identical to SEQ ID NO: 36372
  CDS (1)..(1719)

SEQ ID NO: 50764 - protein, 572 aa, Mycobacterium leprae TN; identical to SEQ ID NO: 36373

SEQ ID NO: 50765 - DNA, 1305 bp, Mycobacterium tuberculosis CDC1551; identical to SEQ ID NO: 9113
  CDS (1)..(1305)

SEQ ID NO: 50766 - protein, 434 aa, Mycobacterium tuberculosis CDC1551; identical to SEQ ID NO: 9114

SEQ ID NO: 50767 - DNA, 1416 bp, Mycobacterium tuberculosis CDC1551; identical to SEQ ID NO: 36376
  CDS (1)..(1416)

SEQ ID NO: 50768 - protein, 471 aa, Mycobacterium tuberculosis CDC1551; identical to SEQ ID NO: 36377

SEQ ID NO: 50769 - DNA, 1488 bp, Mycobacterium tuberculosis CDC1551; identical to SEQ ID NO: 36378
  CDS (1)..(1488)

SEQ ID NO: 50770 - protein, 495 aa, Mycobacterium tuberculosis CDC1551; identical to SEQ ID NO: 36379

SEQ ID NO: 50771 - DNA, 1254 bp, Sulfolobus solfataricus P2; identical to SEQ ID NO: 36380
  CDS (1)..(1254)

SEQ ID NO: 50772 - protein, 417 aa, Sulfolobus solfataricus P2; identical to SEQ ID NO: 36381

SEQ ID NO: 50773 - DNA, 1401 bp, Clostridium acetobutylicum ATCC 824; identical to SEQ ID NO: 36382
  CDS (1)..(1401)

SEQ ID NO: 50774 - protein, 466 aa, Clostridium acetobutylicum ATCC 824; identical to SEQ ID NO: 36383

SEQ ID NO: 50775 - DNA, 1404 bp, Streptococcus pneumoniae R6; identical to SEQ ID NO: 36384
  CDS (1)..(1404)

SEQ ID NO: 50776 - protein, 467 aa, Streptococcus pneumoniae R6; identical to SEQ ID NO: 36385

SEQ ID NO: 50777 - DNA, 1398 bp, Rickettsia conorii str. Malish 7; identical to SEQ ID NO: 36386
  CDS (1)..(1398)

SEQ ID NO: 50778 - protein, 465 aa, Rickettsia conorii str. Malish 7; identical to SEQ ID NO: 36387

SEQ ID NO: 50779 - DNA, 1638 bp, Staphylococcus aureus subsp. aureus Mu50; identical to SEQ ID NO: 36388
  CDS (1)..(1638)

SEQ ID NO: 50780 - protein, 545 aa, Staphylococcus aureus subsp. aureus Mu50; identical to SEQ ID NO: 36389

SEQ ID NO: 50781 - DNA, 1449 bp, Staphylococcus aureus subsp. aureus Mu50; identical to SEQ ID NO: 36390
  CDS (1)..(1449)

SEQ ID NO: 50782 - protein, 482 aa, Staphylococcus aureus subsp. aureus Mu50; identical to SEQ ID NO: 36391

SEQ ID NO: 50783 - DNA, 1278 bp, Sulfolobus tokodaii str. 7; identical to SEQ ID NO: 36392
  CDS (1)..(1278)

SEQ ID NO: 50784 - protein, 425 aa, Sulfolobus tokodaii str. 7; identical to SEQ ID NO: 36393

SEQ ID NO: 50785 - DNA, 1386 bp, Bacillus subtilis subsp. subtilis str. 168; identical to SEQ ID NO: 36394
  CDS (1)..(1386)

SEQ ID NO: 50786 - protein, 461 aa, Bacillus subtilis subsp. subtilis str. 168; identical to SEQ ID NO: 36395

SEQ ID NO: 50787 - DNA, 1464 bp, Halobacterium salinarum NRC-1; identical to SEQ ID NO: 36396
  CDS (1)..(1464)

SEQ ID NO: 50788 - protein, 487 aa, Halobacterium salinarum NRC-1; identical to SEQ ID NO: 36397

SEQ ID NO: 50789 - DNA, 1527 bp, Yersinia pestis CO92; identical to SEQ ID NO: 36398
  CDS (1)..(1527)

SEQ ID NO: 50790 - protein, 508 aa, Yersinia pestis CO92; identical to SEQ ID NO: 36399

SEQ ID NO: 50791 - DNA, 1392 bp, Yersinia pestis CO92; identical to SEQ ID NO: 9051
  CDS (1)..(1392)

SEQ ID NO: 50792 - protein, 463 aa, Yersinia pestis CO92; identical to SEQ ID NO: 9052

SEQ ID NO: 50793 - DNA, 1551 bp, Escherichia coli K12; identical to SEQ ID NO: 36402
  CDS (1)..(1551)

SEQ ID NO: 50794 - protein, 516 aa, Escherichia coli K12; identical to SEQ ID NO: 36403

SEQ ID NO: 50795 - DNA, 1389 bp, Escherichia coli K12; identical to SEQ ID NO: 36404
  CDS (1)..(1389)

SEQ ID NO: 50796 - protein, 462 aa, Escherichia coli K12; identical to SEQ ID NO: 36405

SEQ ID NO: 50797 - DNA, 1503 bp, Caulobacter crescentus CB15; identical to SEQ ID NO: 36406
  CDS (1)..(1503)

SEQ ID NO: 50798 - protein, 500 aa, Caulobacter crescentus CB15; identical to SEQ ID NO: 36407

SEQ ID NO: 50799 - DNA, 1641 bp, Caulobacter crescentus CB15; identical to SEQ ID NO: 36408
  CDS (1)..(1641)

SEQ ID NO: 50800 - protein, 546 aa, Caulobacter crescentus CB15; identical to SEQ ID NO: 36409

SEQ ID NO: 50801 - DNA, 1302 bp, Caulobacter crescentus CB15; identical to SEQ ID NO: 36410
  CDS (1)..(1302)

SEQ ID NO: 50802 - protein, 433 aa, Caulobacter crescentus CB15; identical to SEQ ID NO: 36411

SEQ ID NO: 50803 - DNA, 1326 bp, Sinorhizobium meliloti 1021; identical to SEQ ID NO: 36412
  CDS (1)..(1326)

SEQ ID NO: 50804 - protein, 441 aa, Sinorhizobium meliloti 1021; identical to SEQ ID NO: 36413

SEQ ID NO: 50805 - DNA, 1392 bp, Listeria monocytogenes EGD-e; identical to SEQ ID NO: 36414
  CDS (1)..(1392)

SEQ ID NO: 50806 - protein, 463 aa, Listeria monocytogenes EGD-e; identical to SEQ ID NO: 36415

SEQ ID NO: 50807 - DNA, 1368 bp, Nostoc sp. PCC 7120; identical to SEQ ID NO: 36416
  CDS (1)..(1368)

SEQ ID NO: 50808 - protein, 455 aa, Nostoc sp. PCC 7120; identical to SEQ ID NO: 36417

SEQ ID NO: 50809 - DNA, 1626 bp, Caenorhabditis elegans; identical to SEQ ID NO: 36418
  CDS (1)..(1626)

SEQ ID NO: 50810 - protein, 541 aa, Caenorhabditis elegans; identical to SEQ ID NO: 36419

SEQ ID NO: 50811 - DNA, 1752 bp, Caenorhabditis elegans; identical to SEQ ID NO: 36420
  CDS (1)..(1752)

SEQ ID NO: 50812 - protein, 583 aa, Caenorhabditis elegans; identical to SEQ ID NO: 36421

SEQ ID NO: 50813 - DNA, 1770 bp, Caenorhabditis elegans; identical to SEQ ID NO: 36422
  CDS (1)..(1770)

SEQ ID NO: 50814 - protein, 589 aa, Caenorhabditis elegans; identical to SEQ ID NO: 36423

SEQ ID NO: 50815 - DNA, 1482 bp, Caenorhabditis elegans; identical to SEQ ID NO: 36424
  CDS (1)..(1482)

SEQ ID NO: 50816 - protein, 493 aa, Caenorhabditis elegans; identical to SEQ ID NO: 36425

SEQ ID NO: 50817 - DNA, 1431 bp, Ralstonia solanacearum GMI1000; identical to SEQ ID NO: 36426
  CDS (1)..(1431)

SEQ ID NO: 50818 - protein, 476 aa, Ralstonia solanacearum GMI1000; identical to SEQ ID NO: 36427

SEQ ID NO: 50819 - DNA, 1458 bp, Agrobacterium tumefaciens str. C58; identical to SEQ ID NO: 9087
  CDS (1)..(1458)

SEQ ID NO: 50820 - protein, 485 aa, Agrobacterium tumefaciens str. C58; identical to SEQ ID NO: 9088

SEQ ID NO: 50821 - DNA, 1323 bp, Clostridium perfringens str. 13; identical to SEQ ID NO: 36430
  CDS (1)..(1323)

SEQ ID NO: 50822 - protein, 440 aa, Clostridium perfringens str. 13; identical to SEQ ID NO: 36431

SEQ ID NO: 50823 - DNA, 1383 bp, Clostridium perfringens str. 13; identical to SEQ ID NO: 36432
  CDS (1)..(1383)

SEQ ID NO: 50824 - protein, 460 aa, Clostridium perfringens str. 13; identical to SEQ ID NO: 36433

SEQ ID NO: 50825 - DNA, 1710 bp, Arabidopsis thaliana; identical to SEQ ID NO: 36434
  CDS (1)..(1710)

SEQ ID NO: 50826 - protein, 569 aa, Arabidopsis thaliana; identical to SEQ ID NO: 36435

SEQ ID NO: 50827 - DNA, 1503 bp, Drosophila melanogaster; identical to SEQ ID NO: 36436
  CDS (1)..(1503)

SEQ ID NO: 50828 - protein, 500 aa, Drosophila melanogaster; identical to SEQ ID NO: 36437

SEQ ID NO: 50829 - DNA, 1320 bp, Methanosarcina acetivorans C2A; identical to SEQ ID NO: 36438
  CDS (1)..(1320)

SEQ ID NO: 50830 - protein, 439 aa, Methanosarcina acetivorans C2A; identical to SEQ ID NO: 36439

SEQ ID NO: 50831 - DNA, 1293 bp, Methanosarcina acetivorans C2A; identical to SEQ ID NO: 36440
  CDS (1)..(1293)

SEQ ID NO: 50832 - protein, 430 aa, Methanosarcina acetivorans C2A; identical to SEQ ID NO: 36441

SEQ ID NO: 50833 - DNA, 1320 bp, Methanosarcina acetivorans C2A; identical to SEQ ID NO: 36442
  CDS (1)..(1320)

SEQ ID NO: 50834 - protein, 439 aa, Methanosarcina acetivorans C2A; identical to SEQ ID NO: 36443

SEQ ID NO: 50835 - DNA, 1380 bp, Thermoanaerobacter tengcongensis MB4; identical to SEQ ID NO: 36444
  CDS (1)..(1380)

SEQ ID NO: 50836 - protein, 459 aa, Thermoanaerobacter tengcongensis MB4; identical to SEQ ID NO: 36445

SEQ ID NO: 50837 - DNA, 1440 bp, Thermoanaerobacter tengcongensis MB4; identical to SEQ ID NO: 36446
  CDS (1)..(1440)

SEQ ID NO: 50838 - protein, 479 aa, Thermoanaerobacter tengcongensis MB4; identical to SEQ ID NO: 36447

SEQ ID NO: 50839 - DNA, 1428 bp, Thermoanaerobacter tengcongensis MB4; identical to SEQ ID NO: 36448
  CDS (1)..(1428)

SEQ ID NO: 50840 - protein, 475 aa, Thermoanaerobacter tengcongensis MB4; identical to SEQ ID NO: 36449

SEQ ID NO: 50841 - DNA, 1491 bp, Streptomyces coelicolor A3(2); identical to SEQ ID NO: 36450
  CDS (1)..(1491)

SEQ ID NO: 50842 - protein, 496 aa, Streptomyces coelicolor A3(2); identical to SEQ ID NO: 36451

SEQ ID NO: 50843 - DNA, 1440 bp, Streptomyces coelicolor A3(2); identical to SEQ ID NO: 36452
  CDS (1)..(1440)

SEQ ID NO: 50844 - protein, 479 aa, Streptomyces coelicolor A3(2); identical to SEQ ID NO: 36453

SEQ ID NO: 50845 - DNA, 2238 bp, Methanosarcina mazei Go1; identical to SEQ ID NO: 36454
  CDS (1)..(2238)

SEQ ID NO: 50846 - protein, 745 aa, Methanosarcina mazei Go1; identical to SEQ ID NO: 36455

SEQ ID NO: 50847 - DNA, 1281 bp, Methanosarcina mazei Go1; identical to SEQ ID NO: 36456
  CDS (1)..(1281)

SEQ ID NO: 50848 - protein, 426 aa, Methanosarcina mazei Go1; identical to SEQ ID NO: 36457

SEQ ID NO: 50849 - DNA, 1431 bp, Xanthomonas campestris pv. campestris str. ATCC 33913; identical to SEQ ID NO: 36458
  CDS (1)..(1431)

SEQ ID NO: 50850 - protein, 476 aa, Xanthomonas campestris pv. campestris str. ATCC 33913; identical to SEQ ID NO: 36459

SEQ ID NO: 50851 - DNA, 1482 bp, Xanthomonas campestris pv. campestris str. ATCC 33913; identical to SEQ ID NO: 36460
  CDS (1)..(1482)

SEQ ID NO: 50852 - protein, 493 aa, Xanthomonas campestris pv. campestris str. ATCC 33913; identical to SEQ ID NO: 36461

SEQ ID NO: 50853 - DNA, 1587 bp, Xanthomonas campestris pv. campestris str. ATCC 33913; identical to SEQ ID NO: 36462
  CDS (1)..(1587)

SEQ ID NO: 50854 - protein, 528 aa, Xanthomonas campestris pv. campestris str. ATCC 33913; identical to SEQ ID NO: 36463

SEQ ID NO: 50855 - DNA, 1302 bp, Xanthomonas campestris pv. campestris str. ATCC 33913; identical to SEQ ID NO: 36464
  CDS (1)..(1302)

SEQ ID NO: 50856 - protein, 433 aa, Xanthomonas campestris pv. campestris str. ATCC 33913; identical to SEQ ID NO: 36465

SEQ ID NO: 50857 - DNA, 1413 bp, Xanthomonas campestris pv. campestris str. ATCC 33913; identical to SEQ ID NO: 36466
  CDS (1)..(1413)

SEQ ID NO: 50858 - protein, 470 aa, Xanthomonas campestris pv. campestris str. ATCC 33913; identical to SEQ ID NO: 36467

SEQ ID NO: 50859 - DNA, 1431 bp, Xanthomonas axonopodis pv. citri str. 306; identical to SEQ ID NO: 36468
  CDS (1)..(1431)

SEQ ID NO: 50860 - protein, 476 aa, Xanthomonas axonopodis pv. citri str. 306; identical to SEQ ID NO: 36469

SEQ ID NO: 50861 - DNA, 1482 bp, Xanthomonas axonopodis pv. citri str. 306; identical to SEQ ID NO: 36470
  CDS (1)..(1482)

SEQ ID NO: 50862 - protein, 493 aa, Xanthomonas axonopodis pv. citri str. 306; identical to SEQ ID NO: 36471

SEQ ID NO: 50863 - DNA, 1587 bp, Xanthomonas axonopodis pv. citri str. 306; identical to SEQ ID NO: 36472
  CDS (1)..(1587)

SEQ ID NO: 50864 - protein, 528 aa, Xanthomonas axonopodis pv. citri str. 306; identical to SEQ ID NO: 36473

SEQ ID NO: 50865 - DNA, 1317 bp, Xanthomonas axonopodis pv. citri str. 306; identical to SEQ ID NO: 36474
  CDS (1)..(1317)

SEQ ID NO: 50866 - protein, 438 aa, Xanthomonas axonopodis pv. citri str. 306; identical to SEQ ID NO: 36475

SEQ ID NO: 50867 - DNA, 1416 bp, Xanthomonas axonopodis pv. citri str. 306; identical to SEQ ID NO: 36476
  CDS (1)..(1416)

SEQ ID NO: 50868 - protein, 471 aa, Xanthomonas axonopodis pv. citri str. 306; identical to SEQ ID NO: 36477

SEQ ID NO: 50869 - DNA, 2010 bp, Drosophila melanogaster; identical to SEQ ID NO: 36478
  CDS (1)..(2010)

SEQ ID NO: 50870 - protein, 669 aa, Drosophila melanogaster; identical to SEQ ID NO: 36479

SEQ ID NO: 50871 - DNA, 1815 bp, Drosophila melanogaster; identical to SEQ ID NO: 36480
  CDS (1)..(1815)

SEQ ID NO: 50872 - protein, 604 aa, Drosophila melanogaster; identical to SEQ ID NO: 36481

SEQ ID NO: 50873 - DNA, 1518 bp, Drosophila melanogaster; identical to SEQ ID NO: 36482
  CDS (1)..(1518)

SEQ ID NO: 50874 - protein, 505 aa, Drosophila melanogaster; identical to SEQ ID NO: 36483

SEQ ID NO: 50875 - DNA, 1416 bp, Bacillus anthracis str. A2012; identical to SEQ ID NO: 36484
  CDS (1)..(1416)

SEQ ID NO: 50876 - protein, 471 aa, Bacillus anthracis str. A2012; identical to SEQ ID NO: 36485

SEQ ID NO: 50877 - DNA, 1404 bp, Bacillus anthracis str. A2012; identical to SEQ ID NO: 36486
  CDS (1)..(1404)

SEQ ID NO: 50878 - protein, 467 aa, Bacillus anthracis str. A2012; identical to SEQ ID NO: 36487

SEQ ID NO: 50879 - DNA, 1287 bp, Bacillus anthracis str. A2012; identical to SEQ ID NO: 36488
  CDS (1)..(1287)

SEQ ID NO: 50880 - protein, 428 aa, Bacillus anthracis str. A2012; identical to SEQ ID NO: 36489

SEQ ID NO: 50881 - DNA, 1359 bp, Mus musculus; identical to SEQ ID NO: 36490
  CDS (1)..(1359)

SEQ ID NO: 50882 - protein, 452 aa, Mus musculus; identical to SEQ ID NO: 36491

SEQ ID NO: 50883 - DNA, 1488 bp, Chlorobium tepidum TLS; identical to SEQ ID NO: 36492
  CDS (1)..(1488)

SEQ ID NO: 50884 - protein, 495 aa, Chlorobium tepidum TLS; identical to SEQ ID NO: 36493

SEQ ID NO: 50885 - DNA, 1392 bp, Streptococcus pyogenes MGAS315; identical to SEQ ID NO: 36494
  CDS (1)..(1392)

SEQ ID NO: 50886 - protein, 463 aa, Streptococcus pyogenes MGAS315; identical to SEQ ID NO: 36495

SEQ ID NO: 50887 - DNA, 1137 bp, Thermosynechococcus elongatus BP-1; identical to SEQ ID NO: 36496
  CDS (1)..(1137)

SEQ ID NO: 50888 - protein, 378 aa, Thermosynechococcus elongatus BP-1; identical to SEQ ID NO: 36497

SEQ ID NO: 50889 - DNA, 1374 bp, Shigella flexneri 2a str. 301; identical to SEQ ID NO: 9205
  CDS (1)..(1374)

SEQ ID NO: 50890 - protein, 457 aa, Shigella flexneri 2a str. 301; identical to SEQ ID NO: 9206

SEQ ID NO: 50891 - DNA, 1293 bp, Shigella flexneri 2a str. 301; identical to SEQ ID NO: 36500
  CDS (1)..(1293)

SEQ ID NO: 50892 - protein, 430 aa, Shigella flexneri 2a str. 301; identical to SEQ ID NO: 36501

SEQ ID NO: 50893 - DNA, 1257 bp, Shigella flexneri 2a str. 301; identical to SEQ ID NO: 36502
  CDS (1)..(1257)

SEQ ID NO: 50894 - protein, 418 aa, Shigella flexneri 2a str. 301; identical to SEQ ID NO: 36503

SEQ ID NO: 50895 - DNA, 1626 bp, Drosophila melanogaster; identical to SEQ ID NO: 36504
  CDS (1)..(1626)

SEQ ID NO: 50896 - protein, 541 aa, Drosophila melanogaster; identical to SEQ ID NO: 36505

SEQ ID NO: 50897 - DNA, 1866 bp, Drosophila melanogaster; identical to SEQ ID NO: 36506
  CDS (1)..(1866)

SEQ ID NO: 50898 - protein, 621 aa, Drosophila melanogaster; identical to SEQ ID NO: 36507

SEQ ID NO: 50899 - DNA, 1353 bp, Streptococcus agalactiae NEM316; identical to SEQ ID NO: 36508
  CDS (1)..(1353)

SEQ ID NO: 50900 - protein, 450 aa, Streptococcus agalactiae NEM316; identical to SEQ ID NO: 36509

SEQ ID NO: 50901 - DNA, 1452 bp, Staphylococcus epidermidis ATCC 12228; identical to SEQ ID NO: 36510
  CDS (1)..(1452)

SEQ ID NO: 50902 - protein, 483 aa, Staphylococcus epidermidis ATCC 12228; identical to SEQ ID NO: 36511

SEQ ID NO: 50903 - DNA, 1368 bp, Bradyrhizobium japonicum USDA 110; identical to SEQ ID NO: 36512
  CDS (1)..(1368)

SEQ ID NO: 50904 - protein, 455 aa, Bradyrhizobium japonicum USDA 110; identical to SEQ ID NO: 36513

SEQ ID NO: 50905 - DNA, 1434 bp, Xylella fastidiosa Temecula1; identical to SEQ ID NO: 36514
  CDS (1)..(1434)

SEQ ID NO: 50906 - protein, 477 aa, Xylella fastidiosa Temecula1; identical to SEQ ID NO: 36515

SEQ ID NO: 50907 - DNA, 1443 bp, Xylella fastidiosa Temecula1; identical to SEQ ID NO: 36516
  CDS (1)..(1443)

SEQ ID NO: 50908 - protein, 480 aa, Xylella fastidiosa Temecula1; identical to SEQ ID NO: 36517

SEQ ID NO: 50909 - DNA, 1398 bp, Lactobacillus plantarum WCFS1; identical to SEQ ID NO: 36518
  CDS (1)..(1398)

SEQ ID NO: 50910 - protein, 465 aa, Lactobacillus plantarum WCFS1; identical to SEQ ID NO: 36519

SEQ ID NO: 50911 - DNA, 1332 bp, Lactobacillus plantarum WCFS1; identical to SEQ ID NO: 36520
  CDS (1)..(1332)

SEQ ID NO: 50912 - protein, 443 aa, Lactobacillus plantarum WCFS1; identical to SEQ ID NO: 36521

SEQ ID NO: 50913 - DNA, 1428 bp, Lactobacillus plantarum WCFS1; identical to SEQ ID NO: 36522
  CDS (1)..(1428)

SEQ ID NO: 50914 - protein, 475 aa, Lactobacillus plantarum WCFS1; identical to SEQ ID NO: 36523

SEQ ID NO: 50915 - DNA, 1500 bp, Lactobacillus plantarum WCFS1; identical to SEQ ID NO: 36524
  CDS (1)..(1500)

SEQ ID NO: 50916 - protein, 499 aa, Lactobacillus plantarum WCFS1; identical to SEQ ID NO: 36525

SEQ ID NO: 50917 - DNA, 1341 bp, Lactobacillus plantarum WCFS1; identical to SEQ ID NO: 9305
  CDS (1)..(1341)

SEQ ID NO: 50918 - protein, 446 aa, Lactobacillus plantarum WCFS1; identical to SEQ ID NO: 9306

SEQ ID NO: 50919 - DNA, 1425 bp, Lactobacillus plantarum WCFS1; identical to SEQ ID NO: 36528
  CDS (1)..(1425)

SEQ ID NO: 50920 - protein, 474 aa, Lactobacillus plantarum WCFS1; identical to SEQ ID NO: 36529

SEQ ID NO: 50921 - DNA, 1290 bp, Salmonella enterica subsp. enterica serovar Typhi Ty2; identical to SEQ ID NO: 36530
  CDS (1)..(1290)

SEQ ID NO: 50922 - protein, 429 aa, Salmonella enterica subsp. enterica serovar Typhi Ty2; identical to SEQ ID NO: 36531

SEQ ID NO: 50923 - DNA, 1392 bp, Enterococcus faecalis V583; identical to SEQ ID NO: 36532
  CDS (1)..(1392)

SEQ ID NO: 50924 - protein, 463 aa, Enterococcus faecalis V583; identical to SEQ ID NO: 36533

SEQ ID NO: 50925 - DNA, 1500 bp, Enterococcus faecalis V583; identical to SEQ ID NO: 36534
  CDS (1)..(1500)

SEQ ID NO: 50926 - protein, 499 aa, Enterococcus faecalis V583; identical to SEQ ID NO: 36535

SEQ ID NO: 50927 - DNA, 1314 bp, Coxiella burnetii RSA 493; identical to SEQ ID NO: 36536
  CDS (1)..(1314)

SEQ ID NO: 50928 - protein, 437 aa, Coxiella burnetii RSA 493; identical to SEQ ID NO: 36537

SEQ ID NO: 50929 - DNA, 1464 bp, Streptomyces avermitilis MA-4680; identical to SEQ ID NO: 9239
  CDS (1)..(1464)

SEQ ID NO: 50930 - protein, 487 aa, Streptomyces avermitilis MA-4680; identical to SEQ ID NO: 9240

SEQ ID NO: 50931 - DNA, 1479 bp, Streptomyces avermitilis MA-4680; identical to SEQ ID NO: 36540
  CDS (1)..(1479)

SEQ ID NO: 50932 - protein, 492 aa, Streptomyces avermitilis MA-4680; identical to SEQ ID NO: 36541

SEQ ID NO: 50933 - DNA, 1416 bp, Bacillus cereus ATCC 14579; identical to SEQ ID NO: 36542
  CDS (1)..(1416)

SEQ ID NO: 50934 - protein, 471 aa, Bacillus cereus ATCC 14579; identical to SEQ ID NO: 36543

SEQ ID NO: 50935 - DNA, 1311 bp, Bacillus cereus ATCC 14579; identical to SEQ ID NO: 36544
  CDS (1)..(1311)

SEQ ID NO: 50936 - protein, 436 aa, Bacillus cereus ATCC 14579; identical to SEQ ID NO: 36545

SEQ ID NO: 50937 - DNA, 1257 bp, Shigella flexneri 2a str. 2457T; identical to SEQ ID NO: 36546
  CDS (1)..(1257)

SEQ ID NO: 50938 - protein, 418 aa, Shigella flexneri 2a str. 2457T; identical to SEQ ID NO: 36547

SEQ ID NO: 50939 - DNA, 1563 bp, Nitrosomonas europaea ATCC 19718; identical to SEQ ID NO: 36548
  CDS (1)..(1563)

SEQ ID NO: 50940 - protein, 520 aa, Nitrosomonas europaea ATCC 19718; identical to SEQ ID NO: 36549

SEQ ID NO: 50941 - DNA, 1446 bp, Mycobacterium bovis AF2122/97; identical to SEQ ID NO: 36550
  CDS (1)..(1446)

SEQ ID NO: 50942 - protein, 481 aa, Mycobacterium bovis AF2122/97; identical to SEQ ID NO: 36551

SEQ ID NO: 50943 - DNA, 1470 bp, Mycobacterium bovis AF2122/97; identical to SEQ ID NO: 36552
  CDS (1)..(1470)

SEQ ID NO: 50944 - protein, 489 aa, Mycobacterium bovis AF2122/97; identical to SEQ ID NO: 9208

SEQ ID NO: 50945 - DNA, 1329 bp, Rhodopirellula baltica SH 1; identical to SEQ ID NO: 36554
  CDS (1)..(1329)

SEQ ID NO: 50946 - protein, 442 aa, Rhodopirellula baltica SH 1; identical to SEQ ID NO: 36555

SEQ ID NO: 50947 - DNA, 2190 bp, Rhodopirellula baltica SH 1; identical to SEQ ID NO: 36556
  CDS (1)..(2190)

SEQ ID NO: 50948 - protein, 729 aa, Rhodopirellula baltica SH 1; identical to SEQ ID NO: 36557

SEQ ID NO: 50949 - DNA, 1455 bp, Rhodopirellula baltica SH 1; identical to SEQ ID NO: 36558
  CDS (1)..(1455)

SEQ ID NO: 50950 - protein, 484 aa, Rhodopirellula baltica SH 1; identical to SEQ ID NO: 36559

SEQ ID NO: 50951 - DNA, 1338 bp, Bordetella parapertussis 12822; identical to SEQ ID NO: 36560
  CDS (1)..(1338)

SEQ ID NO: 50952 - protein, 445 aa, Bordetella parapertussis 12822; identical to SEQ ID NO: 36561

SEQ ID NO: 50953 - DNA, 1338 bp, Bordetella bronchiseptica RB50; identical to SEQ ID NO: 36562
  CDS (1)..(1338)

SEQ ID NO: 50954 - protein, 445 aa, Bordetella bronchiseptica RB50; identical to SEQ ID NO: 36563

SEQ ID NO: 50955 - DNA, 1398 bp, Chromobacterium violaceum ATCC 12472; identical to SEQ ID NO: 36564
  CDS (1)..(1398)

SEQ ID NO: 50956 - protein, 465 aa, Chromobacterium violaceum ATCC 12472; identical to SEQ ID NO: 36565

SEQ ID NO: 50957 - DNA, 1332 bp, Chromobacterium violaceum ATCC 12472; identical to SEQ ID NO: 36566
  CDS (1)..(1332)

SEQ ID NO: 50958 - protein, 443 aa, Chromobacterium violaceum ATCC 12472; identical to SEQ ID NO: 36567

SEQ ID NO: 50959 - DNA, 1851 bp, Oryza sativa (japonica cultivar-group); identical to SEQ ID NO: 36568
  CDS (1)..(1851)

SEQ ID NO: 50960 - protein, 616 aa, Oryza sativa (japonica cultivar-group); identical to SEQ ID NO: 36569

SEQ ID NO: 50961 - DNA, 1332 bp, Gloeobacter violaceus PCC 7421; identical to SEQ ID NO: 36570
  CDS (1)..(1332)

SEQ ID NO: 50962 - protein, 443 aa, Gloeobacter violaceus PCC 7421; identical to SEQ ID NO: 36571

SEQ ID NO: 50963 - DNA, 1416 bp, Gloeobacter violaceus PCC 7421; identical to SEQ ID NO: 36572
  CDS (1)..(1416)

SEQ ID NO: 50964 - protein, 471 aa, Gloeobacter violaceus PCC 7421; identical to SEQ ID NO: 36573

SEQ ID NO: 50965 - DNA, 1371 bp, Gloeobacter violaceus PCC 7421; identical to SEQ ID NO: 36574
  CDS (1)..(1371)

SEQ ID NO: 50966 - protein, 456 aa, Gloeobacter violaceus PCC 7421; identical to SEQ ID NO: 36575

SEQ ID NO: 50967 - DNA, 1602 bp, Photorhabdus luminescens subsp. laumondii TTO1; identical to SEQ ID NO: 36576
  CDS (1)..(1602)

SEQ ID NO: 50968 - protein, 533 aa, Photorhabdus luminescens subsp. laumondii TTO1; identical to SEQ ID NO: 36577

SEQ ID NO: 50969 - DNA, 1413 bp, Corynebacterium diphtheriae NCTC 13129; identical to SEQ ID NO: 9471
  CDS (1)..(1413)

SEQ ID NO: 50970 - protein, 470 aa, Corynebacterium diphtheriae NCTC 13129; identical to SEQ ID NO: 9472

SEQ ID NO: 50971 - DNA, 1482 bp, Rhodopseudomonas palustris CGA009; identical to SEQ ID NO: 36580
  CDS (1)..(1482)

SEQ ID NO: 50972 - protein, 493 aa, Rhodopseudomonas palustris CGA009; identical to SEQ ID NO: 36581

SEQ ID NO: 50973 - DNA, 1518 bp, Mycobacterium avium subsp. paratuberculosis str. k10; identical to SEQ ID NO: 36582
  CDS (1)..(1518)

SEQ ID NO: 50974 - protein, 505 aa, Mycobacterium avium subsp. paratuberculosis str. k10; identical to SEQ ID NO: 36583

SEQ ID NO: 50975 - DNA, 1353 bp, Lactobacillus johnsonii NCC 533; identical to SEQ ID NO: 36584
  CDS (1)..(1353)

SEQ ID NO: 50976 - protein, 450 aa, Lactobacillus johnsonii NCC 533; identical to SEQ ID NO: 36585

SEQ ID NO: 50977 - DNA, 1377 bp, Lactobacillus johnsonii NCC 533; identical to SEQ ID NO: 36586
  CDS (1)..(1377)

SEQ ID NO: 50978 - protein, 458 aa, Lactobacillus johnsonii NCC 533; identical to SEQ ID NO: 36587

SEQ ID NO: 50979 - DNA, 1311 bp, Lactobacillus johnsonii NCC 533; identical to SEQ ID NO: 36588
  CDS (1)..(1311)

SEQ ID NO: 50980 - protein, 436 aa, Lactobacillus johnsonii NCC 533; identical to SEQ ID NO: 36589

SEQ ID NO: 50981 - DNA, 1353 bp, Lactobacillus johnsonii NCC 533; identical to SEQ ID NO: 36590
  CDS (1)..(1353)

SEQ ID NO: 50982 - protein, 450 aa, Lactobacillus johnsonii NCC 533; identical to SEQ ID NO: 36591

SEQ ID NO: 50983 - DNA, 1389 bp, Lactobacillus johnsonii NCC 533; identical to SEQ ID NO: 36592
  CDS (1)..(1389)

SEQ ID NO: 50984 - protein, 462 aa, Lactobacillus johnsonii NCC 533; identical to SEQ ID NO: 36593

SEQ ID NO: 50985 - DNA, 1401 bp, Lactobacillus johnsonii NCC 533; identical to SEQ ID NO: 36594
  CDS (1)..(1401)

SEQ ID NO: 50986 - protein, 466 aa, Lactobacillus johnsonii NCC 533; identical to SEQ ID NO: 36595

SEQ ID NO: 50987 - DNA, 1398 bp, Lactobacillus johnsonii NCC 533; identical to SEQ ID NO: 36596
  CDS (1)..(1398)

SEQ ID NO: 50988 - protein, 465 aa, Lactobacillus johnsonii NCC 533; identical to SEQ ID NO: 36597

SEQ ID NO: 50989 - DNA, 1239 bp, Bdellovibrio bacteriovorus HD100; identical to SEQ ID NO: 36598
  CDS (1)..(1239)

SEQ ID NO: 50990 - protein, 412 aa, Bdellovibrio bacteriovorus HD100; identical to SEQ ID NO: 36599

SEQ ID NO: 50991 - DNA, 1281 bp, Treponema denticola ATCC 35405; identical to SEQ ID NO: 36600
  CDS (1)..(1281)

SEQ ID NO: 50992 - protein, 426 aa, Treponema denticola ATCC 35405; identical to SEQ ID NO: 36601

SEQ ID NO: 50993 - DNA, 1404 bp, Bacillus cereus ATCC 10987; identical to SEQ ID NO: 36602
  CDS (1)..(1404)

SEQ ID NO: 50994 - protein, 467 aa, Bacillus cereus ATCC 10987; identical to SEQ ID NO: 36603

SEQ ID NO: 50995 - DNA, 1416 bp, Bacillus cereus ATCC 10987; identical to SEQ ID NO: 36604
  CDS (1)..(1416)

SEQ ID NO: 50996 - protein, 471 aa, Bacillus cereus ATCC 10987; identical to SEQ ID NO: 36605

SEQ ID NO: 50997 - DNA, 1590 bp, Xenopus tropicalis; identical to SEQ ID NO: 36606
  CDS (1)..(1590)

SEQ ID NO: 50998 - protein, 529 aa, Xenopus tropicalis; identical to SEQ ID NO: 36607

SEQ ID NO: 50999 - DNA, 1527 bp, Xenopus tropicalis; identical to SEQ ID NO: 36608
  CDS (1)..(1527)

SEQ ID NO: 51000 - protein, 508 aa, Xenopus tropicalis; identical to SEQ ID NO: 36609

SEQ ID NO: 51001 - DNA, 1827 bp, Rattus norvegicus; identical to SEQ ID NO: 36610
  CDS (1)..(1827)

SEQ ID NO: 51002 - protein, 608 aa, Rattus norvegicus; identical to SEQ ID NO: 36611

SEQ ID NO: 51003 - DNA, 1908 bp, Rattus norvegicus; identical to SEQ ID NO: 36612
  CDS (1)..(1908)

SEQ ID NO: 51004 - protein, 635 aa, Rattus norvegicus; identical to SEQ ID NO: 36613

SEQ ID NO: 51005 - DNA, 1467 bp, Rattus norvegicus; identical to SEQ ID NO: 36614
  CDS (1)..(1467)

SEQ ID NO: 51006 - protein, 488 aa, Rattus norvegicus; identical to SEQ ID NO: 36615

SEQ ID NO: 51007 - DNA, 1575 bp, Anopheles gambiae str. PEST; identical to SEQ ID NO: 36616
  CDS (1)..(1575)

SEQ ID NO: 51008 - protein, 524 aa, Anopheles gambiae str. PEST; identical to SEQ ID NO: 36617

SEQ ID NO: 51009 - DNA, 1707 bp, Apis mellifera; identical to SEQ ID NO: 36618
  CDS (1)..(1707)

SEQ ID NO: 51010 - protein, 568 aa, Apis mellifera; identical to SEQ ID NO: 36619

SEQ ID NO: 51011 - DNA, 1656 bp, Apis mellifera; identical to SEQ ID NO: 36620
  CDS (1)..(1656)

SEQ ID NO: 51012 - protein, 551 aa, Apis mellifera; identical to SEQ ID NO: 36621

SEQ ID NO: 51013 - DNA, 2163 bp, Apis mellifera; identical to SEQ ID NO: 36622
  CDS (1)..(2163)

SEQ ID NO: 51014 - protein, 720 aa, Apis mellifera; identical to SEQ ID NO: 36623

SEQ ID NO: 51015 - DNA, 1446 bp, Apis mellifera; identical to SEQ ID NO: 36624
  CDS (1)..(1446)

SEQ ID NO: 51016 - protein, 481 aa, Apis mellifera; identical to SEQ ID NO: 36625

SEQ ID NO: 51017 - DNA, 2076 bp, Ustilago maydis 521; identical to SEQ ID NO: 36626
  CDS (1)..(2076)

SEQ ID NO: 51018 - protein, 691 aa, Ustilago maydis 521; identical to SEQ ID NO: 36627

SEQ ID NO: 51019 - DNA, 2328 bp, Gallus gallus; identical to SEQ ID NO: 36628
  CDS (1)..(2328)

SEQ ID NO: 51020 - protein, 775 aa, Gallus gallus; identical to SEQ ID NO: 36629

SEQ ID NO: 51021 - DNA, 1818 bp, Oryza sativa (japonica cultivar-group); identical to SEQ ID NO: 36630
  CDS (1)..(1818)

SEQ ID NO: 51022 - protein, 605 aa, Oryza sativa (japonica cultivar-group); identical to SEQ ID NO: 36631

SEQ ID NO: 51023 - DNA, 1920 bp, Oryza sativa (japonica cultivar-group); identical to SEQ ID NO: 36632
  CDS (1)..(1920)

SEQ ID NO: 51024 - protein, 639 aa, Oryza sativa (japonica cultivar-group); identical to SEQ ID NO: 36633

SEQ ID NO: 51025 - DNA, 1686 bp, Oryza sativa (japonica cultivar-group); identical to SEQ ID NO: 36634
  CDS (1)..(1686)

SEQ ID NO: 51026 - protein, 561 aa, Oryza sativa (japonica cultivar-group); identical to SEQ ID NO: 36635

SEQ ID NO: 51027 - DNA, 1599 bp, Yarrowia lipolytica CLIB99; identical to SEQ ID NO: 36636
  CDS (1)..(1599)

SEQ ID NO: 51028 - protein, 532 aa, Yarrowia lipolytica CLIB99; identical to SEQ ID NO: 36637

SEQ ID NO: 51029 - DNA, 1656 bp, Canis familiaris; identical to SEQ ID NO: 36638
  CDS (1)..(1656)

SEQ ID NO: 51030 - protein, 551 aa, Canis familiaris; identical to SEQ ID NO: 36639

SEQ ID NO: 51031 - DNA, 1599 bp, Canis familiaris; identical to SEQ ID NO: 36640
  CDS (1)..(1599)

SEQ ID NO: 51032 - protein, 532 aa, Canis familiaris; identical to SEQ ID NO: 36641

SEQ ID NO: 51033 - DNA, 1308 bp, Parachlamydia sp. UWE25; identical to SEQ ID NO: 36642
  CDS (1)..(1308)

SEQ ID NO: 51034 - protein, 435 aa, Parachlamydia sp. UWE25; identical to SEQ ID NO: 36643

SEQ ID NO: 51035 - DNA, 1332 bp, Picrophilus torridus DSM 9790; identical to SEQ ID NO: 36644
  CDS (1)..(1332)

SEQ ID NO: 51036 - protein, 443 aa, Picrophilus torridus DSM 9790; identical to SEQ ID NO: 36645

SEQ ID NO: 51037 - DNA, 1338 bp, Picrophilus torridus DSM 9790; identical to SEQ ID NO: 36646
  CDS (1)..(1338)

SEQ ID NO: 51038 - protein, 445 aa, Picrophilus torridus DSM 9790; identical to SEQ ID NO: 36647

SEQ ID NO: 51039 - DNA, 1404 bp, Bacillus thuringiensis serovar konkukian str. 97-27; identical to SEQ ID NO: 36648
  CDS (1)..(1404)

SEQ ID NO: 51040 - protein, 467 aa, Bacillus thuringiensis serovar konkukian str. 97-27; identical to SEQ ID NO: 36649

SEQ ID NO: 51041 - DNA, 1317 bp, Bacillus thuringiensis serovar konkukian str. 97-27; identical to SEQ ID NO: 36650
  CDS (1)..(1317)

SEQ ID NO: 51042 - protein, 438 aa, Bacillus thuringiensis serovar konkukian str. 97-27; identical to SEQ ID NO: 36651

SEQ ID NO: 51043 - DNA, 1485 bp, Acinetobacter sp. ADP1; identical to SEQ ID NO: 36652
  CDS (1)..(1485)

SEQ ID NO: 51044 - protein, 494 aa, Acinetobacter sp. ADP1; identical to SEQ ID NO: 36653

SEQ ID NO: 51045 - DNA, 1377 bp, Erwinia carotovora subsp. atroseptica SCRI1043; identical to SEQ ID NO: 36654
  CDS (1)..(1377)

SEQ ID NO: 51046 - protein, 458 aa, Erwinia carotovora subsp. atroseptica SCRI1043; identical to SEQ ID NO: 36655

SEQ ID NO: 51047 - DNA, 1449 bp, Propionibacterium acnes KPA171202; identical to SEQ ID NO: 36656
  CDS (1)..(1449)

SEQ ID NO: 51048 - protein, 482 aa, Propionibacterium acnes KPA171202; identical to SEQ ID NO: 36657

SEQ ID NO: 51049 - DNA, 1407 bp, Propionibacterium acnes KPA171202; identical to SEQ ID NO: 36658
  CDS (1)..(1407)

SEQ ID NO: 51050 - protein, 468 aa, Propionibacterium acnes KPA171202; identical to SEQ ID NO: 36659

SEQ ID NO: 51051 - DNA, 1461 bp, Streptococcus pyogenes MGAS10394; identical to SEQ ID NO: 36660
  CDS (1)..(1461)

SEQ ID NO: 51052 - protein, 486 aa, Streptococcus pyogenes MGAS10394; identical to SEQ ID NO: 36661

SEQ ID NO: 51053 - DNA, 1518 bp, Desulfotalea psychrophila LSv54; identical to SEQ ID NO: 36662
  CDS (1)..(1518)

SEQ ID NO: 51054 - protein, 505 aa, Desulfotalea psychrophila LSv54; identical to SEQ ID NO: 36663

SEQ ID NO: 51055 - DNA, 1407 bp, Rickettsia typhi str. Wilmington; identical to SEQ ID NO: 36664
  CDS (1)..(1407)

SEQ ID NO: 51056 - protein, 468 aa, Rickettsia typhi str. Wilmington; identical to SEQ ID NO: 36665

SEQ ID NO: 51057 - DNA, 1416 bp, Bacillus cereus ZK; identical to SEQ ID NO: 36666
  CDS (1)..(1416)

SEQ ID NO: 51058 - protein, 471 aa, Bacillus cereus ZK; identical to SEQ ID NO: 36667

SEQ ID NO: 51059 - DNA, 1404 bp, Bacillus cereus ZK; identical to SEQ ID NO: 36668
  CDS (1)..(1404)

SEQ ID NO: 51060 - protein, 467 aa, Bacillus cereus ZK; identical to SEQ ID NO: 36669

SEQ ID NO: 51061 - DNA, 1416 bp, Bacillus cereus ZK; identical to SEQ ID NO: 36670
  CDS (1)..(1416)

SEQ ID NO: 51062 - protein, 471 aa, Bacillus cereus ZK; identical to SEQ ID NO: 36671

SEQ ID NO: 51063 - DNA, 1287 bp, Bacillus cereus ZK; identical to SEQ ID NO: 36672
  CDS (1)..(1287)

SEQ ID NO: 51064 - protein, 428 aa, Bacillus cereus ZK; identical to SEQ ID NO: 36673

SEQ ID NO: 51065 - DNA, 1317 bp, Bacillus cereus ZK; identical to SEQ ID NO: 36674
  CDS (1)..(1317)

SEQ ID NO: 51066 - protein, 438 aa, Bacillus cereus ZK; identical to SEQ ID NO: 36675

SEQ ID NO: 51067 - DNA, 1329 bp, Bacillus licheniformis ATCC 14580; identical to SEQ ID NO: 36676
  CDS (1)..(1329)

SEQ ID NO: 51068 - protein, 442 aa, Bacillus licheniformis ATCC 14580; identical to SEQ ID NO: 36677

SEQ ID NO: 51069 - DNA, 1578 bp, Bacillus licheniformis ATCC 14580; identical to SEQ ID NO: 36678
  CDS (1)..(1578)

SEQ ID NO: 51070 - protein, 525 aa, Bacillus licheniformis ATCC 14580; identical to SEQ ID NO: 36679

SEQ ID NO: 51071 - DNA, 1668 bp, Bacteroides fragilis YCH46; identical to SEQ ID NO: 36680
  CDS (1)..(1668)

SEQ ID NO: 51072 - protein, 555 aa, Bacteroides fragilis YCH46; identical to SEQ ID NO: 36681

SEQ ID NO: 51073 - DNA, 1404 bp, Burkholderia mallei ATCC 23344; identical to SEQ ID NO: 36682
  CDS (1)..(1404)

SEQ ID NO: 51074 - protein, 467 aa, Burkholderia mallei ATCC 23344; identical to SEQ ID NO: 36683

SEQ ID NO: 51075 - DNA, 1404 bp, Burkholderia pseudomallei K96243; identical to SEQ ID NO: 36684
  CDS (1)..(1404)

SEQ ID NO: 51076 - protein, 467 aa, Burkholderia pseudomallei K96243; identical to SEQ ID NO: 36685

SEQ ID NO: 51077 - DNA, 1296 bp, Burkholderia pseudomallei K96243; identical to SEQ ID NO: 36686
  CDS (1)..(1296)

SEQ ID NO: 51078 - protein, 431 aa, Burkholderia pseudomallei K96243; identical to SEQ ID NO: 36687

SEQ ID NO: 51079 - DNA, 1398 bp, Methylococcus capsulatus str. Bath; identical to SEQ ID NO: 36688
  CDS (1)..(1398)

SEQ ID NO: 51080 - protein, 465 aa, Methylococcus capsulatus str. Bath; identical to SEQ ID NO: 36689

SEQ ID NO: 51081 - DNA, 1422 bp, Methylococcus capsulatus str. Bath; identical to SEQ ID NO: 36690
  CDS (1)..(1422)

SEQ ID NO: 51082 - protein, 473 aa, Methylococcus capsulatus str. Bath; identical to SEQ ID NO: 36691

SEQ ID NO: 51083 - DNA, 1293 bp, Methylococcus capsulatus str. Bath; identical to SEQ ID NO: 36692
  CDS (1)..(1293)

SEQ ID NO: 51084 - protein, 430 aa, Methylococcus capsulatus str. Bath; identical to SEQ ID NO: 36693

SEQ ID NO: 51085 - DNA, 1338 bp, Nocardia farcinica IFM 10152; identical to SEQ ID NO: 36694
  CDS (1)..(1338)

SEQ ID NO: 51086 - protein, 445 aa, Nocardia farcinica IFM 10152; identical to SEQ ID NO: 36695

SEQ ID NO: 51087 - DNA, 1488 bp, Nocardia farcinica IFM 10152; identical to SEQ ID NO: 36696
  CDS (1)..(1488)

SEQ ID NO: 51088 - protein, 495 aa, Nocardia farcinica IFM 10152; identical to SEQ ID NO: 36697

SEQ ID NO: 51089 - DNA, 1296 bp, Legionella pneumophila str. Paris; identical to SEQ ID NO: 36698
  CDS (1)..(1296)

SEQ ID NO: 51090 - protein, 431 aa, Legionella pneumophila str. Paris; identical to SEQ ID NO: 36699

SEQ ID NO: 51091 - DNA, 1185 bp, Legionella pneumophila str. Paris; identical to SEQ ID NO: 36700
  CDS (1)..(1185)

SEQ ID NO: 51092 - protein, 394 aa, Legionella pneumophila str. Paris; identical to SEQ ID NO: 36701

SEQ ID NO: 51093 - DNA, 1185 bp, Legionella pneumophila str. Lens; identical to SEQ ID NO: 36702
  CDS (1)..(1185)

SEQ ID NO: 51094 - protein, 394 aa, Legionella pneumophila str. Lens; identical to SEQ ID NO: 36703

SEQ ID NO: 51095 - DNA, 1455 bp, Haloarcula marismortui ATCC 43049; identical to SEQ ID NO: 36704
  CDS (1)..(1455)

SEQ ID NO: 51096 - protein, 484 aa, Haloarcula marismortui ATCC 43049; identical to SEQ ID NO: 36705

SEQ ID NO: 51097 - DNA, 2265 bp, Haloarcula marismortui ATCC 43049; identical to SEQ ID NO: 36706
  CDS (1)..(2265)

SEQ ID NO: 51098 - protein, 754 aa, Haloarcula marismortui ATCC 43049; identical to SEQ ID NO: 36707

SEQ ID NO: 51099 - DNA, 2205 bp, Haloarcula marismortui ATCC 43049; identical to SEQ ID NO: 36708
  CDS (1)..(2205)

SEQ ID NO: 51100 - protein, 734 aa, Haloarcula marismortui ATCC 43049; identical to SEQ ID NO: 36709

SEQ ID NO: 51101 - DNA, 1386 bp, Streptococcus thermophilus LMG 18311; identical to SEQ ID NO: 36710
  CDS (1)..(1386)

SEQ ID NO: 51102 - protein, 461 aa, Streptococcus thermophilus LMG 18311; identical to SEQ ID NO: 36711

SEQ ID NO: 51103 - DNA, 1386 bp, Streptococcus thermophilus CNRZ1066; identical to SEQ ID NO: 36712
  CDS (1)..(1386)

SEQ ID NO: 51104 - protein, 461 aa, Streptococcus thermophilus CNRZ1066; identical to SEQ ID NO: 36713

SEQ ID NO: 51105 - DNA, 1416 bp, Geobacillus kaustophilus HTA426; identical to SEQ ID NO: 36714
  CDS (1)..(1416)

SEQ ID NO: 51106 - protein, 471 aa, Geobacillus kaustophilus HTA426; identical to SEQ ID NO: 36715

SEQ ID NO: 51107 - DNA, 1365 bp, Geobacillus kaustophilus HTA426; identical to SEQ ID NO: 36716
  CDS (1)..(1365)

SEQ ID NO: 51108 - protein, 454 aa, Geobacillus kaustophilus HTA426; identical to SEQ ID NO: 36717

SEQ ID NO: 51109 - DNA, 1407 bp, Salmonella enterica subsp. enterica serovar Paratypi A str. ATCC; identical to SEQ ID NO: 36718
  CDS (1)..(1407)

SEQ ID NO: 51110 - protein, 468 aa, Salmonella enterica subsp. enterica serovar Paratypi A str. ATCC; identical to SEQ ID NO: 36719

SEQ ID NO: 51111 - DNA, 1371 bp, Salmonella enterica subsp. enterica serovar Paratypi A str. ATCC; identical to SEQ ID NO: 36720
  CDS (1)..(1371)

SEQ ID NO: 51112 - protein, 456 aa, Salmonella enterica subsp. enterica serovar Paratypi A str. ATCC; identical to SEQ ID NO: 36721

SEQ ID NO: 51113 - DNA, 1311 bp, Idiomarina loihiensis L2TR; identical to SEQ ID NO: 36722
  CDS (1)..(1311)

SEQ ID NO: 51114 - protein, 436 aa, Idiomarina loihiensis L2TR; identical to SEQ ID NO: 36723

SEQ ID NO: 51115 - DNA, 1221 bp, Idiomarina loihiensis L2TR; identical to SEQ ID NO: 36724
  CDS (1)..(1221)

SEQ ID NO: 51116 - protein, 406 aa, Idiomarina loihiensis L2TR; identical to SEQ ID NO: 36725

SEQ ID NO: 51117 - DNA, 1497 bp, Zymomonas mobilis subsp. mobilis ZM4; identical to SEQ ID NO: 36726
  CDS (1)..(1497)

SEQ ID NO: 51118 - protein, 498 aa, Zymomonas mobilis subsp. mobilis ZM4; identical to SEQ ID NO: 36727

SEQ ID NO: 51119 - DNA, 1434 bp, Zymomonas mobilis subsp. mobilis ZM4; identical to SEQ ID NO: 36728
  CDS (1)..(1434)

SEQ ID NO: 51120 - protein, 477 aa, Zymomonas mobilis subsp. mobilis ZM4; identical to SEQ ID NO: 36729

SEQ ID NO: 51121 - DNA, 1347 bp, Silicibacter pomeroyi DSS-3; identical to SEQ ID NO: 36730
  CDS (1)..(1347)

SEQ ID NO: 51122 - protein, 448 aa, Silicibacter pomeroyi DSS-3; identical to SEQ ID NO: 36731

SEQ ID NO: 51123 - DNA, 1209 bp, Silicibacter pomeroyi DSS-3; identical to SEQ ID NO: 36732
  CDS (1)..(1209)

SEQ ID NO: 51124 - protein, 402 aa, Silicibacter pomeroyi DSS-3; identical to SEQ ID NO: 36733

SEQ ID NO: 51125 - DNA, 1443 bp, Xylella fastidiosa Dixon; identical to SEQ ID NO: 36734
  CDS (1)..(1443)

SEQ ID NO: 51126 - protein, 480 aa, Xylella fastidiosa Dixon; identical to SEQ ID NO: 36735

SEQ ID NO: 51127 - DNA, 1443 bp, Xylella fastidiosa Ann-1; identical to SEQ ID NO: 36736
  CDS (1)..(1443)

SEQ ID NO: 51128 - protein, 480 aa, Xylella fastidiosa Ann-1; identical to SEQ ID NO: 36737

SEQ ID NO: 51129 - DNA, 1437 bp, Xylella fastidiosa Ann-1; identical to SEQ ID NO: 36738
  CDS (1)..(1437)

SEQ ID NO: 51130 - protein, 478 aa, Xylella fastidiosa Ann-1; identical to SEQ ID NO: 36739

SEQ ID NO: 51131 - DNA, 1491 bp, Xylella fastidiosa Ann-1; identical to SEQ ID NO: 36740
  CDS (1)..(1491)

SEQ ID NO: 51132 - protein, 496 aa, Xylella fastidiosa Ann-1; identical to SEQ ID NO: 36741

SEQ ID NO: 51133 - DNA, 1329 bp, Lactobacillus gasseri; identical to SEQ ID NO: 36742
  CDS (1)..(1329)

SEQ ID NO: 51134 - protein, 442 aa, Lactobacillus gasseri; identical to SEQ ID NO: 36743

SEQ ID NO: 51135 - DNA, 1401 bp, Lactobacillus gasseri; identical to SEQ ID NO: 36744
  CDS (1)..(1401)

SEQ ID NO: 51136 - protein, 466 aa, Lactobacillus gasseri; identical to SEQ ID NO: 36745

SEQ ID NO: 51137 - DNA, 1332 bp, Leuconostoc mesenteroides subsp. mesenteroides ATCC 8293; identical to SEQ ID NO: 36746
  CDS (1)..(1332)

SEQ ID NO: 51138 - protein, 443 aa, Leuconostoc mesenteroides subsp. mesenteroides ATCC 8293; identical to SEQ ID NO: 36747

SEQ ID NO: 51139 - DNA, 1401 bp, Leuconostoc mesenteroides subsp. mesenteroides ATCC 8293; identical to SEQ ID NO: 36748
  CDS (1)..(1401)

SEQ ID NO: 51140 - protein, 466 aa, Leuconostoc mesenteroides subsp. mesenteroides ATCC 8293; identical to SEQ ID NO: 36749

SEQ ID NO: 51141 - DNA, 1332 bp, Leuconostoc mesenteroides subsp. mesenteroides ATCC 8293; identical to SEQ ID NO: 36750
  CDS (1)..(1332)

SEQ ID NO: 51142 - protein, 443 aa, Leuconostoc mesenteroides subsp. mesenteroides ATCC 8293; identical to SEQ ID NO: 36751

SEQ ID NO: 51143 - DNA, 1314 bp, Pseudomonas syringae pv. syringae B728a; identical to SEQ ID NO: 36752
  CDS (1)..(1314)

SEQ ID NO: 51144 - protein, 437 aa, Pseudomonas syringae pv. syringae B728a; identical to SEQ ID NO: 36753

SEQ ID NO: 51145 - DNA, 1284 bp, Rickettsia sibirica 246; identical to SEQ ID NO: 36754
  CDS (1)..(1284)

SEQ ID NO: 51146 - protein, 427 aa, Rickettsia sibirica 246; identical to SEQ ID NO: 36755

SEQ ID NO: 51147 - DNA, 1443 bp, Psychrobacter sp. 273-4; identical to SEQ ID NO: 36756
  CDS (1)..(1443)

SEQ ID NO: 51148 - protein, 480 aa, Psychrobacter sp. 273-4; identical to SEQ ID NO: 36757

SEQ ID NO: 51149 - DNA, 1446 bp, Rickettsia rickettsii; identical to SEQ ID NO: 36758
  CDS (1)..(1446)

SEQ ID NO: 51150 - protein, 481 aa, Rickettsia rickettsii; identical to SEQ ID NO: 36759

SEQ ID NO: 51151 - DNA, 1284 bp, Rickettsia rickettsii; identical to SEQ ID NO: 36760
  CDS (1)..(1284)

SEQ ID NO: 51152 - protein, 427 aa, Rickettsia rickettsii; identical to SEQ ID NO: 36761

SEQ ID NO: 51153 - DNA, 1359 bp, Anabaena variabilis ATCC 29413; identical to SEQ ID NO: 36762
  CDS (1)..(1359)

SEQ ID NO: 51154 - protein, 452 aa, Anabaena variabilis ATCC 29413; identical to SEQ ID NO: 36763

SEQ ID NO: 51155 - DNA, 1365 bp, Ralstonia eutropha JMP134; identical to SEQ ID NO: 36764
  CDS (1)..(1365)

SEQ ID NO: 51156 - protein, 454 aa, Ralstonia eutropha JMP134; identical to SEQ ID NO: 36765

SEQ ID NO: 51157 - DNA, 1383 bp, Ralstonia eutropha JMP134; identical to SEQ ID NO: 36766
  CDS (1)..(1383)

SEQ ID NO: 51158 - protein, 460 aa, Ralstonia eutropha JMP134; identical to SEQ ID NO: 36767

SEQ ID NO: 51159 - DNA, 1398 bp, Ralstonia eutropha JMP134; identical to SEQ ID NO: 36768
  CDS (1)..(1398)

SEQ ID NO: 51160 - protein, 465 aa, Ralstonia eutropha JMP134; identical to SEQ ID NO: 36769

SEQ ID NO: 51161 - DNA, 1407 bp, Methylobacillus flagellatus KT; identical to SEQ ID NO: 36770
  CDS (1)..(1407)

SEQ ID NO: 51162 - protein, 468 aa, Methylobacillus flagellatus KT; identical to SEQ ID NO: 36771

SEQ ID NO: 51163 - DNA, 1389 bp, Exiguobacterium sp. 255-15; identical to SEQ ID NO: 36772
  CDS (1)..(1389)

SEQ ID NO: 51164 - protein, 462 aa, Exiguobacterium sp. 255-15; identical to SEQ ID NO: 36773

SEQ ID NO: 51165 - DNA, 1401 bp, Exiguobacterium sp. 255-15; identical to SEQ ID NO: 36774
  CDS (1)..(1401)

SEQ ID NO: 51166 - protein, 466 aa, Exiguobacterium sp. 255-15; identical to SEQ ID NO: 36775

SEQ ID NO: 51167 - DNA, 1506 bp, Rubrobacter xylanophilus DSM 9941; identical to SEQ ID NO: 36776
  CDS (1)..(1506)

SEQ ID NO: 51168 - protein, 501 aa, Rubrobacter xylanophilus DSM 9941; identical to SEQ ID NO: 36777

SEQ ID NO: 51169 - DNA, 1341 bp, Rubrobacter xylanophilus DSM 9941; identical to SEQ ID NO: 36778
  CDS (1)..(1341)

SEQ ID NO: 51170 - protein, 446 aa, Rubrobacter xylanophilus DSM 9941; identical to SEQ ID NO: 36779

SEQ ID NO: 51171 - DNA, 1422 bp, Rubrobacter xylanophilus DSM 9941; identical to SEQ ID NO: 36780
  CDS (1)..(1422)

SEQ ID NO: 51172 - protein, 473 aa, Rubrobacter xylanophilus DSM 9941; identical to SEQ ID NO: 36781

SEQ ID NO: 51173 - DNA, 1302 bp, Methanococcoides burtonii DSM 6242; identical to SEQ ID NO: 36782
  CDS (1)..(1302)

SEQ ID NO: 51174 - protein, 433 aa, Methanococcoides burtonii DSM 6242; identical to SEQ ID NO: 36783

SEQ ID NO: 51175 - DNA, 1374 bp, Burkholderia cepacia R18194; identical to SEQ ID NO: 36784
  CDS (1)..(1374)

SEQ ID NO: 51176 - protein, 457 aa, Burkholderia cepacia R18194; identical to SEQ ID NO: 36785

SEQ ID NO: 51177 - DNA, 1275 bp, Burkholderia cepacia R18194; identical to SEQ ID NO: 36786
  CDS (1)..(1275)

SEQ ID NO: 51178 - protein, 424 aa, Burkholderia cepacia R18194; identical to SEQ ID NO: 36787

SEQ ID NO: 51179 - DNA, 1359 bp, Burkholderia cepacia R18194; identical to SEQ ID NO: 36788
  CDS (1)..(1359)

SEQ ID NO: 51180 - protein, 452 aa, Burkholderia cepacia R18194; identical to SEQ ID NO: 36789

SEQ ID NO: 51181 - DNA, 1407 bp, Burkholderia cepacia R1808; identical to SEQ ID NO: 36790
  CDS (1)..(1407)

SEQ ID NO: 51182 - protein, 468 aa, Burkholderia cepacia R1808; identical to SEQ ID NO: 36791

SEQ ID NO: 51183 - DNA, 1392 bp, Listeria monocytogenes str. 1/2a F6854; identical to SEQ ID NO: 36792
  CDS (1)..(1392)

SEQ ID NO: 51184 - protein, 463 aa, Listeria monocytogenes str. 1/2a F6854; identical to SEQ ID NO: 36793

SEQ ID NO: 51185 - DNA, 1461 bp, Bacillus cereus G9241; identical to SEQ ID NO: 36794
  CDS (1)..(1461)

SEQ ID NO: 51186 - protein, 486 aa, Bacillus cereus G9241; identical to SEQ ID NO: 36795

SEQ ID NO: 51187 - DNA, 1317 bp, Bacillus cereus G9241; identical to SEQ ID NO: 36796
  CDS (1)..(1317)

SEQ ID NO: 51188 - protein, 438 aa, Bacillus cereus G9241; identical to SEQ ID NO: 36797

SEQ ID NO: 51189 - DNA, 1320 bp, Bacillus cereus G9241; identical to SEQ ID NO: 36798
  CDS (1)..(1320)

SEQ ID NO: 51190 - protein, 439 aa, Bacillus cereus G9241; identical to SEQ ID NO: 36799

SEQ ID NO: 51191 - DNA, 1416 bp, Bacillus cereus G9241; identical to SEQ ID NO: 36800
  CDS (1)..(1416)

SEQ ID NO: 51192 - protein, 471 aa, Bacillus cereus G9241; identical to SEQ ID NO: 36801

SEQ ID NO: 51193 - DNA, 1377 bp, Bacillus cereus G9241; identical to SEQ ID NO: 36802
  CDS (1)..(1377)

SEQ ID NO: 51194 - protein, 458 aa, Bacillus cereus G9241; identical to SEQ ID NO: 36803

SEQ ID NO: 51195 - DNA, 1410 bp, Ralstonia metallidurans CH34; identical to SEQ ID NO: 36804
  CDS (1)..(1410)

SEQ ID NO: 51196 - protein, 469 aa, Ralstonia metallidurans CH34; identical to SEQ ID NO: 36805

SEQ ID NO: 51197 - DNA, 1392 bp, Burkholderia fungorum LB400; identical to SEQ ID NO: 36806
  CDS (1)..(1392)

SEQ ID NO: 51198 - protein, 463 aa, Burkholderia fungorum LB400; identical to SEQ ID NO: 36807

SEQ ID NO: 51199 - DNA, 1350 bp, Enterococcus faecium; identical to SEQ ID NO: 36808
  CDS (1)..(1350)

SEQ ID NO: 51200 - protein, 449 aa, Enterococcus faecium; identical to SEQ ID NO: 36809

SEQ ID NO: 51201 - DNA, 1356 bp, Enterococcus faecium; identical to SEQ ID NO: 36810
  CDS (1)..(1356)

SEQ ID NO: 51202 - protein, 451 aa, Enterococcus faecium; identical to SEQ ID NO: 36811

SEQ ID NO: 51203 - DNA, 1377 bp, Enterococcus faecium; identical to SEQ ID NO: 36812
  CDS (1)..(1377)

SEQ ID NO: 51204 - protein, 458 aa, Enterococcus faecium; identical to SEQ ID NO: 36813

SEQ ID NO: 51205 - DNA, 1503 bp, Thermobifida fusca; identical to SEQ ID NO: 36814
  CDS (1)..(1503)

SEQ ID NO: 51206 - protein, 500 aa, Thermobifida fusca; identical to SEQ ID NO: 36815

SEQ ID NO: 51207 - DNA, 1269 bp, Methanosarcina barkeri str. fusaro; identical to SEQ ID NO: 36816
  CDS (1)..(1269)

SEQ ID NO: 51208 - protein, 422 aa, Methanosarcina barkeri str. fusaro; identical to SEQ ID NO: 36817

SEQ ID NO: 51209 - DNA, 1578 bp, Novosphingobium aromaticivorans DSM 12444; identical to SEQ ID NO: 36818
  CDS (1)..(1578)

SEQ ID NO: 51210 - protein, 525 aa, Novosphingobium aromaticivorans DSM 12444; identical to SEQ ID NO: 36819

SEQ ID NO: 51211 - DNA, 1317 bp, Novosphingobium aromaticivorans DSM 12444; identical to SEQ ID NO: 36820
  CDS (1)..(1317)

SEQ ID NO: 51212 - protein, 438 aa, Novosphingobium aromaticivorans DSM 12444; identical to SEQ ID NO: 36821

SEQ ID NO: 51213 - DNA, 1596 bp, Ferroplasma acidarmanus; identical to SEQ ID NO: 36822
  CDS (1)..(1596)

SEQ ID NO: 51214 - protein, 531 aa, Ferroplasma acidarmanus; identical to SEQ ID NO: 36823

SEQ ID NO: 51215 - DNA, 1323 bp, Ferroplasma acidarmanus; identical to SEQ ID NO: 36824
  CDS (1)..(1323)

SEQ ID NO: 51216 - protein, 440 aa, Ferroplasma acidarmanus; identical to SEQ ID NO: 36825

SEQ ID NO: 51217 - DNA, 1365 bp, Ferroplasma acidarmanus; identical to SEQ ID NO: 36826
  CDS (1)..(1365)

SEQ ID NO: 51218 - protein, 454 aa, Ferroplasma acidarmanus; identical to SEQ ID NO: 36827

SEQ ID NO: 51219 - DNA, 1560 bp, Ferroplasma acidarmanus; identical to SEQ ID NO: 36828
  CDS (1)..(1560)

SEQ ID NO: 51220 - protein, 519 aa, Ferroplasma acidarmanus; identical to SEQ ID NO: 36829

SEQ ID NO: 51221 - DNA, 1443 bp, Cytophaga hutchinsonii; identical to SEQ ID NO: 36830
  CDS (1)..(1443)

SEQ ID NO: 51222 - protein, 480 aa, Cytophaga hutchinsonii; identical to SEQ ID NO: 36831

SEQ ID NO: 51223 - DNA, 1314 bp, Microbulbifer degradans 2-40; identical to SEQ ID NO: 36832
  CDS (1)..(1314)

SEQ ID NO: 51224 - protein, 437 aa, Microbulbifer degradans 2-40; identical to SEQ ID NO: 36833

SEQ ID NO: 51225 - DNA, 1359 bp, Oenococcus oeni PSU-1; identical to SEQ ID NO: 36834
  CDS (1)..(1359)

SEQ ID NO: 51226 - protein, 452 aa, Oenococcus oeni PSU-1; identical to SEQ ID NO: 36835

SEQ ID NO: 51227 - DNA, 1437 bp, Oenococcus oeni PSU-1; identical to SEQ ID NO: 36836
  CDS (1)..(1437)

SEQ ID NO: 51228 - protein, 478 aa, Oenococcus oeni PSU-1; identical to SEQ ID NO: 36837

SEQ ID NO: 51229 - DNA, 1422 bp, Pediococcus pentosaceus ATCC 25745; identical to SEQ ID NO: 36838
  CDS (1)..(1422)

SEQ ID NO: 51230 - protein, 473 aa, Pediococcus pentosaceus ATCC 25745; identical to SEQ ID NO: 36839

SEQ ID NO: 51231 - DNA, 1302 bp, Trichodesmium erythraeum IMS101; identical to SEQ ID NO: 36840
  CDS (1)..(1302)

SEQ ID NO: 51232 - protein, 433 aa, Trichodesmium erythraeum IMS101; identical to SEQ ID NO: 36841

SEQ ID NO: 51233 - DNA, 1566 bp, Moorella thermoacetica ATCC 39073; identical to SEQ ID NO: 36842
  CDS (1)..(1566)

SEQ ID NO: 51234 - protein, 521 aa, Moorella thermoacetica ATCC 39073; identical to SEQ ID NO: 36843

SEQ ID NO: 51235 - DNA, 1521 bp, Moorella thermoacetica ATCC 39073; identical to SEQ ID NO: 36844
  CDS (1)..(1521)

SEQ ID NO: 51236 - protein, 506 aa, Moorella thermoacetica ATCC 39073; identical to SEQ ID NO: 36845

SEQ ID NO: 51237 - DNA, 1401 bp, Moorella thermoacetica ATCC 39073; identical to SEQ ID NO: 36846
  CDS (1)..(1401)

SEQ ID NO: 51238 - protein, 466 aa, Moorella thermoacetica ATCC 39073; identical to SEQ ID NO: 36847

SEQ ID NO: 51239 - DNA, 1392 bp, Rickettsia akari str. Hartford; identical to SEQ ID NO: 36848
  CDS (1)..(1392)

SEQ ID NO: 51240 - protein, 463 aa, Rickettsia akari str. Hartford; identical to SEQ ID NO: 36849

SEQ ID NO: 51241 - DNA, 1290 bp, Rickettsia akari str. Hartford; identical to SEQ ID NO: 36850
  CDS (1)..(1290)

SEQ ID NO: 51242 - protein, 429 aa, Rickettsia akari str. Hartford; identical to SEQ ID NO: 36851

SEQ ID NO: 51243 - DNA, 1356 bp, Pseudomonas aeruginosa UCBPP-PA14; identical to SEQ ID NO: 36852
  CDS (1)..(1356)

SEQ ID NO: 51244 - protein, 451 aa, Pseudomonas aeruginosa UCBPP-PA14; identical to SEQ ID NO: 36853

SEQ ID NO: 51245 - DNA, 1389 bp, Bacillus subtilis; identical to SEQ ID NO: 36854
  CDS (1)..(1389)

SEQ ID NO: 51246 - protein, 462 aa, Bacillus subtilis; identical to SEQ ID NO: 36855

SEQ ID NO: 51247 - DNA, 1512 bp, Schistosoma mansoni; identical to SEQ ID NO: 36856
  CDS (1)..(1512)

SEQ ID NO: 51248 - protein, 503 aa, Schistosoma mansoni; identical to SEQ ID NO: 36857

SEQ ID NO: 51249 - DNA, 1281 bp, Aeromonas salmonicida; identical to SEQ ID NO: 36858
  CDS (1)..(1281)

SEQ ID NO: 51250 - protein, 426 aa, Aeromonas salmonicida; identical to SEQ ID NO: 36859

SEQ ID NO: 51251 - DNA, 1608 bp, Pongo pygmaeus; identical to SEQ ID NO: 36860
  CDS (1)..(1608)

SEQ ID NO: 51252 - protein, 535 aa, Pongo pygmaeus; identical to SEQ ID NO: 36861

SEQ ID NO: 51253 - DNA, 1608 bp, Pongo pygmaeus; identical to SEQ ID NO: 36862
  CDS (1)..(1608)

SEQ ID NO: 51254 - protein, 535 aa, Pongo pygmaeus; identical to SEQ ID NO: 36863

SEQ ID NO: 51255 - DNA, 1455 bp, Xenopus tropicalis; identical to SEQ ID NO: 36864
  CDS (1)..(1455)

SEQ ID NO: 51256 - protein, 484 aa, Xenopus tropicalis; identical to SEQ ID NO: 36865

SEQ ID NO: 51257 - DNA, 1791 bp, Oryza sativa; identical to SEQ ID NO: 36866
  CDS (1)..(1791)

SEQ ID NO: 51258 - protein, 596 aa, Oryza sativa; identical to SEQ ID NO: 36867

SEQ ID NO: 51259 - DNA, 1581 bp, Gallus gallus; identical to SEQ ID NO: 36868
  CDS (1)..(1581)

SEQ ID NO: 51260 - protein, 526 aa, Gallus gallus; identical to SEQ ID NO: 36869

SEQ ID NO: 51261 - DNA, 1869 bp, Xenopus laevis; identical to SEQ ID NO: 36870
  CDS (1)..(1869)

SEQ ID NO: 51262 - protein, 622 aa, Xenopus laevis [sequence omitted]

SEQ ID NO: 51263 - DNA, 1908 bp, Homo sapiens; identical to SEQ ID NO: 36872
  CDS (1)..(1908)

SEQ ID NO: 51264 - protein, 635 aa, Homo sapiens [sequence omitted]

SEQ ID NO: 51265 - DNA, 1986 bp, Xenopus laevis; identical to SEQ ID NO: 36874
  CDS (1)..(1986)

SEQ ID NO: 51266 - protein, 661 aa, Xenopus laevis; identical to SEQ ID NO: 36875

SEQ ID NO: 51267 - DNA, 1245 bp, Xenopus laevis; identical to SEQ ID NO: 36876
  CDS (1)..(1245)

SEQ ID NO: 51268 - protein, 414 aa, Xenopus laevis; identical to SEQ ID NO: 36877

SEQ ID NO: 51269 - DNA, 1713 bp, Rhodococcus erythropolis; identical to SEQ ID NO: 36878
  CDS (1)..(1713)

SEQ ID NO: 51270 - protein, 570 aa, Rhodococcus erythropolis; identical to SEQ ID NO: 36879

SEQ ID NO: 51271 - DNA, 1611 bp, Didelphis marsupialis virginiana; identical to SEQ ID NO: 36880
  CDS (1)..(1611)

SEQ ID NO: 51272 - protein, 536 aa, Didelphis marsupialis virginiana; identical to SEQ ID NO: 36881

SEQ ID NO: 51273 - DNA, 1584 bp, Xenopus laevis; identical to SEQ ID NO: 36882
  CDS (1)..(1584)

SEQ ID NO: 51274 - protein, 527 aa, Xenopus laevis; identical to SEQ ID NO: 36883

SEQ ID NO: 51275 - DNA, 1590 bp, Xenopus laevis; identical to SEQ ID NO: 36884
  CDS (1)..(1590)

SEQ ID NO: 51276 - protein, 529 aa, Xenopus laevis; identical to SEQ ID NO: 36885

SEQ ID NO: 51277 - DNA, 1317 bp, Shigella flexneri; identical to SEQ ID NO: 36886
  CDS (1)..(1317)

SEQ ID NO: 51278 - protein, 438 aa, Shigella flexneri; identical to SEQ ID NO: 36887

SEQ ID NO: 51279 - DNA, 1377 bp, Shigella flexneri; identical to SEQ ID NO: 36888
  CDS (1)..(1377)

SEQ ID NO: 51280 - protein, 458 aa, Shigella flexneri; identical to SEQ ID NO: 36889

SEQ ID NO: 51281 - DNA, 1908 bp, Arabidopsis thaliana; identical to SEQ ID NO: 36890
  CDS (1)..(1908)

SEQ ID NO: 51282 - protein, 635 aa, Arabidopsis thaliana; identical to SEQ ID NO: 36891

SEQ ID NO: 51283 - DNA, 1497 bp, Rhodococcus sp; identical to SEQ ID NO: 36892
  CDS (1)..(1497)

SEQ ID NO: 51284 - protein, 498 aa, Rhodococcus sp; identical to SEQ ID NO: 36893

SEQ ID NO: 51285 - DNA, 1857 bp, Oryza sativa; identical to SEQ ID NO: 36894
  CDS (1)..(1857)

SEQ ID NO: 51286 - protein, 618 aa, Oryza sativa; identical to SEQ ID NO: 36895

SEQ ID NO: 51287 - DNA, 1602 bp, Arabidopsis thaliana; identical to SEQ ID NO: 36896
  CDS (1)..(1602)

SEQ ID NO: 51288 - protein, 533 aa, Arabidopsis thaliana; identical to SEQ ID NO: 36897

SEQ ID NO: 51289 - DNA, 1524 bp, Homo sapiens; identical to SEQ ID NO: 36898
  CDS (1)..(1524)

SEQ ID NO: 51290 - protein, 507 aa, Homo sapiens; identical to SEQ ID NO: 36899

SEQ ID NO: 51291 - DNA, 1485 bp, Homo sapiens; identical to SEQ ID NO: 36900
  CDS (1)..(1485)

SEQ ID NO: 51292 - protein, 494 aa, Homo sapiens; identical to SEQ ID NO: 36901

SEQ ID NO: 51293 - DNA, 1851 bp, Arabidopsis thaliana; identical to SEQ ID NO: 36902
  CDS (1)..(1851)

SEQ ID NO: 51294 - protein, 616 aa, Arabidopsis thaliana; identical to SEQ ID NO: 36903

SEQ ID NO: 51295 - DNA, 1845 bp, Arabidopsis thaliana; identical to SEQ ID NO: 36904
  CDS (1)..(1845)

SEQ ID NO: 51296 - protein, 614 aa, Arabidopsis thaliana; identical to SEQ ID NO: 36905

SEQ ID NO: 51297 - DNA, 1608 bp, Oryctolagus cuniculus; identical to SEQ ID NO: 36906
  CDS (1)..(1608)

SEQ ID NO: 51298 - protein, 535 aa, Oryctolagus cuniculus; identical to SEQ ID NO: 36907

SEQ ID NO: 51299 - DNA, 1845 bp, Arabidopsis thaliana; identical to SEQ ID NO: 36908
  CDS (1)..(1845)

SEQ ID NO: 51300 - protein, 614 aa, Arabidopsis thaliana; identical to SEQ ID NO: 36909

SEQ ID NO: 51301 - DNA, 1593 bp, Mus musculus; identical to SEQ ID NO: 36910
  CDS (1)..(1593)

SEQ ID NO: 51302 - protein, 530 aa, Mus musculus; identical to SEQ ID NO: 36911

SEQ ID NO: 51303 - DNA, 1500 bp, Escherichia coli; identical to SEQ ID NO: 36912
  CDS (1)..(1500)

SEQ ID NO: 51304 - protein, 499 aa, Escherichia coli; identical to SEQ ID NO: 9412

SEQ ID NO: 51305 - DNA, 1494 bp, Salmonella typhimurium; identical to SEQ ID NO: 36914
  CDS (1)..(1494)

SEQ ID NO: 51306 - protein, 497 aa, Salmonella typhimurium; identical to SEQ ID NO: 36915

SEQ ID NO: 51307 - DNA, 1470 bp, Streptomyces coelicolor; identical to SEQ ID NO: 36916
  CDS (1)..(1470)

SEQ ID NO: 51308 - protein, 489 aa, Streptomyces coelicolor; identical to SEQ ID NO: 9150

SEQ ID NO: 51309 - DNA, 1563 bp, Bacillus subtilis; identical to SEQ ID NO: 36918
  CDS (1)..(1563)

SEQ ID NO: 51310 - protein, 520 aa, Bacillus subtilis; identical to SEQ ID NO: 36919

SEQ ID NO: 51311 - DNA, 1602 bp, Rattus norvegicus; identical to SEQ ID NO: 36920
  CDS (1)..(1602)

SEQ ID NO: 51312 - protein, 533 aa, Rattus norvegicus; identical to SEQ ID NO: 36921

SEQ ID NO: 51313 - DNA, 1374 bp, Escherichia coli; identical to SEQ ID NO: 36922
  CDS (1)..(1374)

SEQ ID NO: 51314 - protein, 457 aa, Escherichia coli; identical to SEQ ID NO: 9056

SEQ ID NO: 51315 - DNA, 1371 bp, Salmonella typhimurium; identical to SEQ ID NO: 36924
  CDS (1)..(1371)

SEQ ID NO: 51316 - protein, 456 aa, Salmonella typhimurium; identical to SEQ ID NO: 9418

SEQ ID NO: 51317 - DNA, 1509 bp, Mus musculus; identical to SEQ ID NO: 36926
  CDS (1)..(1509)

SEQ ID NO: 51318 - protein, 502 aa, Mus musculus; identical to SEQ ID NO: 36927

SEQ ID NO: 51319 - DNA, 1308 bp, Methanococcus jannaschii; identical to SEQ ID NO: 36928
  CDS (1)..(1308)

SEQ ID NO: 51320 - protein, 435 aa, Methanococcus jannaschii; identical to SEQ ID NO: 36929

SEQ ID NO: 51321 - DNA, 1323 bp, Mycobacterium tuberculosis; identical to SEQ ID NO: 36930
  CDS (1)..(1323)

SEQ ID NO: 51322 - protein, 440 aa, Mycobacterium tuberculosis; identical to SEQ ID NO: 36931

SEQ ID NO: 51323 - DNA, 1257 bp, Escherichia coli; identical to SEQ ID NO: 36932
  CDS (1)..(1257)

SEQ ID NO: 51324 - protein, 418 aa, Escherichia coli; identical to SEQ ID NO: 36933

SEQ ID NO: 51325 - DNA, 24 bp, Primer
atgatgaacacggaaggtaataac

SEQ ID NO: 51326 - DNA, 24 bp, Primer
ttatacggttttattgcgcttcat

SEQ ID NO: 51327 - protein, 78 aa, consensus; identical to SEQ ID NO: 36936
  MISC_FEATURE (1)..(78): consensus for the disclosure of xaa see table XV

SEQ ID NO: 51328 - protein, 38 aa, consensus; identical to SEQ ID NO: 36937
  MISC_FEATURE (1)..(38): consensus for the disclosure of xaa see table XV

SEQ ID NO: 51329 - DNA, 1053 bp, Escherichia coli
  CDS (1)..(1053)
atgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaa

SEQ ID NO: 51330 - protein, 350 aa, Escherichia coli
MKKLVATAPRVAALVEYEDRAILANEVKIRVRFGAPKHGTEVVDFRAASPFIDEDFNGEWQMFTPRPADAPRGIEFGKFQLGNMVVGDIIECGSDVTDYAVGDSVCGYGPLSETVIINAVNNYKLRKMPQGSSWKNAVCYDPAQFAMSGVRDANVRVGDFVVVVGLGAIGQIAIQLAKRAGASVVIGVDPIAHRCDIARRHGADFCLNPIGTDVGKEIKTLTGKQGADVIIETSGYADALQSALRGLAYGGTISYVAFAKPFAEGFNLGREAHFNNAKIVFSRACSEPNPDYPRWSRKRIEETCWELLMNGYLNCEDLIDPVVTFANSPESYMQYVDQHPEQSIKMGVTF

SEQ ID NO: 51331 - DNA, 1053 bp, Thermococcus kodakaraensis
  CDS (1)..(1053)
atggccgagaaaatgcaggctattatgaagactaagccggcgtacggcgccgaacttgtagaagttgacgttccaaagcctgggccaggagaagtcctcattaaggttctcgcaacgagcatctgcggtacagacctccatatctacgagtggaacgaatgggcgcagagcaggataaagccgccccagataatgggccacgaagtggctggagaggtcgtcgaggtcggtcccggcgttgaggatctccaggttggagattacatcagcgttgaaactcatatcgtctgtggcaagtgctacgcgtgcaagcacaaccgctatcacgtctgccagaacaccaagatattcggagttgatatggacggtgtcttcgcccactacgcgatagttccggccaagaacgcctggaagaacccgaaggacatgccgccagagtacgcagcccttcaggagccgctcggaaacgccgtcgataccgttcttgcaggcccgattgctgggaggagcaccctcataaccggtgctggaccgctcggtcttctcggcatagcagttgccaaggcaagcggggcttatccagtcatcgttagcgagccgagtgagttcagaaggaagctcgccaagaaggtcggtgctgactacgtcgttaaccccttcgaggaagacccagtcaagttcgttatggacataaccgacggagcgggcgttgaagttttccttgagttcagtggtgcacctaaagcccttgagcagggcctcaaggcagtaacacccggaggacgcgtctcacttctcggcctcttcccgagagaggtcacgatagacttcaacaacctcataatcttcaaggcccttgaagtccacggcataaccggaaggcacctctgggaaacctggtacaccgtctcaagcctcatccagagcggcaagctgaacctcgatccgataatcacccacaagtacaagggcttcgacaagttcgaggaagcctttgagcttatgcgcgctggaaagaccggaaaggtcgtcttcttccctcacaagggatga

SEQ ID NO: 51332 - protein, 350 aa, Thermococcus kodakaraensis
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 51333 - DNA, 1056 bp, Staphylococcus aureus subsp. aureus COL
  CDS (1)..(1056)
atgaaagctttagtaaaaacaagagaaggacatggcaacttagaacttcttgataaagaagttgcaacaccgctagatgataaagtaaagattaaagtacattatgcaggaatttgtggcacagatattcatacttatgaaggtcattataaagttaattttccagtgacattaggtcatgaattttctggtgaaatcgttgaagttggagcagacgttaaagattttaaagttggtgaccgtgtcacatctgaaacgacattctatgtttgtaatgagtgtgaatactgtaaatcaaaagactataatttatgcaaccatcgaaaaggtattggaacacaagttgatggcgcatttactaattatgtcattgcacgtgaagaaagtttgcatcatattccagacgaagtatcgtatcagtctgcagctatgacagaaccattagcatgtgcacatcatggcgtttctaagattcaagtcaattcaggcgatgtagcagttgtaatgggacctgggccaatcggattacttgtagcacaagtgttaaaaagtaaaggcgcaactgttgtggtaactggattggacaatgacaaagtcagattagataaagcagaagcattgcacatggattatgtagtcaatttacaacaaacagacttaaaaacgtatatcaatggaattacagacggttacggtgcagatgttgttgttgaatgttcaggtgcagttccagcagcacgacaaggtttggatattttacgcaaaaaaggtttctacagtcaaataggtatttttaaggatgctgaaattccatttgatatggaaaaagtgattcaaaaagaaataacagttgttggtagtagaagtcaaaagccagcagattgggaaccttcattgcaacttatggcggatggtttagtaaatgctgaagctttggtgacaaaaatatatgatatttcgaaatgggacgaggcgtatcaacatttaaaatccggcgaaggtattaaagtattacttaagccgctcgatttagatgaaaatgaaggagagaattaa

SEQ ID NO: 51334 - protein, 351 aa, Staphylococcus aureus subsp. aureus COL
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKVLLKPLDLDENEGEN

SEQ ID NO: 51335 - DNA, 1044 bp, Staphylococcus aureus subsp. aureus COL
  CDS (1)..(1044)
atgaaagcattgaaattatatggcgtggaagatttacggtatgaggataatgaaaagccagtcattgaaagtgcgaatgacgttattattaaagtacgagcgactggcatatgtggttcagacacgtcacgatacaaaaaaatggggccatacattaaaggtatgccatttggtcatgaattttcaggtgtagtagatgccattggaagtgatgttacgcatgttaatgtgggcgacaaagtgacaggttgcccagcaataccttgttatcaatgcgagtattgtttaaaaggtgaatatgcacgatgtgaaaagttattcgtcattggctcatatgaacctggatcgttcgcggaatatgtcaaattgccagcgcaaaatgttttaaaggttccagacaatgttgattacattgaagcagcaatggttgagccatcagccgttgttgcgcatgggttttataaatcgaatatacaacctggtatgactgttgcagtaatggggtgtggcagtataggtttgttagctattcaatgggcacgaatatttggtgctgcacatatcatcgctatagatatagatgcgcataaactagatattgcaacatcattgggcgcacatcaaacaatcaattcaaaagaagaaaatcttgagaaattcatcgaaaatcattacgccaatcaaatcgatttagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccgggcaaagagtggacggcaaccttacattatatgaagacgaaagatattaatgtaaagcctattatttctcattttttaccgttagaaaaaggcccggagacatttgataaattagttaacaagaaagaacgatttgataaagtcatgtttacgatttattag

SEQ ID NO: 51336 - protein, 347 aa, Staphylococcus aureus subsp. aureus COL
MKALKLYGVEDLRYEDNEKPVIESANDVIIKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 51337 - DNA, 1053 bp, Staphylococcus epidermidis RP62A
  CDS (1)..(1053)
atgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaagacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaatag

SEQ ID NO: 51338 - protein, 350 aa, Staphylococcus epidermidis RP62A
MKAAVWYGQKDVRVEDREPKAIKDNEVQVKVSWAGICGTDLHEYLEGPIFISTDQPDPLLGQTAPVTLGHEFSGVVENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 51339 - DNA, 1128 bp, Staphylococcus epidermidis RP62A
  CDS (1)..(1128)
atgaaaactagagcagcagttttatatgaaatgggggctaaaaagccctataaagaatctaaacctttaaaaattgaatacttagaacttgataatcctagcgaacacgaagtattaattaaaattcatgcagctggattatgtcactctgatttgtcagtaattaatggtaacagacctagacctttacctatggcacttggtcatgaagcttccggtgaagtaattaaagttggaaaagctgttacaagagttagcgaaggagatcatgtggtatgcacatttattccaagttgtggaaaatgtatcccatgtaaagaaggacgtcctgcattatgtgaaaacggagcaatatctaatgaaaaaggcgaaatgttagagggagggatgcgtttatctaatgatgaaggaaaagtatatcatcacttggggatatcaggttttgctgaatattctgttgtctctgaaaactctatagttaaaattgataaaaaaataccttttgaacgtgcagctgcatttggttgtgctattatcacaggtatcggtgctgtggtgaatacagcccaaattcgttctggtagtaatgtagcggttgttggtttaggaggtattggattgaatgctattattggagctaaactagcgggagccaatgaaattattgctttagatattaacgaagataaatttgaattagcaaagcaatttggggctacagcaacatttaattcaagcgataaagatatcgatgagcaaattaaagaatatattcctggcggagtagaatatgcttttgaaacagcgggtgtagtgccagctatgaaagttgcttatcagattaccaaacgaggggggacaactgtaacaacaggactgcctaatcctaaagataatttttctttccctcaagttactttagcggctgaagaacgtaccattaaaggatcatatgtaggaagttgtgtacctgacagagatataccaaggttcgttaatctatacaaccaaggacgtttaaatattgattcactcattagtgaggttatcactttagatgaaattaatgagggatttgatcgtttgtctaatggtgaagtcggtagaattataatgaagatgcattga

SEQ ID NO: 51340 - protein, 375 aa, Staphylococcus epidermidis RP62A
MKTRAAVLYEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKMH

SEQ ID NO: 51341 - DNA, 1032 bp, Vibrio fischeri ES114
  CDS (1)..(1032)
atgaaaattaaagcgctttcaaaattaaaacctgaagaaggtatctggctaactgaggttgaaaaacctgagatgggtcataacgatcttcttatccgcattaagaaaactgccatctgtggtaccgatgtacatatctacaactgggacgaatggtcacaaaaaacaattccagtacctatggttgttggtcacgagtatgtaggtgaagttgttggtattggtcaagaagtgcgtggttttgaaattggagaccgcgtttcaggtgaaggtcacataacttgtggtcattgtcgtaactgtcgtggcggccgtactcacctttgtcgtaatacaacaggcgtaggtgtaaaccgtactggtgctttttctgaatacctagtgattcctgctttcaatgcatttaagatccctgctggcatttcagatgacttagcatcaatctttgacccatttggaaacgcagttcacactgctctatcatttgatttagttggtgaagacgttctaatcacgggtgctggtcctattggcatcatggcggcggctgttgcaaaacatgttggtgcacgtcacgtcgtgattactgatgtgaatgaataccgcttagatcttgctaagaaaatgggcgtaactcgtgccgtaaacgtaatgaacgagaagcttgaagatgtgatgtctgagcttggcatgacagaaggctttgatgtcggtttggaaatgtctggtaatccatcagcatttaatagcatgctaactaacatgaaccatggcggtaaaatatctcttctaggtattccaccatcagacatgactgttgattggaaccaagttatctttaaaggcttagtcatcaaaggcatttacggacgcgagatgtttgaaacttggtataagatggcaagcttaattcaatcaggcttagatctaacaccaattatcacgcaccactataagattgatgacttccaagcaggcttcgatatgatgcgctctggtatgtctggtaaagttattctagattgggaataa

SEQ ID NO: 51342 - protein, 343 aa, Vibrio fischeri ES114
MKIKALSKLKPEEGIWLTEVEKPEMGHNDLLIRIKKTAICGTDVHIYNWDEWSQKTIPVPMVVGHEYVGEVVGIGQEVRGFEIGDRVSGEGHITCGHCRNCRGGRTHLCRNTTGVGVNRTGAFSEYLVIPAFNAFKIPAGISDDLASIFDPFGNAVHTALSFDLVGEDVLITGAGPIGIMAAAVAKHVGARHVVITDVNEYRLDLAKKMGVTRAVNVMNEKLEDVMSELGMTEGFDVGLEMSGNPSAFNSMLTNMNHGGKISLLGIPPSDMTVDWNQVIFKGLVIKGIYGREMFETWYKMASLIQSGLDLTPIITHHYKIDDFQAGFDMMRSGMSGKVILDWE

SEQ ID NO: 51343 - DNA, 1011 bp, Mesorhizobium loti MAFF303099
  CDS (1)..(1011)
atgaaagccatcgaactgagccaacccaggctcgacgccttccgcgccgccaccgtcgccacccccgaaccgcagcgcggcgaggtgctgatccgccagcgtgcggccagcctcaatttcgtcgacgtcgcggtggcgagcggcaattatcccgggccgagctttccactcatcccggtcgccgacggcgccggtgagatcgtcgcgctgggcgagggcgttacgagtttcagcatgggcgatcgcgtcgtcgcccatgccaagccgcgctggatcggcggaaggccgcggccctacgaaatgacgcagatgcgcggcatctcgttgccggggtcgctggccgaatatgtcgcgctgccggccaattcgcttgtgccggtcccggcgcatctctccttcgaggcggcgtcgacgttgccgatcgccggcaccacggcatggaacgcgctgcgcaccgccaatgtcgggccgggttcggtcgtcgtgctgctcggcaccggcggcgtctcgatcttcaccctgcagcttgccaaggcggctggcgccaccgtcatcatcacctcgtcgtcggacgagaagctggagcgggcgaaggcgctgggcgccgatcacctcatcaactaccgtgcgacgccggactgggacggcaaggtgctggaactgaccggcggccttggcgccgacctcgtcgtcgagaccggcggcaccgcgaccttcgcccgcgccatcaacgccacggcgcccggcggcacgctgttcaccatcggtttcgtcaccggcgccgaggccacgatcaacctgctgccgatcatcatcaaggccttgaaagtgatcggcaacaacaccggatcggtgtccgaccttcgcgacgccgcccgcgccatcggcgccgccgggatcaagccggtcgtcgacaaggtgttttcacctgatgacgcggccgaagcctacacccacatggctgccggcggcctgcatttcggcaagctggtattcgggttggagtggtag

SEQ ID NO: 51344 - protein, 336 aa, Mesorhizobium loti MAFF303099
MKAIELSQPRLDAFRAATVATPEPQRGEVLIRQRAASLNFVDVAVASGNYPGPSFPLIPVADGAGEIVALGEGVTSFSMGDRVVAHAKPRWIGGRPRPYEMTQMRGISLPGSLAEYVALPANSLVPVPAHLSFEAASTLPIAGTTAWNALRTANVGPGSVVVLLGTGGVSIFTLQLAKAAGATVIITSSSDEKLERAKALGADHLINYRATPDWDGKVLELTGGLGADLVVETGGTATFARAINATAPGGTLFTIGFVTGAEATINLLPIIIKALKVIGNNTGSVSDLRDAARAIGAAGIKPVVDKVFSPDDAAEAYTHMAAGGLHFGKLVFGLEW

SEQ ID NO: 51345 - DNA, 870 bp, Mesorhizobium loti MAFF303099
  CDS (1)..(870)
gtgacgcccggacatgaattttcgggcatcgtcgaggcaatcggcaaggccgtctccggctttgccgtcggcgatcgtgttaccggggatcccaacatcgcctgcggacggtgcccgcattgccatgccggccgggtcaatctctgccgcaatctcaacgccatcggcatccatcgcgacggcggctttgccgagtatgtcgtgctgccgcagaaacaggctttcatcctgccggccgatctgccgccgacgcatggcgccttctgcgaaccgctcggctgctgcctgcatggcgtggaccttgcgcagatcaagcctggcagttcggtggtcgtgctgggcggcggcgtgatcggcctgctgacggtgcaactggcgaaactggccggagccaccaccatcatcctgtcgacaaggcaggcttctcggcgggtgcttgccgaggaactcggcgcgacagcgacggtcgatcctaccgccggcgatgtcatcgatgccatcgcgggatccgagggcttgatgcccggcggcgccgacgtggtgttcgaatgcgctggcgtgcgcgacaccgtcgaacaatcgatgcggctggcaagggccggcggcaccgtcgtcatcgtcggcgtgacgccgcaaggcatgaaggcggaattcgagcccttcgacctgctgtttcgggaattgaaggtggtcggctcgttcctcaacccctacacgcaccgccgcgcggccgagctcatcgcttcgggtgcgatcgagatcgatcggctgatctccaggcaggtgccgctcgaagaggcggccgatgtgatcgccaatccgccagcgcccggcgaggtcaaggtgctggtggtgccgcgacagggttga

SEQ ID NO: 51346 - protein, 289 aa, Mesorhizobium loti MAFF303099
MTPGHEFSGIVEAIGKAVSGFAVGDRVTGDPNIACGRCPHCHAGRVNLCRNLNAIGIHRDGGFAEYVVLPQKQAFILPADLPPTHGAFCEPLGCCLHGVDLAQIKPGSSVVVLGGGVIGLLTVQLAKLAGATTIILSTRQASRRVLAEELGATATVDPTAGDVIDAIAGSEGLMPGGADVVFECAGVRDTVEQSMRLARAGGTVVIVGVTPQGMKAEFEPFDLLFRELKVVGSFLNPYTHRRAAELIASGAIEIDRLISRQVPLEEAADVIANPPAPGEVKVLVVPRQG

SEQ ID NO: 51347 - DNA, 1065 bp, Bacillus halodurans C-125
  CDS (1)..(1065)
atgaaagcccttaatttatacggcattcaagaccttcgatttgaagaaacaccggccccttccatcgagcacgatgacgacatcatcataaaggtgaaggcggttggaatatgcggctctgacctctctcgatacaaaaagctcggtccttatgttccagggatgacgtttggtcatgaatttgcaggggaagtcgtcaaaatcggccgttcggtgactggattttccataggcgatcgggtggccgcttgtcctacctatacatgtggtcaatgtcgatactgtcaattaggtgagcccacacgttgcgagcggctatctgttatcggtgcccgtcatcccggcgcttatgctgaatatgtaaagctccccgcaaagcatgtgattcccttgccaaacgttgtgaactatgatgaagcagcactgattgagccggcttccgttgtggcacatggcttttatcggacgaatataaagcctggggcatccgttgcgatcatgggagtcggaagcattggcttgttggcggttcaatgggcaaagatttttggagcgactacggtttttgccatcgacatcgacgaacaaaaactgaatgtcgctaaccagctaggtgccgatgtattaattagtagcttacagcgcccagcccataaacaaattttggagtatacgaacggcatcggggtcgatgtggcggtagaatctgcagggactccaagcacgtctgcccaagtattcgcccttcctaaaaaaggcggggaagttgtatttctcggaattccttatgctgacgtccaaatcgaacgtttttattttgagaaaattgtccgcaacgaacttcatgtctacggttcgtggaatgcgctctcctccccattccctggaaaggaatgggcgaccacaatacattatatgtcaagtgggcaactgaacgtagcaccgatgatctcgtatcgccttcctctagccaaaggtcccgagacatttcagcaaatagctaaaggggaactgaaaccgacaaaagtattgttttacccagaaaaactgtctgagaggaagtag

SEQ ID NO: 51348 - protein, 354 aa, Bacillus halodurans C-125
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 51349 - DNA, 1047 bp, Bacillus halodurans C-125
  CDS (1)..(1047)
ttgcaggctttaagatggcatggagtaaaagacgtaagagttgacgacatcgcagaacctgcaacgcttaaagggaaagtaaagattaaagtgaaatggtgtggcatttgtggaagtgatcttcatgagtatgcggccggtccaatctttattccacaaaatagccctcattctctaacggaagaaaaagctccgattgtgatgggccatgagttttctggacaagtggtggaagtaggcgatggtgtgaccaaatgtgaagagggcgaccgtgtagtggtcgagccgatttttgcttgtggtacttgtaccgcctgcaagcaaggaaagtataatctttgcgagcaattagggttcctcggtttagctggaggtggaggtggtttctcggaatatgtgacagtagacgagcacatggttcacaaaattccggacactgtatccttcgagcaaggggccttagtcgagcccgccgccgttgccttatatgcggtccgccagagccagtttaatgtcggtgaccaagcggttgtattcggtacaggcccaatcggattattggttattgaagcgcttaaagcttcgggggcctcaaagatttacgcagtagaactctcaaccgaacggagacagagagcagaacaattaggtgccattgccctgaacccagcggaagtaaatgtagtggaagaaattcagcgtctaaccgatggcggtgctgatgtgtcctttgaagtaaccggtgtccctattgtcttaacacaggcgatcgagtccaccaagctaaacgggcaaacgatgattgtgagcatctttgaaaaagaagcctcttttcaaccaaacctagttgtcatgcgagaacgaaacattgcagggattattggctaccgcgacattttcccagcggtcatcagcttgatgaatcaaggctacttttccgctgagacgttagtcaccaagcggatcggcctacatgacattgtagagcaaggcttcgaggctttaatgaagacgaattgtaatattaagtgcgacaccacaaaataa

SEQ ID NO: 51350 - protein, 348 aa, Bacillus halodurans C-125
MQALRWHGVKDVRVDDIAEPATLKGKVKIKVKWCGICGSDLHEYAAGPIFIPQNSPHSLTEEKAPIVMGHEFSGQVVEVGDGVTKCEEGDRVVVEPIFACGTCTACKQGKYNLCEQLGFLGLAGGGGGFSEYVTVDEHMVHKIPDTVSFEQGALVEPAAVALYAVRQSQFNVGDQAVVFGTGPIGLLVIEALKASGASKIYAVELSTERRQRAEQLGAIALNPAEVNVVEEIQRLTDGGADVSFEVTGVPIVLTQAIESTKLNGQTMIVSIFEKEASFQPNLVVMRERNIAGIIGYRDIFPAVISLMNQGYFSAETLVTKRIGLHDIVEQGFEALMKTNCNIKCDTTK

SEQ ID NO: 51351 - DNA, 1092 bp, Pseudomonas aeruginosa PAO1
  CDS (1)..(1092)
atgaacagttccccgcaagccaacgcggcgatgcgcgccgccgtctggcacggccgccacgatatccgcgtggaagacgtgccgctcccggccgagccgccgcccggctgggtgcagatccgcgtgcactggtgcggcatctgcggctccgacctgcacgaatacctggccggcccggtattcatccccgtggaggcgccgcacccgctcaccggcctcaaggatcaatgcatcctcggccacgagttcagcggcgaaatcgtccgcctcggcaacggcgtgaccggcttcgccgtcggccaggcggtcgccgcagacgcctgccagcattgcggcacctgctactactgccggcatgggctgtacaacatctgcgagaacctggccttcaccgggctgatgaacaacggcgccttcgccgaatacgtcaacgtaccggccaacctgctctacgccctgccggccggatttcccagcgaggccggcgcgctgatcgagccgctggcggtgggcatgcacgcggtgaagaaggccggcagcctgctcgggcagaacgtggtggtggtcggcgccggcaccatcggcctgagcaccatcatgtgcgcgcgcgccgccggcgcggcacaggtgatcgccctggagatgtcctcggcgcgcaaggccaaggccctggaggtcggcgccagccaggtgctcgacccctcgcggtgcgacgccctaggcgaaatccgcgccctcaccggcgggcttggcgccgacgtcagcttcgaatgcatcggcaacaagcacaccgccaagctggccatcgatgccatccgcaaggccggcaaatgcgtgcttgtgggaatcttcgaggagcccagtgaattcaatttcttcgagctggtttccaccgagaagcagttgctcggggccctcgcctacaacggcgagttcgccgacgtgatcgccttcatagccgacggccgcctcgacatcgcaccgctggtgaccggtcgcatcggcctggaagaaatcgtcgagcgcggtttcgaagagttggtgaacaacaaggagcacaacgtgaagatcatcgtctcgccgggcggctga

SEQ ID NO: 51352 - protein, 363 aa, Pseudomonas aeruginosa PAO1
MNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFAVGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLSTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 51353 - DNA, 978 bp, Pseudomonas aeruginosa PAO1
  CDS (1)..(978)
atgaaagccgtcctctgcaaagccttcggcccggccagcagcctggtcctggaagaaatcgccagcccgagcccggcgaagaacgaaatcctcctcgatgtgcacgccgccggggtcaacttcccagacaccctgatcatcgagggcaagtaccagttcaagccacccttccccttctccccgggcggcgaggcggccggggtggtcgccgcggtcggtgaaaaggtcgcccacgtcaggcccggcgaccgggtcatggccctgaccggctggggcagcttcgccgagcaggtcaaggtgcccggctataacgtgatgccgattcccgaaggcatggacttcgccagcgccgccgccttcggcatgacctacggcacctcgatgcacgccctgaaacagcgcgccaacctgcaacccggcgagaccctgctggtgctcggcgcttccggcggggtcgggctggctgccgtggagatcggcaaggccatgggcgcccgggtgatcgctgccgccagtacccccgacaagctcgccgtggccaaggccgccggcgccgacgaactgatcaactacagcgaaggtagcctgcgcgagcagctcaaggccttgaccggcggccagggcgtcgatgtgatctacgatccggtgggcggcgaactgttcgaggaggccttccgcagcatcgcctggaacggacggatgctggtggtcggcttcgccagcggcagcatcccttcgctgccggccaacctgaccctgctcaagggcgcctcgctggtcggcgtgttctggggatcgttcgcccaacgccagccgcaggacaacgctgacaacttccgccagctgttcgcctggcacgccgaaggcaaactgaagccgctggtgtcgcagcgcttcccgctggaacgggccggcgacgctatcgacgccctcggccagcgcagggcggtcggcaaggtggtggtggaggttcgctga

SEQ ID NO: 51354 - protein, 325 aa, Pseudomonas aeruginosa PAO1
MKAVLCKAFGPASSLVLEEIASPSPAKNEILLDVHAAGVNFPDTLIIEGKYQFKPPFPFSPGGEAAGVVAAVGEKVAHVRPGDRVMALTGWGSFAEQVKVPGYNVMPIPEGMDFASAAAFGMTYGTSMHALKQRANLQPGETLLVLGASGGVGLAAVEIGKAMGARVIAAASTPDKLAVAKAAGADELINYSEGSLREQLKALTGGQGVDVIYDPVGGELFEEAFRSIAWNGRMLVVGFASGSIPSLPANLTLLKGASLVGVFWGSFAQRQPQDNADNFRQLFAWHAEGKLKPLVSQRFPLERAGDAIDALGQRRAVGKVVVEVR

SEQ ID NO: 51355 - DNA, 1017 bp, Halobacterium salinarum NRC-1
  CDS (1)..(1017)
atggacgcacgcacactgtacttcaccggccccggctccgtcgcggtgcgcacggggacggtcagcgaccccgtcgacgacgaggtcgtggtggagacgcaggcctcgggcatcagcgccggatcggagctgttggtctaccgcggcgagttccccgagtccctgcccgtggacgccaccatcgacgccctcgacggcgagttcgactacccgctcgcgtacggatacgccagcgtcggcacggtcaccgccaccggcccggacagcaccgagtggctcgaccgccgcgtgttcgcgttcgaaccccacgccacgcgcttccggacgacgcccgacgcggtcgtcgaactccccgacgacatcgccacgcaggcggcgacgctcctgccgacggttgaaacggccacgaacctcgtgctcgacgcccaaccccggatcggcgagcgcgccgtggtgttcggtgcgggcgcggtcggcctcgccacgacacagctgctggcgtcgttcccgctgtcggaggtcgtcgtcgtggagcccctggcgtcccgccgcgccaccgccgccgcggtcggtgccgaccgcaccatcgaccccgggtcgactgccatcgcggacgcgccgccgttcgccgacgccgaacccgccggcgcggacgtcgtgttcgaactctcgggccgcccggagaccctcgacgacgccatcgcggccgcgggctacgacagccgcgtgatcgtggggtcgtggtacggcgcgaagcgcgcgcccatcgacctcggtgggtcgttccatcgcgaccgcgtggacatcgtgtccagccaggtcagcacgctcagccccgagttgcgggggcgctgggacaccgaccgccgcttcgacgtggcgttcgaccgcctggacgccatggacgcggacgcgctgatcacgcacgaactccccctcgatcgggccgccgacgcctacgccctcctcgacgaccaccccgacgaagcccgccacatcatcctcacctaccaatga

SEQ ID NO: 51356 - protein, 338 aa, Halobacterium salinarum NRC-1
MDARTLYFTGPGSVAVRTGTVSDPVDDEVVVETQASGISAGSELLVYRGEFPESLPVDATIDALDGEFDYPLAYGYASVGTVTATGPDSTEWLDRRVFAFEPHATRFRTTPDAVVELPDDIATQAATLLPTVETATNLVLDAQPRIGERAVVFGAGAVGLATTQLLASFPLSEVVVVEPLASRRATAAAVGADRTIDPGSTAIADAPPFADAEPAGADVVFELSGRPETLDDAIAAAGYDSRVIVGSWYGAKRAPIDLGGSFHRDRVDIVSSQVSTLSPELRGRWDTDRRFDVAFDRLDAMDADALITHELPLDRAADAYALLDDHPDEARHIILTYQ

SEQ ID NO: 51357 - DNA, 1011 bp, Deinococcus radiodurans R1
  CDS (1)..(1011)
ttgctcctcgtcccagctttttccggaggttttgccatgcgtgccctcgtttgccagcagttcgaccagcccgaaaccctgaccgttcttgagagccccgaccccacgcccggcgccggcgaggtcgtgattgccgtggaagccgccggcgtcaacttccccgacgccctgatggtgatgggccagtaccaggttcgcccgccgctgcccttcgtggcgggggccgaggccgccggaaccgtcgccgccatgggcgagggcgtgcggcacctcaagcccggtcagaacgtggtggcctttaccggcaccggggctttcgcgtcgcatctggtggcgcctgcctccaatgtgattccgctgccgcccggctttccggcggacgtggcggcgacgctgccgctcgcttacggcaccaccctgcacgccctgattcagcgcgggcaactgaaagaaggcgaaacgctgctggtcctcggcgcggcgggcggtgtggggctggccgccgtgatgatcggcaaggcgctcggcgcacgggtcatcgcggcagcgtccacgccggaaaaatgcgcggtggcgagtgagcacggcgccgacgaagtcatcaactacacggacgaggacctgcgcgagcggctcaaggcgctgaccggcaaaaagggcctggacgtggtgttcgacccggtgggcgaccgctacgccgaacccgctttccgctcgctcggctggaacgggcgctacctcgtcatcggcttcgcgggcggcgagattcccaagctgccgctcaacctgccgctgctcaagggctccagcctcgtcggcgtgttctggggcgaattcgcgcagcgcgagccgaaggccaatgccgagaacatggcgcggctcatcggctggattgccgagggcaaagtacgccccctcgtcagtgagcgctacccgctggagcgcggctccgaggcgctgcgggcgctgctggggcgacaggtgacggggaaggtggtcattacaccttga

SEQ ID NO: 51358 - protein, 336 aa, Deinococcus radiodurans R1
MLLVPAFSGGFAMRALVCQQFDQPETLTVLESPDPTPGAGEVVIAVEAAGVNFPDALMVMGQYQVRPPLPFVAGAEAAGTVAAMGEGVRHLKPGQNVVAFTGTGAFASHLVAPASNVIPLPPGFPADVAATLPLAYGTTLHALIQRGQLKEGETLLVLGAAGGVGLAAVMIGKALGARVIAAASTPEKCAVASEHGADEVINYTDEDLRERLKALTGKKGLDVVFDPVGDRYAEPAFRSLGWNGRYLVIGFAGGEIPKLPLNLPLLKGSSLVGVFWGEFAQREPKANAENMARLIGWIAEGKVRPLVSERYPLERGSEALRALLGRQVTGKVVITP

SEQ ID NO: 51359 - DNA, 1155 bp, Mycobacterium tuberculosis CDC1551
  CDS (1)..(1155)
atgcgtgcggtagtcatcgacggggccggcagcgtcagagtcaacacccagcccgacccggcactgcccgggcctgacggagtggttgtcgccgtgaccgccgccggcatctgcggatccgatctgcatttctacgaaggcgaatatccgttcaccgagccggtggccctcggtcacgaggcggtaggcaccatcgtcgaggccgggccacaggtgcgcaccgtcggagttggcgacctggtcatggtgtcttcagtggccggctgcggcgtctgcccgggatgcgaaacccatgatccagtcatgtgcttctccggcccgatgatcttcggcgccggcgtgcttggcggcgcacaggccgatctgctggcggtgccggccgccgatttccaggtgctcaagatccccgaaggtatcaccaccgagcaggcactgctgctcacggacaacctcgccaccggttgggcggcagcccaacgagccgatatttcattcggctccgccgtggcggtcatcggcctgggagccgtcggcctctgcgcgctgcgcagcgccttcatacacggtgccgcaacggttttcgctgtcgaccgagtaaagggacgcttgcaacgcgcggccacctggggtgctacgccgataccgtcaccggcggccgagacgattctggccgcgacgcggggtcgcggcgcagactcggtgattgacgccgtcggcaccgacgcctcgatgagcgacgcgctcaatgcggtgcgccctggcggcaccgtctcggttgtcggcgtgcacgatcttcagccgtttcccctgcccgcactgacgtgcctgttgcgaagcatcacgctgcgaatgaccatggcaccggtacaacgaacctggccggaactgatcccgttgctgcagtcgggccgactcgatgtcgatggcatcttcactaccaccctgccgttggacgaagcggccaagggctatgcaaccgcgagggcgcgctcgggtgaggagctaaggttctgcttacgccctgacagccgtgatgtactgggagcgcatgaaactgtcgatctttacgtccacgtccggcggtgtcagtccgtagccgacctgcagctcgagggtgctgcggacggggtcgacggcccatccatgctcaactag

SEQ ID NO: 51360 - protein, 384 aa, Mycobacterium tuberculosis CDC1551
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPLPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 51361 - DNA, 1038 bp, Sulfolobus solfataricus P2
  CDS (1)..(1038)
atggtggagggattctcacctatgaaaagcgtaattatggagaacggaaaggctgtaataaaggagctaccattacctaaattacagcaaggtgatgtattagttaaaatgaaggcttgtggattgtgcggtactgacatcgagaagatttgtgggcaatacaccgcatcacaaccaatattgggtcatgaaccgactggaataatccaagaatctacagtggattggctaaagcctggggatagggtctttgctcatcaccatgtcccatgctatgagtgttattattgtaaaaagggaagcccgaccatgtgtccttattatagaaaaactaacttagatcccggtggattttcggagtacttcagagtcccagcttggaatgttgcaagagggggagtattaaagttgccagataatgtaagtttcgaagaaggggcattcatagaaccattagctaccgttattagggcgcaaaagagagtagctatcgataatggcgatacggtctttattgttggaattggtcccatgggactattacacgcaatgatggctaaggtaaataaggcaggagttatcatagcatcagacgtaagtgattttagaaccgaatttggatacaaagtaggtattaactattcccttaatgcgaagaaagttaatgtagttgatgaagttaagagattaaccgatggtagaggcgctgatgttactataatagcctctggatctccttctgcaatagtctctggtcttaatgctactagaaagggtggtagagttttactatttggtgtgccatataaggggacgatacttaattacgatattagtgacctcttaaataatgagatctcaataattcctagtaatgctgctgtggaagaggatacaaaggaagctttagctataatagctaataagaagattgatgtaactaaactgataactcatagattctcattagatgagttcaatgaggccgtaaggataggtaaggagggaaatgccataaaggtaataatatatagttga

SEQ ID NO: 51362 - protein, 345 aa, Sulfolobus solfataricus P2
MVEGFSPMKSVIMENGKAVIKELPLPKLQQGDVLVKMKACGLCGTDIEKICGQYTASQPILGHEPTGIIQESTVDWLKPGDRVFAHHHVPCYECYYCKKGSPTMCPYYRKTNLDPGGFSEYFRVPAWNVARGGVLKLPDNVSFEEGAFIEPLATVIRAQKRVAIDNGDTVFIVGIGPMGLLHAMMAKVNKAGVIIASDVSDFRTEFGYKVGINYSLNAKKVNVVDEVKRLTDGRGADVTIIASGSPSAIVSGLNATRKGGRVLLFGVPYKGTILNYDISDLLNNEISIIPSNAAVEEDTKEALAIIANKKIDVTKLITHRFSLDEFNEAVRIGKEGNAIKVIIYS

SEQ ID NO: 51363 - DNA, 1194 bp, Agrobacterium tumefaciens str. C58
  CDS (1)..(1194)
gtggcaggtcgcaaaacaggccttccccaaaacccagcgatttcaggccttcggtggagaaagccgttctggcatgggcattgcaccttctctggcatcaagtgccatcgaggagaaaacatgcgcgcgctcagatttcatgcagccaaggatttgcggatcgaagacattgccgagccgaaacggcctggcccgggacaggtcctcgtccgcaaccgtttcgtcggcatctgcggcaccgatctgcatgaatatagctacggcccgatcttcattcccaccgaaccgcatccttttaccggcgcccatggcccacagattctgggccacgaattcggcggcgtggttgaggcgatcggcgacggtgtgacctccgtcaacgtcggcgaccgcgtctccatccagccgctcatcatgccgcgatccggcgattatttcgctgatcgtggccttttccatctcagcacgcaactggcactggtcggcctcagctgggacggcggcggcatggcggaagccgcacttgtcaacgaatacaacgtccagaaaattccggacgagatgaccgacgaagaggccgcactggtggaaccctcggccgttgccgtttatgcctgtgatcgcggtggcgttaccgccggtaatagcgttctggtcacgggtgccggcccgatcggcatgttgacgcttctggcggcccgcgccgccggcgctacccagctttttgtctccgatctgaatgacgcccgcctcgagcttgcccgcaatgtcatccgtgatgtcatcaccatcaaccccaagcgcgataatgtcggtgatgtcgtccgctcggcaaccgaaggcaaggtcggctgcgacgtggcgatcgaatgcgtgggtaatgaacatgcgctcaaggcctgcgttgacgccgtgcgcaagcagggcgtcgtcgtgcaaaccgggctgcacccgcatgaaaacccgatcgactggttccaggtgacgttccgtgatctggagatcaagggctcctgggcctatccgacccattactggccgcgcgtcatccggctcattgcctccggcctgctgccggcgacgaagatcgtcaccaagcgcatcacgctggatacggccgtgaccgagggcttcgatgccctgctcgaccccgccggcacgcatctgaaaatcctgatcgatctttcgaaatag

SEQ ID NO: 51364 - protein, 397 aa, Agrobacterium tumefaciens str. C58
MAGRKTGLPQNPAISGLRWRKPFWHGHCTFSGIKCHRGENMRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILIDLSK

SEQ ID NO: 51365 - DNA, 1056 bp, Staphylococcus aureus subsp. aureus Mu50
  CDS (1)..(1056)
gtgaaagctttagtaaaaacaagagaaggacatggcaacttagaacttcttgataaagaagttgcaacaccgctagatgataaagtaaagattaaagtacattatgcaggaatttgtggcacagacattcatacttatgaagggcattataaagttaattttccagtgacattaggtcatgaattttctggtgaaatcgttgaagttggagcagacgttaaagattttaaagttggtgaccgtgtcacttctgaaactacattctatgtttgtaatgagtgtgaatactgtaaatcaaaagactataatttatgcaaccatcgaaaaggtattggaacacaagttgatggcgtatttactaattatgtcattgcacgtgaagaaagtttgcatcatattccagacgaagtatcgtatcagtctgcagctatgacagaaccattagcatgtgcacatcatggcgtttctaagattcaagtgaactctggcgatgtagcagttgtaatgggacctgggccaatcggattacttgtagcacaagtgttgaaaagtaaaggcgcaactgttgtggtaactggattggacaatgacaaagtcagattagataaagcagaagcattgcacatggattatgtagtcaatttacaacaaacagacttaaaaacgtatatcaatggaattacagacggttacggtgcagatgttgttgttgaatgttcaggtgcagttccagcagcacgacaaggtttagatattatacgcaaaaaaggtttctacagtcaaataggtatttttaaggatgctgaaattccatttgatatggaaaaagtgattcaaaaagaaataacagttgttggtagtagaagtcaaaagccagcagattgggaaccttcattgcaacttatggcggatggtttagtaaatgctgaagctttggtgacaaaaatatatgatatttcgaaatgggacgaggcgtatcaacatttaaaatctggcgaaggtattaaagcattacttaagccgctcgatttagatgaaaatgaaggagagaattaa

SEQ ID NO: 51366 - protein, 351 aa, Staphylococcus aureus subsp. aureus Mu50
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGVFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDIIRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 51367 - DNA, 1044 bp, Staphylococcus aureus subsp. aureus Mu50
  CDS (1)..(1044)
gtgaaagcattgaaattatatggcgtagaagatttacggtatgaggataatgaaaagccagtcattgaaagtgcgaatgacgttattgttaaagtacgagcgactggcatatgtggttcagacacgtcacgatacaaaaaaatggggccatacattaaaggtatgccatttggtcatgaattttcaggtgtagtagatgccattggaagtgatgttacgcatgttaatgtgggcgacaaagtgacaggttgcccagcaataccttgttatcaatgcgagtattgtttgaaaggtgaatatgcacgatgtgaaaagttattcgtcattggctcatatgaacctggatcgttcgcggaatatgtcaaattgccagcgcaaaatgttttaaaggttccagacaatgttgattacattgaagcagcaatggttgagccatcagccgttgttgcgcatgggttttataaatcgaatatacaacctggtatgactgttgcagtaatggggtgtggcagtataggtttgttagctattcaatgggcacgaatatttggtgctgcacatatcatcgctatagatatagatgcgcataaactagatattgcaacatcattgggcgcacatcaaacaatcaattcaaaagaagaaaatcttgagaaattcatcgaaaatcattacgccaatcaaatcgatttagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccgggcaaagagtggacggcaaccttacattatatgaagacgaaagatattaatgtaaagcctattatttctcattttttaccgttagaaaaaggcccggagacatttgataaattagttaacaagaaagaacgatttgataaagtcatgtttacgatttattag

SEQ ID NO: 51368 - protein, 347 aa, Staphylococcus aureus subsp. aureus Mu50
MKALKLYGVEDLRYEDNEKPVIESANDVIVKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 51369 - DNA, 1044 bp, Sulfolobus tokodaii str. 7
  CDS (1)..(1044)
atgcgcgcgatgagattagtagaaataggaaagccgttaaagttggaagatattccaatccctaagccaaaaggttctcaagtcttaataaaaattgaagccgctggagtatgtcattcagacgtgcatatgaggcaaggaagatttggtaatttgagaatagttgaagatttaggtgtgaaattgcctgttactttaggtcatgagattgctggtaggatagaggaagtaggtgatgaggttgtcggatattctaagggtgatttggttgctgtgaatccttgggagggtgagggaaattgttattactgtagaattggtgaagagcacttgtgtgactcaccaaggtggttagggattaattatgatggtgcttatgccgaatatgttttagttcctcattataaatacttgtataagttaaggagacttagtgccgttgaggctgcaccattaacttgttccggtgtaacaacgtatagggctgttaggaaagcatctcttgatccctcaaagacactagtagtaataggtgctggtggaggattaggtactatggctatacaaatagctaaggctgtgagtggtgctacaataattggtgttgatgtgagggaggaggcattagaggctgctaaaagggctggggctgattatgtaataaacgcttcatctcaagatccggtaagtgagattaggagaataactcaaggtaaaggggctgatgctgttatagatttaaacaactcagaaaaaactctctcaatttatccttatgttttagctaaacaagggaaatacgtaatggttggactttttggtgctgatttaaagtatcatgcacctttaataacgttaaatgaggttcaatttataggtagtcttgttggtaatcaatctgacttcttgggtattatgagcttagccgaggctggtaaggttaaacctatggtgactaagacgatgaaattagaagaggcaaatgaggctatagataatttggagaactttaaagctgttgggaggcaagtattagtaccttaa

SEQ ID NO: 51370 - protein, 347 aa, Sulfolobus tokodaii str. 7
MRAMRLVEIGKPLKLEDIPIPKPKGSQVLIKIEAAGVCHSDVHMRQGRFGNLRIVEDLGVKLPVTLGHEIAGRIEEVGDEVVGYSKGDLVAVNPWEGEGNCYYCRIGEEHLCDSPRWLGINYDGAYAEYVLVPHYKYLYKLRRLSAVEAAPLTCSGVTTYRAVRKASLDPSKTLVVIGAGGGLGTMAIQIAKAVSGATIIGVDVREEALEAAKRAGADYVINASSQDPVSEIRRITQGKGADAVIDLNNSEKTLSIYPYVLAKQGKYVMVGLFGADLKYHAPLITLNEVQFIGSLVGNQSDFLGIMSLAEAGKVKPMVTKTMKLEEANEAIDNLENFKAVGRQVLVP

SEQ ID NO: 51371 - DNA, 1041 bp, Bacillus subtilis subsp. subtilis str. 168
  CDS (1)..(1041)
atgaaggcagcaagatggcataaccaaaaggatatccgtattgaacatatcgaagagccaaaaacggagccgggaaaagtaaagatcaaagtcaaatggtgcggcatctgcggaagtgatttacacgaatatctgggcggcccgatctttattccggttgacaaaccgcacccattaacaaatgaaacggcacctgtcacaatggggcatgaattctccggtgaagttgtcgaagtcggagaaggcgttgaaaattataaagttggagaccgcgttgtagtcgagccgatttttgctacacacggccaccaaggcgcctacaaccttgatgaacaaatgggattcctcggcttagccggcggaggcggcggtttctctgaatacgtctctgtggatgaagagcttttgttcaaacttcctgatgaattatcatatgaacaaggcgcgctcgttgaaccttctgcagttgctctatacgctgtccgctcaagcaaactcaaagcaggcgacaaagcggctgtattcggctgcggcccgatcggacttcttgtcattgaagcgctgaaggctgccggtgcaactgatatttacgctgttgagctttctcctgaacgccagcaaaaagctgaggagcttggcgcgatcatcgttgatccgtctaaaacagacgatgtagtcgctgagattgcagaacgtacaggaggcggtgttgacgtagcattcgaagtcactggtgtcccagtggtgttacgacaagccatccagtccactacaattgccggtgaaaccgtcatcgtcagcatttgggaaaaaggtgctgaaatccatccgaacgatatcgtaatcaaagaacgtacagtaaaaggaattatcggataccgcgacatcttcccggctgtattgtcattaatgaaagaaggctatttctcagccgacaaactcgtaacgaaaaaaatcgtactagatgatttgatcgaggaaggcttcggggctcttattaaagagaaaagccaagtcaaaatccttgttagacctaactaa

SEQ ID NO: 51372 - protein, 346 aa, Bacillus subtilis subsp. subtilis str. 168
MKAARWHNQKDIRIEHIEEPKTEPGKVKIKVKWCGICGSDLHEYLGGPIFIPVDKPHPLTNETAPVTMGHEFSGEVVEVGEGVENYKVGDRVVVEPIFATHGHQGAYNLDEQMGFLGLAGGGGGFSEYVSVDEELLFKLPDELSYEQGALVEPSAVALYAVRSSKLKAGDKAAVFGCGPIGLLVIEALKAAGATDIYAVELSPERQQKAEELGAIIVDPSKTDDVVAEIAERTGGGVDVAFEVTGVPVVLRQAIQSTTIAGETVIVSIWEKGAEIHPNDIVIKERTVKGIIGYRDIFPAVLSLMKEGYFSADKLVTKKIVLDDLIEEGFGALIKEKSQVKILVRPN

SEQ ID NO: 51373 - DNA, 1020 bp, Bacillus subtilis subsp. subtilis str. 168
  CDS (1)..(1020)
atgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgctcgctaccctcccgagagtcatcggacacgaggtaacgggacaagtggaggcagttggtgcgaatgtacagagcctaaaacccggtgatcatgtggtgattgagccgatttcttattgcggatcgtgctatgcctgccgcaaagggcggccgaatgtttgcgccaagctttctgtatttggcgtacatgaggacggaggcatgcgggaatatattgtgcttccggaaagacagcttcacgcggtctcaaaggacttgccttgggaggaagcagtcatggccgagccttatacgataggcgcccaggcagtgtggagaggccaggtggaaaaaggtgataccgtcctgatccagggagcggggcccatcgggatctgtgtgttaaaaatggcaaaactggcgggcgctgctgtcatgatgactgacttgaacaacgagcggctggcatttgcgaaagaaaacggcgccgatgctgttgtaaatgtccaagcagaacatgttgccgagcgggtccttgaatggactgggaatgaaggagcaaacgtggtcattgatgctgtttgcctgccggagacttttgcactttcaattgaggctgtgtcaccggcgggacatgtggttgtgcttggatttgatgaaagagcggctcagatttctcagctgccaattacaaaaaaagaagtcacgataaccggatcccgattgcagaccaatcagtttccaaaagtggtagagcttttgaatggaggccggttaatgcataacgggctggtgacccatacattttcagttgatgacgttcatcatgcatttcagtttattaaggagcatccagatcaggtgcggaaagccgtcatcacgtttgattaa

SEQ ID NO: 51374 - protein, 339 aa, Bacillus subtilis subsp. subtilis str. 168
MKAVQVRKAYDLVTAEVKKPVLSKDDEVLVKVKRVGICGSDMHIYHGTNPLATLPRVIGHEVTGQVEAVGANVQSLKPGDHVVIEPISYCGSCYACRKGRPNVCAKLSVFGVHEDGGMREYIVLPERQLHAVSKDLPWEEAVMAEPYTIGAQAVWRGQVEKGDTVLIQGAGPIGICVLKMAKLAGAAVMMTDLNNERLAFAKENGADAVVNVQAEHVAERVLEWTGNEGANVVIDAVCLPETFALSIEAVSPAGHVVVLGFDERAAQISQLPITKKEVTITGSRLQTNQFPKVVELLNGGRLMHNGLVTHTFSVDDVHHAFQFIKEHPDQVRKAVITFD

SEQ ID NO: 51375 - DNA, 1032 bp, Agrobacterium tumefaciens str. C58
  CDS (1)..(1032)
ttgatgaagatgaaagctgttgtcatgaccggggcgaaccagccttgggaggttcaagaggttcccgttccgaaggcagagccaggacttgtccttgttaaaatccacgcctccggcatgtgctacacggacgtgtgggcgacgcagggtgccggtggcgacatctatccgcagacccccggccatgaggttgtcggcgagatcatcgaggtcggcgcgggcgttcatacgcgcaaggtgggagaccgggtcggcaccacctgggtgcagtcctcttgtggacgatgctcctactgccgccagaaccgtccgttgaccggccagacagccatgaactgcgattcacccaggacaacggggttcgcgacgcaaggcgggcacgcagagtacatcgcgatctctgctgaaggcacagtgttattacccgacgggctcgactacacggatgccgcacccatgatgtgcgcaggctacacgacctggagcggcttgcgcgacgccgagcccaaacctggtgacagaattgcggtacttggcatcggcgggctggggcacgtcgccgtgcagttctccaaagccttggggtttgagaccatcgcgatcacgcattcacccgacaagcacaagttggccaccgatcttggtgcagacatcgtcgtcgccgatggcaaagagttattggaggccggcggtgcggacgttcttctggttacgaccaacgacttcgacaccgccgaaaaagcgatggcgggcgtaaggcctgacgggcgcatcgttctttgcgcgctcgacttcagcaagccgttctcgatcccgtccgacggcaagccgttccacatgatgcgccaacgcgtggttgggtccacgcatggcggacagcactatctcgccgaaatcctcgatctcgccgccaagggcaaggtcaagccgattgtcgagaccttcgccctcgagcaggcaaccgaggcatatgagcggctatccaccgggaagatgcgcttccggggcgtgttccttccgcacggcgcttga

SEQ ID NO: 51376 - protein, 343 aa, Agrobacterium tumefaciens str. C58
MMKMKAVVMTGANQPWEVQEVPVPKAEPGLVLVKIHASGMCYTDVWATQGAGGDIYPQTPGHEVVGEIIEVGAGVHTRKVGDRVGTTWVQSSCGRCSYCRQNRPLTGQTAMNCDSPRTTGFATQGGHAEYIAISAEGTVLLPDGLDYTDAAPMMCAGYTTWSGLRDAEPKPGDRIAVLGIGGLGHVAVQFSKALGFETIAITHSPDKHKLATDLGADIVVADGKELLEAGGADVLLVTTNDFDTAEKAMAGVRPDGRIVLCALDFSKPFSIPSDGKPFHMMRQRVVGSTHGGQHYLAEILDLAAKGKVKPIVETFALEQATEAYERLSTGKMRFRGVFLPHGA

SEQ ID NO: 51377 - DNA, 1116 bp, Yersinia pestis CO92
  CDS (1)..(1116)
atgagtcacgaaaaccttaaaggcgctcaaatggcggagggtatccccgagaccatgcgtgcagttgtcgcctacgggccgcgcgattatcggtttgaaagagtgccggttccgactatcgatgccaaagagattttggtcaaagttgaagggtgtggcatctgcgccggggacaccaaggcttttgagggtgcccccagtttctggggtgatgataagcaacctgcttatatcaaagcaccgatgattccaggtcatgaatttattggtcacgtcgttggcttgggcgcagatgttgaggggtttgagctaggtgatagagtgacttctgagcaaattgttccttgctggggctgccggttctgtaaccatgggcagtactggatgtgtgaaaaacacgatctgtacggcttccagagcaatgttaatggcgcgatggctgaatacctgaaattcacgaaagaagcgattaattatcatgtccctgatcaccttcctttagaaaaagccattctgattgaaccctatgcctgcgcatttcacgcggtacaacgcgccaagataaaactcggtgatgtggtggttttggccggttcaggaaccttagggctaggcatgattggggcaattaaaaagtctggggctgccaagctcattgtgctggatttatcggatgatcgtttggctctcgccaagaagttcggcgctgatttggtgcttaatcccagtagagatgatgtgaataccctgattaaagaaatgaccggtggttatggttgcgatatctacattgatgccactggtgcgcaaaaagccgttgaacaaggattaaccctgctgcgtaagttggggacgtttgtggaattctcggtatttaaagatcccgtgaccgttgactggagcatcatcagtgaccgtaaggaacttgatgtcttgggttcacatctggggccatattgcttcccgctggtgattgaaggcatctctaacggtgatttaccgaccgagggggtcgtcacacatatcttgccattggagaaatatgccgagggtattgagctggtcaaaagaggcgttgactcacttaaagtggttctcaatcccaacctaacctaa

SEQ ID NO: 51378 - protein, 371 aa, Yersinia pestis CO92
MSHENLKGAQMAEGIPETMRAVVAYGPRDYRFERVPVPTIDAKEILVKVEGCGICAGDTKAFEGAPSFWGDDKQPAYIKAPMIPGHEFIGHVVGLGADVEGFELGDRVTSEQIVPCWGCRFCNHGQYWMCEKHDLYGFQSNVNGAMAEYLKFTKEAINYHVPDHLPLEKAILIEPYACAFHAVQRAKIKLGDVVVLAGSGTLGLGMIGAIKKSGAAKLIVLDLSDDRLALAKKFGADLVLNPSRDDVNTLIKEMTGGYGCDIYIDATGAQKAVEQGLTLLRKLGTFVEFSVFKDPVTVDWSIISDRKELDVLGSHLGPYCFPLVIEGISNGDLPTEGVVTHILPLEKYAEGIELVKRGVDSLKVVLNPNLT

SEQ ID NO: 51379 - DNA, 978 bp, Caulobacter crescentus CB15
  CDS (1)..(978)
atgcgcgccctcgtcgtcgaggacctcgcgccgaactacgccggctgcgctgtccgcgaggtcgccacgccccagcccggacccggcgaggcgctggtccgcgtgcgcgccgccagcgtcaatttccccgacctcctgatgacgcgcggcgagtatcagctcaaaccgcccctgcccttcacgccgggcctggatctggccggcgaggtcgtggcgctgggcgagggcgtgacaggcctctcggtcggcgacgccgtggtcggcggggcgcggctgggcgggttcgccgagtacgcggtgctgtcggcgggcgctctcaagcccaagccggcccgcctgtccttcgccgaggctgcggcctatggcgcggcgtacctgaccgcctatgtcgccctggtgcgccgcgcgcgactggagccgggcgagtgggtgctggtgcacggcgcggccggcggggtgggtctggcggccgtggacctggccaaggccctgggcgcgcgggtgatcgccacctcggcctctgacgccaagcttgcgcaggtgaaggtgctctacgcccccgacgccgtggtcaatgtcacggagggcttccgcgaccaggtgaaggccatcaccggcggccatggagccgatgtgatctatgaccccgtgggcggcgacgtcttcgacgagagcgtgcgctgcatcgccttcgacgggcgactgctggtgatcggcttcacctcggggcggatccccaacgtctcggtcaatatgccactgatcaagggcttctcggtgatgggcgtacgggccggcgaatatggccgccagtttcccgagaagggccgcgaaaacgccgacgcgatctggacgatggccaatgagggcgtgatccggccgcacgtccacgccgagctgcccctggaccgctggcgcgaggccttcgacctgctggccgagcgcaaggtggtgggcaaggcggtgatcacgccgtga

SEQ ID NO: 51380 - protein, 325 aa, Caulobacter crescentus CB15
MRALVVEDLAPNYAGCAVREVATPQPGPGEALVRVRAASVNFPDLLMTRGEYQLKPPLPFTPGLDLAGEVVALGEGVTGLSVGDAVVGGARLGGFAEYAVLSAGALKPKPARLSFAEAAAYGAAYLTAYVALVRRARLEPGEWVLVHGAAGGVGLAAVDLAKALGARVIATSASDAKLAQVKVLYAPDAVVNVTEGFRDQVKAITGGHGADVIYDPVGGDVFDESVRCIAFDGRLLVIGFTSGRIPNVSVNMPLIKGFSVMGVRAGEYGRQFPEKGRENADAIWTMANEGVIRPHVHAELPLDRWREAFDLLAERKVVGKAVITP

SEQ ID NO: 51381 - DNA, 963 bp, Caulobacter crescentus CB15
  CDS (1)..(963)
atgaaggcggctgtctattatgaaaccggcgctccggacgtcctgcgctatgaggatgccgccgatccggtctgccacgcgcaaggcgtcgtcatccgcgtcgaggccgtcagcatcgagggcggcgacacgctcaatcgcggcggcggccagatggcgggcgtcccgcacattgtcggctaccaggcggccggcgagatcatcgaagtcggcgccgaggtctcgcacctgaaggtcggccagaaggtcgtgaccgtgaacgccttcggctcgcatgccgaactgcgctccgtgccggcgcgtaacgcctggccgatccccgagggctttgatctccacaaggccgccgccatccccgtgccgttcggcacggcgcacgagtgcctgttcggcgccgggcgcctgaaggccggcgaaaccgttctggtccaggctggggccggcgccgtgggcctggccgccattcaactggccaagcaggccggcgcgacggttctggcctcggcctccagcgacgagcgtctggagcgtctgaagccgttcggtatggatcacgggatcaactatcggcgcgatgatctggtcgaacaggtcatgaagctgaccggcggcaagggcgtcgatctggtcgttgaccccgtcggcggagcgactctgcctggcagtctggcggctttgggctaccggggccgcgtctcgctggtgggcaacgccggccgcgagccgatgaaggtcgatgtcggctcactgatgggcggtaatcgcagcctgaccggcgtgttcctgggcgccgagatcatgaccgatcgcgtccatgacatgatccaggacctgatcgagaaggcggcgcgcggcgagcttgaggtcgtcatcgaccgcaccttcccgctgtcgcaagccgccgccgcccacgcctatatcgaaagccgccaagccgtcggccgcgtgctgctcattccctga

SEQ ID NO: 51382 - protein, 320 aa, Caulobacter crescentus CB15
MKAAVYYETGAPDVLRYEDAADPVCHAQGVVIRVEAVSIEGGDTLNRGGGQMAGVPHIVGYQAAGEIIEVGAEVSHLKVGQKVVTVNAFGSHAELRSVPARNAWPIPEGFDLHKAAAIPVPFGTAHECLFGAGRLKAGETVLVQAGAGAVGLAAIQLAKQAGATVLASASSDERLERLKPFGMDHGINYRRDDLVEQVMKLTGGKGVDLVVDPVGGATLPGSLAALGYRGRVSLVGNAGREPMKVDVGSLMGGNRSLTGVFLGAEIMTDRVHDMIQDLIEKAARGELEVVIDRTFPLSQAAAAHAYIESRQAVGRVLLIP

SEQ ID NO: 51383 - DNA, 1041 bp, Caulobacter crescentus CB15
  CDS (1)..(1041)
atgaaagccctgcgctatcacggcgcccgcgacgtccggtacgagagcatggacgatcccacgccccagtcggaccgcgacgcgatcgtccaggtcaccgcctgctcgatctgcggctcggacctgcacatctatcacggccatggcttctcggaggacctcgggttctgcgtcggccacgaggcggtcggcgaggtggtcgaggtcgggcgcggcgtccagcggctgaaggtcggcgacaaggtcatgctgccggccgccgtaggctgcgggcgttgccgctcgtgcctgtcgggcgtgatccagacctgcgagaacggccaaggcgcctgctatggcctgtcggcgcggctgcagggctcgcaggcggaagccgtgcgcgtgccggccgccgacatgaacgccgtgcccgtgcccgacggcgtctcgatggaccaggcgctgatgatgaccgacgccctggccacggcctggttcggggctcgcaacgccgaggtgcggccgggcgccagcgtggcggtgatcggccttggccccatcggcctgatggcggtcgagagcgcctatgtgatgggcgcgcacgtcgtctacgccatcgatcccctgcccgctcgccgagctttggcggaggaggccggcgccatcgccctgcatcccgacgaggccctggcgcgcgtgcgcgaggacaccaaggggcgcggcctggactgcgtgatcgaggcggtcggcggcgaggccacggtggatgcggccctgcgcctggtgcggccgcgcggcgtggtgtcggtgatcggggtgcagcaggccaagcgcttcgcgttcccgctagagcgcgccttcggggcgggcctgaccttccgggtgggaacctgctcggtgcccgaggaactgccggcgctgtttccgctggtgcggtcgggacgcctgcggcccgagaaatacatcagccaccgcctgccgctcagcgacgggcctgaggcctaccgcctgttcgaaagccgcgaggccggcgcgctgaagatggtgctgacgccggggtga

SEQ ID NO: 51384 - protein, 346 aa, Caulobacter crescentus CB15
MKALRYHGARDVRYESMDDPTPQSDRDAIVQVTACSICGSDLHIYHGHGFSEDLGFCVGHEAVGEVVEVGRGVQRLKVGDKVMLPAAVGCGRCRSCLSGVIQTCENGQGACYGLSARLQGSQAEAVRVPAADMNAVPVPDGVSMDQALMMTDALATAWFGARNAEVRPGASVAVIGLGPIGLMAVESAYVMGAHVVYAIDPLPARRALAEEAGAIALHPDEALARVREDTKGRGLDCVIEAVGGEATVDAALRLVRPRGVVSVIGVQQAKRFAFPLERAFGAGLTFRVGTCSVPEELPALFPLVRSGRLRPEKYISHRLPLSDGPEAYRLFESREAGALKMVLTPG

SEQ ID NO: 51385 - DNA, 1020 bp, Sinorhizobium meliloti 1021
  CDS (1)..(1020)
atgcgcgccatcgtgctccacgccccgggcgatatacggcttgaaacgcggccaaagccggtggccggccccggagaggtcctgctgcgcgtcgcatccgtcggcgtgtgtgggtcggatctgccccgcatgctggtcaagggcgcatggaagatgcctctcatcacaggccacgagttttccggccatatccatgcgctcggtgaaaacgtcgaaggctgggaaatcggcgagctgaccgctattgcgccgctgatgccgtgcaatcaatgcatagaatgcaagacaggcaatttttcccgatgccgcgactatgattacttcggtagccgccgcgacggcgcttatgcggaatttgtcgccgtccccgtcgaaaatctcatcaagacaccgcagcacgtcgatcccagggctatcgccatgaccgaccctgcctcgatcgctctccatgccatctggaaggccggcggtataacggccggccagaccggggccgtcgtcgggtgcggcccgatcggtctgttcgcgattcagtggatgcgcatcatggggacctcgagggtgatcgccgtcgatgtcacggaagagaaactcgccttggcgcgtcaggcgggcgccgatctatgcatcctgtctgccgactttgccgacaacaaggaacgagccgatcttgtgatcgaggccgtcggtatcgattcgacaatcaacgctgccgtcatgctggctgcgccgggcggacatgtcacgtttatcgggatacctgtccccgatgtgaagctgtcgaacgcgacgttccagagattcctgcgccaggaagtttcactgcacggctcgtggaacagtttcggtgcgccttttcccggcccgcagtggacgacaaccgtccaaaaattcgcgaccggggaactgaagtgggaattcatgatctcgcatgatctcgaccttgccgagctacctggtatctttcagcgcttcgcggcgaaggacctgcacttctcgaaagtgctgttccgcccctga

SEQ ID NO: 51386 - protein, 339 aa, Sinorhizobium meliloti 1021
MRAIVLHAPGDIRLETRPKPVAGPGEVLLRVASVGVCGSDLPRMLVKGAWKMPLITGHEFSGHIHALGENVEGWEIGELTAIAPLMPCNQCIECKTGNFSRCRDYDYFGSRRDGAYAEFVAVPVENLIKTPQHVDPRAIAMTDPASIALHAIWKAGGITAGQTGAVVGCGPIGLFAIQWMRIMGTSRVIAVDVTEEKLALARQAGADLCILSADFADNKERADLVIEAVGIDSTINAAVMLAAPGGHVTFIGIPVPDVKLSNATFQRFLRQEVSLHGSWNSFGAPFPGPQWTTTVQKFATGELKWEFMISHDLDLAELPGIFQRFAAKDLHFSKVLFRP

SEQ ID NO: 51387 - DNA, 1047 bp, Listeria monocytogenes EGD-e
  CDS (1)..(1047)
atgaaagctttaaaattatatggaaaaagagatttgcgttatgaagaagcggatatgccaacaattgaagagccagatgatgttattttgaaagtgaaaacagttgggatttgtggttcagatatttcgagatacagtaaacttggtccgtatgtaccaggaatggtatggggtcatgaattttcaggggaagttattgaagttggtagtgaggttacagatattgagattggcgatagggctgccggatgcccagcactctattgtggagagtgtgaatactgtaaaaaaggcgaattcgcccgctgtcggaagctaacagtaatcggagcaagacatcccggagcctatgctgagtatatcaaacttccagcagaaaatgtagtgaaaataccaaacgaattagattatgaggctgctgcacttgtcgagccttccgcagtggtcgttcatggattttatcatacgaaattacaagcaggcgatgatgtcgttgttgtcggaagcggaaatatcggtttgctagcaattcaatgggcgaaagtctttggggcaagaagagtgatagcgattgatgtagacgataaaaagctagcacttgcgaaagaagtcggagcagacgtagttattaactctttaaaagaagatcctttagaagtagtcgcagcacatacagatggtctaaacgctgatttagttgtagaagctgcgggatcacctattacatctgcacaagtttttgcctatgcgaaaaaaggtggaggcgtagtgttcctcggaattccatacgccgatgtaacaatcgaacgtttttactttgaaaaaattgttcggagcgagcttactgtatggggttcatggaatgcgatttctgcaccgtttccaggaaaagagtggcaaacaaccattcacttcttagccaataaacaaatcaacattgagccaatgattacacatcgtctttcacttgctgaaggaccagaagtttttgagcgaatctatgaaagaaatgaatttttcgggaaagtattatttttcccagaatga

SEQ ID NO: 51388 - protein, 348 aa, Listeria monocytogenes EGD-e
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPNELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 51389 - DNA, 1047 bp, Listeria innocua Clip11262
  CDS (1)..(1047)
atgaaagctttaaaattatatggaaaaagagatttgcgttatgaagacgcagatatgccaacaatcgaacaacctgatgatgttattttgaaagtaaaaacggttggaatttgcggatcagatatttcgagatacagtaaacttggtccgtatgtaccgggaatggtgtggggacacgaattttcaggagaagtgattgaggttggtagtgcggtaactgatattgaaattggtgatagggctgccggatgcccagcactctattgcggagagtgtgaatactgtaaaaaaggcgaattcgcccgctgtcggaagctaacagtaatcggagcaagacatcccggagcctatgctgagtatatcaaacttccagcagaaaatgtagtaaaaataccagacgaattagattatgaagcggctgcacttgtcgagccttctgcagtggtcgttcatggattttatcatacgaaattacaagctggcgatgatgtcgtcgttgtcggaagcggcaatatcggtttgctagcaattcaatgggcaaaagtttttggcgcaagaagagttattgcgattgatgtagacgataaaaagttagctcttgcgaaagaagtgggagcagacgtagttattaattctttaaaagaagatccattagaagtagtcgcagcacatacagatggtctaaatgctgatttagttgtagaagccgcgggatcacctattacatccgctcaagtttttgcctatgcgaaaaaaggtggaggcgtcgtgttcctaggaattccatatgctgatgtaacaatcgaacgtttctattttgaaaaaattgtgcggagtgagcttacagtttggggttcatggaacgcaatttccgcaccatttccaggaaaagagtggcaaacaaccattcacttcctagctaacaaacaaatcaacattgagccaatgattacacaccgtctttcacttgctgaaggaccagaagtttttgagcgaatctatgaaagaaatgaatttttcgggaaagtactatttttcccagaatga

SEQ ID NO: 51390 - protein, 348 aa, Listeria innocua Clip11262
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 51391 - DNA, 1053 bp, Listeria innocua Clip11262
  CDS (1)..(1053)
atgaaaaaattagttgcgactgcccctcgtgtggcggaattagtagaatatcatgatcgtgaagttgtagaagatgaagtaaaaattaaagtacagttcgcttctccaaaacatggaacagaagtagttgattttagaggaattagtccttttattgatgaagaattttctccagaatggaatttatttgtttcacgtgaaacaaatagtgcgcgaggcattgtgtttggcgagtttcagctaggcaatatggtcgttggtgaagtagtcgaatgtggaagcaaagtgacggaatatgcacttggagacattgtttgttcttatggaccgattatggaaactgttattgtgaaagctgtcgataattataaactacgtaaattgccaaaaggtgctaattggaaaaatgcggtttgctatgatccggctcaatttgcgatgagtggcgtgcgagatgcacatgttcgtgcgggggattacgttgtcgttgtcggacttggcgcgattggccaaattgcgattcaactggcgaaaaaagctggtgctagtgttgttatcggggtggatcctcttagtcatcgtcgtgaaattgctgaaaaacacggagcagatgctacttttgatccgattacgacagatgttggtttagaagtaaaacgtctgactggtaagctgggtgcggattcgattattgaaacaagcgggaatgcggcggcacttcaagcagcacttcgcggaatagcttacggtggaacaatttcttatgtagccttcgcgaaacctttcccagaaggatttaaccttggtcgggaagctcatttcaacaatgcgaaaatcgtcttttcacgtgcggctagtgaaccaaatccggattatccgcgctgggatcgtaagcgtatcgaggaaacgtgttgggaactactgatgaacggttacttggattgtacggacatcattgatccagttgttccattcgctgattctgctgaaagttatatgaaatatgtcgaccaacaacctgatttaagtattaaaatggggattaccctttaa

SEQ ID NO: 51392 - protein, 350 aa, Listeria innocua Clip11262
MKKLVATAPRVAELVEYHDREVVEDEVKIKVQFASPKHGTEVVDFRGISPFIDEEFSPEWNLFVSRETNSARGIVFGEFQLGNMVVGEVVECGSKVTEYALGDIVCSYGPIMETVIVKAVDNYKLRKLPKGANWKNAVCYDPAQFAMSGVRDAHVRAGDYVVVVGLGAIGQIAIQLAKKAGASVVIGVDPLSHRREIAEKHGADATFDPITTDVGLEVKRLTGKLGADSIIETSGNAAALQAALRGIAYGGTISYVAFAKPFPEGFNLGREAHFNNAKIVFSRAASEPNPDYPRWDRKRIEETCWELLMNGYLDCTDIIDPVVPFADSAESYMKYVDQQPDLSIKMGITL

SEQ ID NO: 51393 - DNA, 1044 bp, Caenorhabditis elegans
  CDS (1)..(1044)
atgtctcaagataatttgtctgctgtcctctacggaataaacgatttacgtcttgaacaagctccaatttccaaaccgggaccaagacaagttcttgttaaaattaatactgttggtatttgtggaagtgatgtacactttttgacacacggagcaattggatcatttgttgttaaagaaccgatggttttaggccatgagagttctggagttgtttctgaaattggaagtgaagtgaaagggtttaaagttggtgacagaattgcaatggaaccaggtctcccatgcaaactgtgtgagcactgcaaaattggaagatataatttgtgtcctgatatgcgttttttcgctactccaccagtgaacggagcattatctagatttgttgttcatgatgcagatttttgtttcaagcttccagacaatctctcatttgaagatggagcacttcttgagccattgtctgttgcaattcaagcatgccgccgtggaactgttcaaatgggacaaaaaatacttgttctcggagcaggaccaattggagtcttgaatcttcttactgctaaagcgataggtgcatcaaaagtagtaatcactgatttgaacgacgagagacttgctcttgcacgcctattaggagctgatgctacaatcaatgttatgggaaaacgttcggatgaagtaagatcagagatcatcaaggcatttggcgatcaacaacctcatgtttcaattgagtgcacaggggtccagccgtgtgtcgagacagctatcatgacaacaagatccggaggagttgttgttctagttggattgggtgcagagagagttgagattccattgattcaatcaccgacacgagaagttgatttgagaggaacatttagatcggcgaattgctattcaactgcaattgagctaatttcatctggaaaacttgatctatcgggattaacaagagctcattacaagttggaagaaagccttgaagcatttaagagaacccaaaatggagatgttattaaagtatttattcattgttaa

SEQ ID NO: 51394 - protein, 347 aa, Caenorhabditis elegans
MSQDNLSAVLYGINDLRLEQAPISKPGPRQVLVKINTVGICGSDVHFLTHGAIGSFVVKEPMVLGHESSGVVSEIGSEVKGFKVGDRIAMEPGLPCKLCEHCKIGRYNLCPDMRFFATPPVNGALSRFVVHDADFCFKLPDNLSFEDGALLEPLSVAIQACRRGTVQMGQKILVLGAGPIGVLNLLTAKAIGASKVVITDLNDERLALARLLGADATINVMGKRSDEVRSEIIKAFGDQQPHVSIECTGVQPCVETAIMTTRSGGVVVLVGLGAERVEIPLIQSPTREVDLRGTFRSANCYSTAIELISSGKLDLSGLTRAHYKLEESLEAFKRTQNGDVIKVFIHC

SEQ ID NO: 51395 - DNA, 2142 bp, Ralstonia solanacearum GMI1000
  CDS (1)..(2142)
atgcgacaaattctgcaggatctcggctcgggcacgaccaatatcatggaggccccgtgcgtggcggccagtccgggcacgatcgtttccacgacgcgggccacgctgatctccgccggcaccgaacgcatgctggtggacttcggccgcgcctcgctgctggccaaggcgcggcagcagccggaaaaggtcaagatggtgctcaacaagattgccaccgatggcctgtccaccacgctcagcgcggtccgcgcgaagctgaaccagccgattccgctgggctactgcaacgtcggcacggtgcacgccgtgggggcgggcgtggagggcttcaaggtcggcgaccgggtcgtgtcgaacggctcgcacgccgatgtggtgcgcgtgccccgcaatctctgtgcgcgcattccggacgaggtcgacgacgaatccgccgtcttcaccgtcgtcgcggccatcgggctgcagggcatccgcctggccgaacccacgctgggcgaggccttcgtcgtgaccggcgtgggcctgatcggcctgctggccgtgcaactgctgcgtgcccacggctgccgcgtgctggccatcgatttcgactcggagaagctgaagctggccgcgcagttcggggcggaaacctgcaatccgggcctgcgcgaggatccggtcgcggccgggctggcgttcagccgcgggcggggcgtggacggcgtcatcatcacggcatccaccgcgtcgagcgagccggtgacccaggccgcgcagatgtgccgcaagcgcggccgcatcgtgctggtgggcgtgacggggctggagctgaatcgggcggacttctacgagaaggagctgtcgttccaggtgtcgtgctcgtacgggccgggccgctacgacccgacgtatgaggagcagggccgggactatccgctgggcttcgtgcgctggaccgagcagcgcaatttcgaggcggtgctcgacatgctggccgaccgccgactcgacgtgcgcccgctgatcacgcaccgcattcccttcgacgaggcgccgcgcgcgtatgacctgctgagcagcgacaagtccgcgctgggcatcgtgctggagtacaaggcgccgccaccgagcacgttcgcgcgccggctggcgctgatcgatgcgccgccggtgttcgatgccgcgcagccggtctgcgccttcatcggcgccggcaactatgcctcgcgggtgctgatgccggcgttcaggaaggccggcgcgcagctgcacagcgtggtgacctccggtggcgtgagcggcgtcatccacggcaagccgcagggcttttccgaggcttcgacggatgtcgacgaggtgctgcgcgacccgagcgtcaacctgatcgccgtggccacccgccacagctcgcacgcttccctggtgatcaaggcactgcgcgcgcagaagcatgtgttcgtcgaaaagccattggcgctgacgctggaagaggtcaccgaggtgagatccgcctacacgtcggcgcatgcgaccggccatgccgcgcacctgatggtgggcttcaaccggcgcttcgccccgcaggtggccaagatgaaggcgctgctgtcgcagttgaacgaaccgaagtcgttcatcatgaccatgaatgccggggccattccggcccagcactggacgcaggacctcgccagcggcggcggccgcatcatcggcgaggcctgccacttcatcgatctgatgcgcttcctggcggattcggagatcgtctcggtgcaggcacggcgcatgggcgaccatgaagcggtggcggtgaccgaagacaaggcgagcatcacgctgggcttcgccgacggctcgttcgggaccatccactatttcgcgaacggcagcagtgccttcccgaaggagcgcgtggaggtgttctgcgggggccgcgtgctgcagctggacaacttccgcaagctgcgggggtatggctggccggggttccgcgccatgaacctgtggcggcaggacaaggggcaggatgcctgcgccgcggcattcctgcgcgcgctcgaggggggcgccgcgacgcccattccgtccgccgagatcttcgaggtggcgcgcatcagcgtcctggcagccaagcagctgcgtgaacaatga

SEQ ID NO: 51396 - protein, 713 aa, Ralstonia solanacearum GMI1000
MRQILQDLGSGTTNIMEAPCVAASPGTIVSTTRATLISAGTERMLVDFGRASLLAKARQQPEKVKMVLNKIATDGLSTTLSAVRAKLNQPIPLGYCNVGTVHAVGAGVEGFKVGDRVVSNGSHADVVRVPRNLCARIPDEVDDESAVFTVVAAIGLQGIRLAEPTLGEAFVVTGVGLIGLLAVQLLRAHGCRVLAIDFDSEKLKLAAQFGAETCNPGLREDPVAAGLAFSRGRGVDGVIITASTASSEPVTQAAQMCRKRGRIVLVGVTGLELNRADFYEKELSFQVSCSYGPGRYDPTYEEQGRDYPLGFVRWTEQRNFEAVLDMLADRRLDVRPLITHRIPFDEAPRAYDLLSSDKSALGIVLEYKAPPPSTFARRLALIDAPPVFDAAQPVCAFIGAGNYASRVLMPAFRKAGAQLHSVVTSGGVSGVIHGKPQGFSEASTDVDEVLRDPSVNLIAVATRHSSHASLVIKALRAQKHVFVEKPLALTLEEVTEVRSAYTSAHATGHAAHLMVGFNRRFAPQVAKMKALLSQLNEPKSFIMTMNAGAIPAQHWTQDLASGGGRIIGEACHFIDLMRFLADSEIVSVQARRMGDHEAVAVTEDKASITLGFADGSFGTIHYFANGSSAFPKERVEVFCGGRVLQLDNFRKLRGYGWPGFRAMNLWRQDKGQDACAAAFLRALEGGAATPIPSAEIFEVARISVLAAKQLREQ

SEQ ID NO: 51397 - DNA, 1068 bp, Ralstonia solanacearum GMI1000
  CDS (1)..(1068)
atgccccatgccgtgaagagctacgctgcccattcccccaccggccgcctgggcctgttcgagttcgaccgccgcagcccgcggccggacgacgtcgtcatcgagatcctgtactgcggggtctgccactccgatgtgcacaacgtccgcaacgactggggcagcgcgcggtatccgatggtgcccggccacgaaatcgtgggccgcgtgctggaggtcggcgccgaggtcacgcgcttcaaggccggcgaccctgtcggcgtgggctgcatggtcgagtcgtgccgccactgcaacgcctgcggaaagggctgggaacagtactgcgaaaacggcgccacctacacctacaacggcaccgacccgatcgacggcacgcgcacctacggcggctacagcgagaagatcgtcgttgccgagcatttcgtgctcaagatgccagaggggctggatctggccggcgccgcgccgctgctgtgcgcgggcatcacgacctactcgccgctgcgccactggaatgtgggcgccggcagccaggtggccatcgtcggcctgggcggcctgggccacatggggctgaagctggccaaggccatgggcgccgaggtgacgctgttcagccgctcgcccggcaaggaagccgatgcgcgccgcctgggcgccgaccatatcgtgatctccaccgatgcggcgcagatggccacggtggcggggcgcttcgacctgatcatcgacaccgtcccctaccagcatgacgtcaacccctacgtgccgacgctggccaccggcggcaccatcgtgatggtgggctacctcggcccgctggagcccccgctcaactcggggccgatggtgtaccgccgcaaggccctggccggctcgctgatcggcggcatcgccgagacccaggcgatgctcgacttctgcggcgcgcacggcgtcacgtcggacatcgaagtcatccgcatccaggacatcaacgaggcctacgagcgcatgctcaaggccgacgtgaagtaccgcttcgtgatcgacatggcttcgctgaaggcggcggccgcggcatga

SEQ ID NO: 51398 - protein, 355 aa, Ralstonia solanacearum GMI1000
MPHAVKSYAAHSPTGRLGLFEFDRRSPRPDDVVIEILYCGVCHSDVHNVRNDWGSARYPMVPGHEIVGRVLEVGAEVTRFKAGDPVGVGCMVESCRHCNACGKGWEQYCENGATYTYNGTDPIDGTRTYGGYSEKIVVAEHFVLKMPEGLDLAGAAPLLCAGITTYSPLRHWNVGAGSQVAIVGLGGLGHMGLKLAKAMGAEVTLFSRSPGKEADARRLGADHIVISTDAAQMATVAGRFDLIIDTVPYQHDVNPYVPTLATGGTIVMVGYLGPLEPPLNSGPMVYRRKALAGSLIGGIAETQAMLDFCGAHGVTSDIEVIRIQDINEAYERMLKADVKYRFVIDMASLKAAAAA

SEQ ID NO: 51399 - DNA, 1011 bp, Brucella melitensis 16M
  CDS (1)..(1011)
ttgacaatgatggccgaattgccctccctgatgaccgctatcgaaatcaccgagcccggcggcgcctacatgctgcgcccggcgcagcgcgcggtgccggagccgaaggagggtgaaattctggtgcgggtgcgcgcggccggcgtcaaccggcccgacgtgttgcagcggcagggccaatatgcacccccgccgggggcttccgatattccggggctggaaattgccggtgacatcgtcgcccttgggcatggggtgaagcggttcaggaagggcgatcaggtcgtggcccttttggctggcggtggctatgccgaatatgccgtggtgcatgaaagcaatgcgctgccgctgccatcggggtttggctatatcgaagcggcggcgatcccggaaaccttcttcaccgtctggcataatgttttcgagcgcggggggcttaaggagggagaggtttttctggttcatggcggctcgtccggtatcggcacgactgcgatccagcttgccaaggcttttggtgcgacggtcatcaccaccgcaggatcgaaggaaaaatgcgacgcctgcgtgaagcttggcgcagaccgagccatcaattatcacgaggaggattttgtcgcggttgtgaaagagatgaccggcggcaagggcgtggatgtgattctggacatggtgggtggcgattatgtcgagcgcaattacaaggctgccgccgaggatgggcgcatcatgcagattgctttcctgaacggggccaaggcaacggccaatttcgcgattctgatgaccaagcggctgacccataccggctccacgctgcgcccgcgcccggtggcgttcaaggcgggtatcgccagagaactggaggccaaggtttggccgcttctggcgcagcgccgtgtcgcgcctgtgatggatatgattttttcgctgaaagatgcctggcgggcgcatgagcgcatggaggaggggcgccatatcggcaagatcgtgctggacatagcgtag

SEQ ID NO: 51400 - protein, 336 aa, Brucella melitensis 16M
MTMMAELPSLMTAIEITEPGGAYMLRPAQRAVPEPKEGEILVRVRAAGVNRPDVLQRQGQYAPPPGASDIPGLEIAGDIVALGHGVKRFRKGDQVVALLAGGGYAEYAVVHESNALPLPSGFGYIEAAAIPETFFTVWHNVFERGGLKEGEVFLVHGGSSGIGTTAIQLAKAFGATVITTAGSKEKCDACVKLGADRAINYHEEDFVAVVKEMTGGKGVDVILDMVGGDYVERNYKAAAEDGRIMQIAFLNGAKATANFAILMTKRLTHTGSTLRPRPVAFKAGIARELEAKVWPLLAQRRVAPVMDMIFSLKDAWRAHERMEEGRHIGKIVLDIA

SEQ ID NO: 51401 - DNA, 1038 bp, Corynebacterium glutamicum ATCC 13032
  CDS (1)..(1038)
atgaccactgctgcaccccaagaatttaccgctgctgttgttgaaaaattcggtcatgacgtgaccgtgaaggatattgaccttccaaagccagggccacaccaggcattggtgaaggtactcacctccggcatctgccacaccgacctccacgccttggagggcgattggccagtaaagccggaaccaccattcgtaccaggacacgaaggtgtaggtgaagttgttgagctcggaccaggtgaacacgatgtgaaggtcggcgatattgtcggcaatgcgtggctctggtcagcgtgtggcacctgcgaatactgcatcaccggcagggaaactcagtgcaacgaagctgagtatggtggctacacccaaaatggatccttcggccagtacatgctggtggatacccgttacgccgctcgcatcccagacggcgtggactacctcgaagcagcaccaattctgtgtgcaggcgtgactgtctacaaggcactcaaagtctctgaaacccgcccgggccaattcatggtgatctccggtgtcggcggacttggccacatcgcagtccaatacgcagcggcgatgggcatgcgtgtcattgcggtagatattgccgatgacaagctggaacttgcccgtaagcacggtgcggaatttaccgtgaatgcgcgtaatgaagattcaggcgaagctgtacagaagtacaccaacggtggcgcacacggcgtgcttgtgactgcagttcacgaggcagcattcggccaggcactggatatggctcgacgtgcaggaacaattgtgttcaacggtctgccaccgggagagttcccagcatccgtgttcaacatcgtattcaagggcctgaccatccgtggatccctcgtgggaacccgccaagacttggccgaagcgctcgatttctttgcacgcggactaatcaagccaaccgtgagtgagtgctccctcgatgaggtcaatggtgtgcttgaccgcatgcgaaacggcaagatcgatggtcgtgtggcgattcgtttctaa

SEQ ID NO: 51402 - protein, 345 aa, Corynebacterium glutamicum ATCC 13032
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 51403 - DNA, 1017 bp, Streptococcus pyogenes MGAS8232
  CDS (1)..(1017)
atgaaagccgtagttgttaatcaagctagtacaggtgtcgaagttgttgagcatgatcttccaaatgttggtcatggtgaagcgcttgttaaagtagaatactgtggcgtttgtcatactgatttacacgttgcacatggcgattttggtcaggtaccaggacgtattttggggcacgaaggtattggtatagtagaagaaattggagaaggcgtaacatccttaaaggttggtgatcgtgtctctattgcatggttctttgaaggatgtggtcattgcgaatactgtactacagggcgtgagacactttgtcgtagtgttaaaaatgctggatacagtgttgatggaggaatgagtgaatatgcagtagtaacagctgattatgcagttaaagttccagaaggtttagacccggctcaagcttcttccattacttgtgctggtgtaacaacttataaagctattaaagaggcaggtgttgctccaggccaatggattgttatctttggggcaggtggccttggaaatctggctgttcaatacgctaaaaaagtctttaatgcacatgttgtcgcagtggacattaataatgataaacttgagttagctaaagaagttggcgcagatattttagttaacggcaaagaaattgaagatgttccaggctatattcaagaaaaaatcggtggagcacatggtgttgtggtaacggctgtttctaaagttgcttttaaccaagcaattgatagtgtccgtgccggtggaacagttgtagccgtaggtcttccatcagaatacatggaactgtctatcgtaaaaactgttttagatggtatcaaagtggtcggatcacttgtagggacacgtaaagacttggaagaagcctttgcctttggtgcagaaggtctggttgctccggttgtcgaaaaagttccagttgacactgctccagaagtctttgatgaaatggaacgtggtttaatccaagggcgcaaggtcttagatttcatcagctaa

SEQ ID NO: 51404 - protein, 338 aa, Streptococcus pyogenes MGAS8232
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGVAPGQWIVIFGAGGLGNLAVQYAKKVFNAHVVAVDINNDKLELAKEVGADILVNGKEIEDVPGYIQEKIGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 51405 - DNA, 1053 bp, Thermoanaerobacter tengcongensis MB4
  CDS (1)..(1053)
atgtctattatggatggacttatgaccgccgtggtaaaacaataccacaaagaaggggcagatatagtaaaaaaggaaataccaaagataggccctgatgaagttttgataaaagttaaagctacttctatttgcggcacagacgttcacatatacgtctggaatgaatgggcaaaaagtagaataaaacctccaaaaacgatgggacacgaatttgtaggagaggttgtagaaattggagaaaatgtcacatcagtaaaagtgggagacttagtaagcgcagaaactcatatagtatgcggaaagtgcagagcctgcagaaccggcaacgctcacatatgtgaaaataccctcattttaggcgttgacacagatggagcttttgcagaatacatcaaagttcctgaaagcaatgtgtggataaacgacaaaaacatacctctagagatactatccatacaggaacctcttggaaacgcagtccacactgttttttcaggagacgtagttggaaaatctgtagctgtcataggatgcggcccaataggaatgatggcaataccacttcttaaaagaacaggtgctgcagcaatattcgcgattgaacctgctgactacaggagagagttggctcacaagcttggtgcaacaagggttataaatcctctccgcgaagacgttgtcagcataataaaaagtgaaacagaaggctatggagcagatgtagttttggacttttcaggtaacccaaccgccataaggcagggtctagagtacattgcaaaaggtggcagaatgtctattctaggccttcctgacaatgaagttccaattgacatcacaaataatgtggtattcaaaggaataactatacaaggcataactggaagaagaatgtacgatacctggtacaccgtaaagggcttactaaaatcaggtcttgcagaagatttaaagccaataatcacccacacattccctcttaccgaataccagaagggaatggaactcatgataaaagggcagtgcggtaaagtcgtattatatccgtaa

SEQ ID NO: 51406 - protein, 350 aa, Thermoanaerobacter tengcongensis MB4
MSIMDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 51407 - DNA, 981 bp, Streptomyces coelicolor A3(2)
  CDS (1)..(981)
atgcatgcgatcacgattcccgaacccggaggccccgaggcgctggtgtgggccgaggtccccgacccgcagcccggcgagggcgaggtcctggtggaggtggcggccagcgccgtcaaccgcgccgacatcatgcagcgccagggcttctacgaccccccgcccggcgcctccccgtaccccggcctggagtgctccggccgcgtggccgaggtcggccccggcgtgtccggctggtccgtcggcgacgaggtgtgcgcgctgctcgcgggcggcggctacgccgagaaggtcgtcgtcccggccggccagctgctgccggtgccgcagggtctcgacgtgaagcgggcggcggccctgcccgaggtggtctgcaccgtctggtcgaacgtcttcatggtcgcccacctgcgtcccggcgagacgctgctcgtgcacggcggctccagcggcatcggcaccatggcgatccagctcgccaaggccgtcggcgcgaaggtcgcggtgacggccggcaccaaggaaaagctggagcgctgcgcggagctgggcgcggacatcctgatcaactaccgggagcaggacttcgtcgccgaggtgaaggacgccaccggcggcgcgggcgccgacgtcatcctggacaacatgggcgccaagtacctggaccgcaacgtccaggccctcgccgtgaacggccggctcgcgatcatcggcatgcagggcggccggaagggcgagctgaacatcggcacgctgctcgccaagcgcgccgccgtcagcgccacctcgttgcgggcccgccccctggaggagaaggcggcgatcgtggcggccgtcaaggagcacgtctggccgctgctcgccgggggacacgtccgcccggtcgtcgaccgcgagatgccgatgagcgaggccgccgagggccaccgggtggtggaggagagcgggcacatcggcaaggtgctgctggtcacctcgtag

SEQ ID NO: 51408 - protein, 326 aa, Streptomyces coelicolor A3(2)
MHAITIPEPGGPEALVWAEVPDPQPGEGEVLVEVAASAVNRADIMQRQGFYDPPPGASPYPGLECSGRVAEVGPGVSGWSVGDEVCALLAGGGYAEKVVVPAGQLLPVPQGLDVKRAAALPEVVCTVWSNVFMVAHLRPGETLLVHGGSSGIGTMAIQLAKAVGAKVAVTAGTKEKLERCAELGADILINYREQDFVAEVKDATGGAGADVILDNMGAKYLDRNVQALAVNGRLAIIGMQGGRKGELNIGTLLAKRAAVSATSLRARPLEEKAAIVAAVKEHVWPLLAGGHVRPVVDREMPMSEAAEGHRVVEESGHIGKVLLVTS

SEQ ID NO: 51409 - DNA, 990 bp, Streptomyces coelicolor A3(2)
  CDS (1)..(990)
atgatgcgtgccgtgcagttcgaccggtacggggaccccgacgtgctgtacgtcgccgagcgtcccgtccccgaacccggccccggccaggtgagaatcgccgtcgacgccgtgagcgtcggccacgcgcagacccagatgcggcgcgaggccttccccgcgccgatgtggcggcccgtcttccccgtcgtcctcggcggcgacgtggtcggcaggatcaccgcggtgggaccgggcgtcacggccctgcggccgggagaccgggtcggtgcgttcaccctctacggcgcctacgccgagcaggtcgtcgtcgacgccgtcaccgtcgtacccgtgcccgaggagctggacgccgccgaggccgcggtcctcccgggcaccggactgatcgccctcggcatcctgcggaccggacgactgcgcaagggcgagacggtgctgatccacgcggcggccggcggggtgggccacatcgcggtccagctcgcccgggcggccggcgccggcctgatcatcggcaccgcgggcgcggccgccaaacgcgagttcgcccgcgcgacgggcgccgacgccgtcgtcgaccaccgctccgcacactgggccgacgaggtccgggaactcaccggggggcgtggccccgacctgatcctggacggcatcggcgccgaggtcctggagcagggagtcggtctgctcgctccgggcggccggctggtgttctacggctcgtccggcggcgagctggcgatcccgaaggtgtcggtgatggacctcatcggcatcaagtacgtcaccggcttcgccctgtcggcctggcgcggtggccgcccgcaggagtacgaggcgggcgtcgccgaactcacccgactgctggccgaaggacaggtcacgtccgcggtgcacgcccggctgccgctggagcgggcggccgaggcgcacgccgtcgtcgaggccagggcccagctgggccgggtcgtgctcgtcccctga

SEQ ID NO: 51410 - protein, 329 aa, Streptomyces coelicolor A3(2)
MMRAVQFDRYGDPDVLYVAERPVPEPGPGQVRIAVDAVSVGHAQTQMRREAFPAPMWRPVFPVVLGGDVVGRITAVGPGVTALRPGDRVGAFTLYGAYAEQVVVDAVTVVPVPEELDAAEAAVLPGTGLIALGILRTGRLRKGETVLIHAAAGGVGHIAVQLARAAGAGLIIGTAGAAAKREFARATGADAVVDHRSAHWADEVRELTGGRGPDLILDGIGAEVLEQGVGLLAPGGRLVFYGSSGGELAIPKVSVMDLIGIKYVTGFALSAWRGGRPQEYEAGVAELTRLLAEGQVTSAVHARLPLERAAEAHAVVEARAQLGRVVLVP

SEQ ID NO: 51411 - DNA, 1146 bp, Streptomyces coelicolor A3(2)
  CDS (1)..(1146)
atgtcatccgtgccgtccgtgccgtccgtgccgcccgtgccgcccgtgccgcccgtgccgtccgtaccgtcggtgtcgtccgtgccgcccgcgtcgtccgtggagcgcgtcgtccagttcaccgggccccgccaggtggaggtggccgagcacaccagggccgcactgccacccggccacctgcgggtccgcacccgctactcgggcatctcggccggcaccgagctgaccgcctaccgcggcaccaacccgtacctgacccggacctgggaccccggggcacgcctcttccgcgacggcgcgcccggcatcgagtacccggtggccggctggggctactccgaggtcggagaggtcgtcgaggtctccccggagctggccggcaccccgggcctgccggtccccggcgacctggtgtggggcatctggggccaccgcagcgagggcatcgtccccgccgagcgcatggtcggccacaccctgccggccggtctggaaccgctggccggtgccttcgcccgggtcggcgccatcgcgtacaacgcggtcctggccggtgacatccacctcggcgaggacgtcgccgtgttcgggcagggcgtcatcggcctgctcaccacccggctcgcccggctcagcggcgcccgcgtcaccgccgtggacgccctcgacggccgcctggagaccgcgaagcactacggcgcccggcacaccctcaacgcccgcaccgacgccgtcgccgaacgcgtccgcgaggccaccggcggcctcggcgccgacctcgccatcgagatcagcggcgcctatccggccctgcacgaggcactgcgctcggtcgcggccgggggccgggtggtggcctccggcttctaccagggcgacggcatcggcctgcgcctcggcgacgagttccaccacaaccgggtccagctgatctgctcccagatcggcggcgtcccgccccagctgtcgaaccgctggagtgtcgagcgcctccagcagaccttcctgcgcctggtcgccgagggccaggtggacgtcgactccctggtgagccacgtcgtccccgtcgccgacgcggccgacgcctacgtcctgctggacgagcggcccgccgaggcactgcaggtcgtcctggaattctga

SEQ ID NO: 51412 - protein, 381 aa, Streptomyces coelicolor A3(2)
MSSVPSVPSVPPVPPVPPVPSVPSVSSVPPASSVERVVQFTGPRQVEVAEHTRAALPPGHLRVRTRYSGISAGTELTAYRGTNPYLTRTWDPGARLFRDGAPGIEYPVAGWGYSEVGEVVEVSPELAGTPGLPVPGDLVWGIWGHRSEGIVPAERMVGHTLPAGLEPLAGAFARVGAIAYNAVLAGDIHLGEDVAVFGQGVIGLLTTRLARLSGARVTAVDALDGRLETAKHYGARHTLNARTDAVAERVREATGGLGADLAIEISGAYPALHEALRSVAAGGRVVASGFYQGDGIGLRLGDEFHHNRVQLICSQIGGVPPQLSNRWSVERLQQTFLRLVAEGQVDVDSLVSHVVPVADAADAYVLLDERPAEALQVVLEF

SEQ ID NO: 51413 - DNA, 1017 bp, Streptococcus pyogenes MGAS315
  CDS (1)..(1017)
atgaaagccgtagttgttaatcaagctagtacaggtgtcgaagttgttgagcatgatcttccaaatgttggtcatggtgaagcgcttgttaaagtagaatactgtggtgtttgtcatactgatttacacgttgcacatggcgattttggtcaggtaccaggacgtattttggggcacgaaggtattggtatagtagaagaaattggagaaggcgtaacatccttaaaggttggtgatcgtgtctctattgcatggttctttgaaggatgtggtcattgcgaatactgtactacaggacgtgagacactttgtcgtagtgttaaaaatgctggatacagtgttgatggaggaatgagtgaatatgcagtagtaacagctgattatgcagttaaagttccagaaggtttagacccggctcaagcttcttccattacttgtgctggtgtaacaacttataaagctattaaagaggcaggtgctgctccaggccaatggattgttatctttggggcaggtggccttggaaatctggctgttcaatacgctaaaaaagtctttaatgcacatgttgtcgcagtggacattaataatgataaacttgagttagctaaagaagttggcgcagatattgtagttaacggcaaagaaattgaagatgttccaggctatattcaagaaaaaaccggtggagcacatggtgttgtggtaacggctgtttctaaagttgcttttaaccaagcaattgatagtgtccgtgccggtgggacagttgtagccgtaggtcttccatcagaatacatggaactgtctatcgtaaaaactgttttagatggtatcaaagtggtcggatcacttgtagggacacgtaaagacttggaagaagcctttgcctttggtgcagaaggtctggttgttccggttgtcgaaaaagttccagttgacactgctccagaagtctttgatgaaatggaacgtggtttaatccaagggcgcaaggtcttagatttcatcagctaa

SEQ ID NO: 51414 - protein, 338 aa, Streptococcus pyogenes MGAS315
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 51415 - DNA, 1029 bp, Oceanobacillus iheyensis HTE831
  CDS (1)..(1029)
atgaaagcggtatttgtagaagatgctgagaaaattattgtgaaagatatagaggtccccgagttaaaaccgaatgaggtgcaaatcaaagtaaatgtcgctgggatttgcggttccgatattcatacgtataaaggcttacatccatttcgtaaacccccggtcgttattggacatgaagtagctggagaagttgtagaagttggatcatccgttactaaattcaaggttggtgatcgagtaacggtggagccgcaaatcggtacaggtgagagtgaaggagtaatgacgggaaatgtaaattactctgatacaagactagctccaggaatgggagactggttagggacaatggctgaatatttcgcatcgcctgaagaacaagtaattaaattaccagattccgttagttatgatcaaggtgtattagtcgaacctcttgctgtaggtgtacatgcagcgtttaaaggcgatgttcaaccaaccgatcgagtagcaattttgggagccggaccaattggccttcttacacttatcgctgtgaaagctaaaggcgtaaaagatattgttgttacggatgtgctcgactattcactacaagtggcaaaagaaatgggtgcttcagaagttattaatattaaggataattcaaactggattcatgatgcgaagcagagcttagataaaggatcttttgataaagtatttatcactgcgggtgttcctggtattgtaaatgactctcttaatctactaagaaaaggtggacgagtggttaccgtagccatgttccatggacaacagtctgttgatatcgaacagttacagcaaaatgaaaaagaaattattgggtgcatgacatataaccgtccggatacagaagaagccctagaaataatcgcaagcgggaaacttgatgtagagaaggttatttcccataaattgcattatgaagaagcagcaaagggttttacaattgtagataaaaagaaagataaatccgttaaagtacttgtttcatttgaatag

SEQ ID NO: 51416 - protein, 342 aa, Oceanobacillus iheyensis HTE831
MKAVFVEDAEKIIVKDIEVPELKPNEVQIKVNVAGICGSDIHTYKGLHPFRKPPVVIGHEVAGEVVEVGSSVTKFKVGDRVTVEPQIGTGESEGVMTGNVNYSDTRLAPGMGDWLGTMAEYFASPEEQVIKLPDSVSYDQGVLVEPLAVGVHAAFKGDVQPTDRVAILGAGPIGLLTLIAVKAKGVKDIVVTDVLDYSLQVAKEMGASEVINIKDNSNWIHDAKQSLDKGSFDKVFITAGVPGIVNDSLNLLRKGGRVVTVAMFHGQQSVDIEQLQQNEKEIIGCMTYNRPDTEEALEIIASGKLDVEKVISHKLHYEEAAKGFTIVDKKKDKSVKVLVSFE

SEQ ID NO: 51417 - DNA, 1056 bp, Oceanobacillus iheyensis HTE831
  CDS (1)..(1056)
atgaaggcagcagtttggtatggtaaacacgatattcgtgtagagaataaggaagaacctataattaaacctggaaaggttaaaataaaagtagcatggacaggcatttgtggaagtgacctgcatgcttatcacggcgctgagggagtcgttcaagttggcgaacctcatcctgtaactggtgaaatggcaccattgacgcttgggcatgagttttctggtgtaattcatgaaattggtgaaggtgtaagcggtttatctgttggagatcgtgtagcgattgagccggctattaagtgtggcaagtgtgagaattgtgtacgaggaaactacaacttgtgtgaacacaatggctttgttggcttacaatctgacggtgcttttgctgagtatgcaattgttgatccacatatggttcacaagcttccagataatatatcgtttgaagaagctacagcaattgagcctacagctgtgtctttccacgcgcttaaattaagcaatatgaaagcaggcgatacggtagcggtctttggtgttggcccaattggtcttacggcgattctatgtgcgaaggcagctggtgcgtctcgtatttatgcgattgatgtttccaatgagcgtcttgagatggctcaaaagcttggcgcaactacggttattaatgcgatagaagagaatgcggcagaaaagatatatgctgaaacaggaagtggcgttactatcgcatttgattgtgcaggagctgaagcgactgtgaacagtgcaattgattcacttgctaaaggcggacaacttgtcattgtgtccattattccagaaccgatcaaagtaaatcttttgcaggcgaacttaaaagaaataaacattcttgcaactatcggttacagagatgtgtataaagacgttattgctatggtggaatcaggacagctggatcttaaaccgatcatcactaaaaaaatcggtttggatgatattatcgaagaaggcttccacgcccttacaaatgataagagccaagcaaaaattcttgtgagcccaacaggggtttaa

SEQ ID NO: 51418 - protein, 351 aa, Oceanobacillus iheyensis HTE831
MKAAVWYGKHDIRVENKEEPIIKPGKVKIKVAWTGICGSDLHAYHGAEGVVQVGEPHPVTGEMAPLTLGHEFSGVIHEIGEGVSGLSVGDRVAIEPAIKCGKCENCVRGNYNLCEHNGFVGLQSDGAFAEYAIVDPHMVHKLPDNISFEEATAIEPTAVSFHALKLSNMKAGDTVAVFGVGPIGLTAILCAKAAGASRIYAIDVSNERLEMAQKLGATTVINAIEENAAEKIYAETGSGVTIAFDCAGAEATVNSAIDSLAKGGQLVIVSIIPEPIKVNLLQANLKEINILATIGYRDVYKDVIAMVESGQLDLKPIITKKIGLDDIIEEGFHALTNDKSQAKILVSPTGV

SEQ ID NO: 51419 - DNA, 981 bp, Brucella suis 1330
  CDS (1)..(981)
atgaccgctatcgaaatcaccgagcccggcggcgcctacatgctgcgcccggcgcagcgcgcggtgccggagccgaaggagggtgaaattctggtgcgggtgcgcgcggccggcgtcaaccgacccgacgtgttgcagcggcagggccaatatgcacccccgccgggggcttccgatattccggggctggaaattgccggtgacatcgtcgcccttgggcatggggtgaagcggttcaggaagggcgatcaggtcgtggcccttttggctggcggtggctatgccgaatatgccgtggtgcatgaaagcaatgcgctgccgctgccatcggggtttggctatatcgaagcggcggcgatcccggaaaccttcttcaccgtctggcataatgttttcgagcgcggggggcttaaggagggagaggtttttctggttcatggcggctcgtccggtatcggcacgactgcgatccagcttgccaaggcttttggcgcgacggtcatcaccaccgcaggatcgaaggaaaaatgcgacgcctgcgtgaagcttggcgcagaccgagccatcaattatcacgaggaggattttgtcgcggttgtgaaagagatgaccggcggcaagggcgtggatgtgattctggacatggtgggtggcgattatgtcgagcgcaattacaaggctgccgccgaggatgggcgcatcgtgcagattgctttcctgaacggggccaaggcaacggccaatttcgcgattctgatgaccaagcggctgacccataccggctccacgctgcgcccgcgcccggtggcgttcaaggcgggtatcgccagagaactggaggccaaggtttggccgcttctggcgcagcgccgtgtcgcgcctgtgatggatatgattttttcgctgaaagatgcctggcgggcgcatgagcgcatggaggaggggcgccatatcggcaagatcgtgctggacatagcgtag

SEQ ID NO: 51420 - protein, 326 aa, Brucella suis 1330
MTAIEITEPGGAYMLRPAQRAVPEPKEGEILVRVRAAGVNRPDVLQRQGQYAPPPGASDIPGLEIAGDIVALGHGVKRFRKGDQVVALLAGGGYAEYAVVHESNALPLPSGFGYIEAAAIPETFFTVWHNVFERGGLKEGEVFLVHGGSSGIGTTAIQLAKAFGATVITTAGSKEKCDACVKLGADRAINYHEEDFVAVVKEMTGGKGVDVILDMVGGDYVERNYKAAAEDGRIVQIAFLNGAKATANFAILMTKRLTHTGSTLRPRPVAFKAGIARELEAKVWPLLAQRRVAPVMDMIFSLKDAWRAHERMEEGRHIGKIVLDIA

SEQ ID NO: 51421 - DNA, 1089 bp, Pseudomonas putida KT2440
  CDS (1)..(1089)
atgaatgacctgagccacacccacatgcgcgcggccgtctggcatggccgccacgatattcgtgtcgaacaggtacctttgccggccgaccctgcgccgggctgggtgcagatcaaggtggactggtgcggcatctgcggctccgacctgcacgaatatgttgccggcccggtgttcatcccggtagaggccccgcacccgctgaccggcattcagggccagtgcatcctcggccacgaattctgcggccacatcgccaagcttggcgaaggcgtggaaggctatgccgtaggcgacccggtggcggcagacgcgtgccagcattgtggtacctgctattactgcacccatggcctgtacaacatctgcgaacgcctggcgttcaccggcctgatgaacaacggtgccttcgccgagctggtcaacgtgcccgccaacctgctctaccggctgccgcagggcttccctgccgaagccggggcactgatcgagccgctggcggtgggtatgcacgcggtgaaaaaggccggcagcctgcttgggcaaaccgttgtagtggttggggccggcaccatcggcctgtgcaccatcatgtgcgccaaggctgcaggtgcggcacaggtcatcgcccttgagatgtcctctgcgcgcaaagccaaggccaaggaagcgggcgccaacgtggtgctggaccccagccagtgcgatgccctggcggaaatccgcgcactgactgctgggctgggcgccgatgtgagttttgagtgcatcggcaacaaacatacggccaagctggccatcgacaccatccgcaaagcaggcaagtgcgtgctggtgggtattttcgaagagcccagcgagttcaacttcttcgagctggtgtccaccgagaagcaagtgctgggggcgttggcgtacaacggcgagtttgctgacgtgattgccttcattgctgatggtcggctggatattcgcccgctggtaaccggccggatcggattggagcagattgtcgagctgggcttcgaggaactggtgaacaacaaagaggagaacgtgaagatcatcgtttcaccaggtgtgcgctga

SEQ ID NO: 51422 - protein, 362 aa, Pseudomonas putida KT2440
MNDLSHTHMRAAVWHGRHDIRVEQVPLPADPAPGWVQIKVDWCGICGSDLHEYVAGPVFIPVEAPHPLTGIQGQCILGHEFCGHIAKLGEGVEGYAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEAGANVVLDPSQCDALAEIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 51423 - DNA, 1011 bp, Pseudomonas putida KT2440
  CDS (1)..(1011)
atgaaagctgctgtcgttgcaccaggccgtcgcgtggacgtgatagagaaaagcctgcgccctctcgaacacggcgaagcgctgctgaagatgcagtgctgcggtgtgtgccacaccgacctgcacgtcaaaaatggcgactttggtgacaagaccggggtagtactgggccacgaaggtattggcgtggttcaggaagttggcccgggcgtcacctcgctcaagccaggcgaccgagccagcgttgcctggttctaccagggttgcggacattgcgaatactgcaacagcggcaacgagaccctgtgccgcgacgtgaagaattccggttacaccgtggacggcggcatggccgaggcctgcatcgtcaaggccgactactcggttaaagtgcccgacggcctcgactccgccgccgccagcagcatcacctgcgccggcgtcacgacctacaaggcagtgaaaatctccaacgtccgccccggccaatggatcgccatctacgggctcggcggcctgggcaacctggccctgcaatatgccaagaatgtgttcaacgccaaagtcatcgccatcgacgtcaacgaagagcaactgcgcttcgccagcgagatgggcgcggatctggtcgtcaacccgctcaacgaagatgccgcgaaggtcatccaggccaaaaccggcggtgcacatgctgccgtcgttactgctgtggccaaaggcgcgttcaactcggctgtcgatgccttgcgcgctggcgggcgactggtggccgtcgggcttccgtcggagtccatggacctgaatattccccgcctggtgcttgatgggatcgaagtggtgggctcgctggtaggtacacgccaggacctgcaggaagccttccagtttgccgctgaaggcaaagtggtgcccaaggtaacgctgcgaccgatcgaggatatcaaccagatctttgacgagatgctggagggcaagatcaaaggccggatggtgatacagttcgaaggctga

SEQ ID NO: 51424 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 51425 - DNA, 978 bp, Pseudomonas putida KT2440
  CDS (1)..(978)
atgaaagctgtgttgtgcaaaaccctgggtccggcgcgcaacctggtgctggaagaggtggccagcccactgccgaagaagaacgagatcctgctggacgtgcaagctgccggggtcaacttccccgacaccttgatcatcgaaggcaagtaccagttccagccgccgctgccgttctctccaggtggcgaggcagcgggcgtggtggccgccgtcggcgaaaaggccggcgcgttcaaggtcggcgaccgggtcatggcgctcaccggctggggtgcgttcgccgagcaagtggcggtgccgttctataacgttctgccgatcccggcgagcatggacttcaccaccgctgcggccttcggcatgacctacggcacctcgatgcacgccctgcgccagcgtggccagttgcaagccggcgagaccctgctggtactgggcgcttccggcggggtgggcctggcggcggtggagatcggcaaggccatgggcgcgcgggtgatcgcggcggccagcagtgccgagaaactggccgtggccaaggctgccggggcggatgagctgatcgactacagccaggccaacctgcgcgaagaaatcaaacgcctgaccggtggccagggcgtggacgtgatctatgacccggtcggtggcgagctgttcgaacaagcggtgcgcgggttggcctggaatggcaggctgctggtggtgggttttgccagtggcagcattccacagctggcggccaacctggtgctgctcaagggcgcggcggtactgggcgtgttctggggggcatttgcccagcgccagccggaggacaacgcggccaacttccaccagctgtttgcctggcatgccgagggcaagttgaagccgctggtgtcgcagacttatccactggcagaagccggggttgctatcgagaagctggggcaacggcaggctgtgggtaagttggtggtgctggccaggtaa

SEQ ID NO: 51426 - protein, 325 aa, Pseudomonas putida KT2440
MKAVLCKTLGPARNLVLEEVASPLPKKNEILLDVQAAGVNFPDTLIIEGKYQFQPPLPFSPGGEAAGVVAAVGEKAGAFKVGDRVMALTGWGAFAEQVAVPFYNVLPIPASMDFTTAAAFGMTYGTSMHALRQRGQLQAGETLLVLGASGGVGLAAVEIGKAMGARVIAAASSAEKLAVAKAAGADELIDYSQANLREEIKRLTGGQGVDVIYDPVGGELFEQAVRGLAWNGRLLVVGFASGSIPQLAANLVLLKGAAVLGVFWGAFAQRQPEDNAANFHQLFAWHAEGKLKPLVSQTYPLAEAGVAIEKLGQRQAVGKLVVLAR

SEQ ID NO: 51427 - DNA, 1044 bp, Escherichia coli CFT073
  CDS (1)..(1044)
atgaaaaattcaaaagcaatattgcaggtgccgggcacaatgaaaattatttcagcagaaatacctgtgcctaaagaagatgaagttttgattaaagtggaatatgtcggtatttgtggttcagatgtacatggttttgaatcaggcccgtttattcctcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatttgcccggacgttgattttatggcgacacaacccaactaccgcggcgcattaacgcactatctgtgtcatccggagagctttacttacaaactgccagacaatatggacacgatggaaggggcgctggtggagcctgccgcagtcgggatgcatgccgcgatgctggcagatgttaaacctggtaagaagataattattctgggagcgggttgtattggtttgatgacgttgcaagcgtgcaaatgcctgggagcaacggaaattgccgtcgttgatgtgctggaaaaacgtctgacaatggcggaacagctcggcgcgacagtggttattaacggcgcaaaagaagacactattgcacgctgtcagcaatttaccgaagacatgggcgcagatattgtttttgaaacagcgggttctgcggtcaccgttaaacaggcaccttatctggtcatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcctcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 51428 - protein, 347 aa, Escherichia coli CFT073
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 51429 - DNA, 1053 bp, Staphylococcus epidermidis ATCC 12228
  CDS (1)..(1053)
atgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcatagaaaatgttggtaaagacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacacactgacaacggtgtagatgtgtcatttgaagttgctggtgtaggtattactttacaacaatctattgaagtaacacgtccgcgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagagaatattgttgaaagtggcttcaatcaacttgtaaacgataaatctcaagctaaaattttagtccgtttaaatggcgaccaaaaataa

SEQ ID NO: 51430 - protein, 350 aa, Staphylococcus epidermidis ATCC 12228
MKAAVWYGQKDVRVEDREPKAIKDNEVQVKVSWAGICGTDLHEYLEGPIFISTDQPDPLLGQTAPVTLGHEFSGVIENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELENIVESGFNQLVNDKSQAKILVRLNGDQK

SEQ ID NO: 51431 - DNA, 975 bp, Bradyrhizobium japonicum USDA 110
  CDS (1)..(975)
atgaaagccattctctgcacgcaatattgccagcccgacgatctcgtgctcgccgaggtgccggatgcggtggcaggtcccggcgaggccgtgatcgcgatcaaggcggcggcgctgaacttcttcgacatcctgatgatccagggcaagtaccagatcaagccgccgttcccgttctcgccggccgccgaagtcgcgggcgtgatcgagagcatcggccccggcgtgaccgacctgaaggtcggcgatcgcgtggtcgcctcctgcggccacaacggcgcgcgcgagaagatcgcgctgccggcggcgtcgatcgtgaagatccctgacaatctcgactatgaccgcgcggccggcatcatcatcatctacggcaccgcgctgcatgcgctggaagatcgcgccagccccaagcccggcgagacgcttgccgtgctcggcgcggccggcggcacgggcctcgccgcctgcgagctcggcaagctgatgggcctgaaggtgatcgcctgcgcctcgtcggacgagaagctcgaattcgcgaaagcccatggtgccgagctcacgctgaactacggcaaggaagatttgaaggaaggcctgcgcaagctcaccggcggcaagggcgtcgacatcatcttcgatccggttggcggcgcctatgccgagcaggcactgcgctcgatcgcctgggaaggccgcttcctcgtgatcggctttgccgccggcgacattccgaagatgccgctgaacctcgcgctgctgaaaggctgcgacatccgcggcgtgttctggggcgcctggacccggctcaatcccgccaagaaccgcgccaatctcgagaagctcgtgaagtggaccgcggaaggcaagatctcatcgcacgtcgatcgcaccttcccgctggcacagaccgcggacgcgctgaaggtgctcgcgggacgccaggccatgggcaaggtgatcttgcatccgtga

SEQ ID NO: 51432 - protein, 324 aa, Bradyrhizobium japonicum USDA 110
MKAILCTQYCQPDDLVLAEVPDAVAGPGEAVIAIKAAALNFFDILMIQGKYQIKPPFPFSPAAEVAGVIESIGPGVTDLKVGDRVVASCGHNGAREKIALPAASIVKIPDNLDYDRAAGIIIIYGTALHALEDRASPKPGETLAVLGAAGGTGLAACELGKLMGLKVIACASSDEKLEFAKAHGAELTLNYGKEDLKEGLRKLTGGKGVDIIFDPVGGAYAEQALRSIAWEGRFLVIGFAAGDIPKMPLNLALLKGCDIRGVFWGAWTRLNPAKNRANLEKLVKWTAEGKISSHVDRTFPLAQTADALKVLAGRQAMGKVILHP

SEQ ID NO: 51433 - DNA, 978 bp, Bradyrhizobium japonicum USDA 110
  CDS (1)..(978)
atggtgcgcgctgtcgtctgccgcgagctcggcgcgcccgaaagcttgctgctggaagagtttctctcgcgtgccctgaagccgggcgaggtgcgcgtcgcgatccgcgccgccgggctgaattttcccgacgtgctgatggcggccggggaatatcagctcaagccggagttgccgttcacgcccggcatggaggccgccggcgacgtgaccgaagtgggcgcggagacgaggggcgttgccgtcggcgacaaggtgatcgtgaagatgcgccacggtgctttcaccgatgaagcggtcgtcgcgccgtcgcagctcacgccgatgccgtccaccttcgattacgcggaggctgcgacctatctcgccggtcacggcaccgcctatcacgcactgatcgaccgcggccgcgtcgagcccggagaagtgctgctcgtgcatggcgccggtggcggcgtcggccttgccgccgtcgagatcggcaagatgctgggcgcgaccgtgatcgcgaccgcctccagcgacgagaagcttgcgattgccaaggcacgcggcgccgatcatctcgtgcgttacgaccgcgagccgtttcgcgatgccgtcaagcgcatcaccgacggccgcggcgccgacgtggtgttcgatccggtcggcggcgaggtgttcgagaattcaatgcgctgcatcgcctggggcgcgcggctgctggtgatcggcttcaccggcggcatcggctcggccaagaccaatctcttgctgatcaagggcgccagtgtgctcggcgtgcgcgccggcgaggccgtgcggaaaaatcccacgctcggcgaggtgcgcctgaaggcgctgcttcagtgggcggaggaaggcaagctgcgccccaacgtctcgcaccgcctgccgcttggggattacgcgaaggcgatgcggttgctgatcgaccgcaaggcgatcggtcgcgtggcgctggtgatggagtga

SEQ ID NO: 51434 - protein, 325 aa, Bradyrhizobium japonicum USDA 110
MVRAVVCRELGAPESLLLEEFLSRALKPGEVRVAIRAAGLNFPDVLMAAGEYQLKPELPFTPGMEAAGDVTEVGAETRGVAVGDKVIVKMRHGAFTDEAVVAPSQLTPMPSTFDYAEAATYLAGHGTAYHALIDRGRVEPGEVLLVHGAGGGVGLAAVEIGKMLGATVIATASSDEKLAIAKARGADHLVRYDREPFRDAVKRITDGRGADVVFDPVGGEVFENSMRCIAWGARLLVIGFTGGIGSAKTNLLLIKGASVLGVRAGEAVRKNPTLGEVRLKALLQWAEEGKLRPNVSHRLPLGDYAKAMRLLIDRKAIGRVALVME

SEQ ID NO: 51435 - DNA, 1026 bp, Bradyrhizobium japonicum USDA 110
  CDS (1)..(1026)
atgccgaccatgaaagccgcaatcgtcagacaattcggcaagccgctcgtgatcgaggacgtgccggtgccgcagcccggacccggcgaggttctggtcaaggtcaaggcgtgcggcgtctgccataccgatttgcacgcagcctccggcgactggccggtgaagccggttccgcctttcatcccgggccatgaggttgccggcatcgtcgccgcgctcggatccggcgtgaagaatctgaaggtgggcgatgccgtcggcgtcgcctggctgcacgatgcctgcatgtcctgtgaatattgcgagaccggctgggagacgctgtgcgagcaccagcacaacactggctacagtgtgaacggcggcttcgccgaatatgtcatcgcctcggctgccttcgccgccaaactgccggcgacgatcgattttgcgggcatcgcgccgatcctgtgcgcgggcgtcaccacctacaagggcttgaaggagacggaggcaaagcccggcgagtgggtcgtgatctcgggcgtcggcgggctcggccatgtcgcgatccagtatgccaaggcgatgggcctcaaggtcgcggccgtcgatatcgccgacgacaagctcgagctcgcgcgcgagaccggcgccgacctcgccgtcaacgcgctcgcggccgatgccgtggacaaggtgttggcggtaaccgggggaggggcgcacggcgtgctggtgacggcggtctcgaccgccgcgttcgcccaggcgctgaagatggtgcgccggaagggcaccgtcagcctcgtcggtctgccgccgggcgaattcccgacgccgatcttcgacgtcgtgctcaagcgcatcaccgtgcgcggctccatcgtcggcacccgccgcgatctcgacgaagccatcgcattcgccgccgacggcaaggtcaaggccgaggtgacaaaggtgccgctcgctgagatcaacgacgtcttcgaccggatgaaggccggcaagatcgaaggccgcatggtgctggactttggctag

SEQ ID NO: 51436 - protein, 341 aa, Bradyrhizobium japonicum USDA 110
MPTMKAAIVRQFGKPLVIEDVPVPQPGPGEVLVKVKACGVCHTDLHAASGDWPVKPVPPFIPGHEVAGIVAALGSGVKNLKVGDAVGVAWLHDACMSCEYCETGWETLCEHQHNTGYSVNGGFAEYVIASAAFAAKLPATIDFAGIAPILCAGVTTYKGLKETEAKPGEWVVISGVGGLGHVAIQYAKAMGLKVAAVDIADDKLELARETGADLAVNALAADAVDKVLAVTGGGAHGVLVTAVSTAAFAQALKMVRRKGTVSLVGLPPGEFPTPIFDVVLKRITVRGSIVGTRRDLDEAIAFAADGKVKAEVTKVPLAEINDVFDRMKAGKIEGRMVLDFG

SEQ ID NO: 51437 - DNA, 1044 bp, Bradyrhizobium japonicum USDA 110
  CDS (1)..(1044)
atggatatcaagaccgcgaaggctgcgattctcgtcgagtcgggcaagccgctgatcgtcgacgagttcaccttgccggatacgctcgaacacggccaggtgctcgcgcacgtgcacacgtcgagcatctgcggcgcacagatcaacgagatcgacgccgtcaagggcgccgacaagttcctgccgcacctcttggggcacgaagcgctggcgaccatcgtcgaaaccgggcccggcgtcgtctcgtgcaagcagggcgacaccgtcgtcatgcattggcggccgggcaagggcatccagtccaatacgccggtctattcctggcacggcaagcgactcaacgcgggctgggtcaccaccttcaacgaatatgccgtggtgtcggaaaatcgcgtcacgcccgttcccccctcgatcgatcgcagcagcgcgccgctgctcggctgcgcggtgacgaccgccctcggcgtcgtcaacaacgacgcgcaggtcgcgatcggcgaggccgtcctcgtgttcggcgtcggcggcgtcgggctgaacatcgtgcaatttgccgcgatggtcggcgcccatccggtcgttgcgatcgaccgcctcgacaacaagttggagatggcgaggcagttcggcgccacccacaccatcaactccgacgcggtaaaggatctggccgccgaggttcggtccatcacggggcctgacgggcccgacaaggtcgtcgagaccaccggcgtcagccgtttgatcgagctcgcctacgaggtcaccgcgaagaagggccgctgtatccttgtcggtgttccccgcgacaaggtcgagatctacacgctgccgctgcacttcgagaaggtgctgaagggttcggaaggcgggcagtgccagccggcgcgcgacatcccgcgtctcgtccggctcgacgaagccggcaaggtcagttaccgcgggatcgtgacccacgagttcgcgctcgatgacatcaacgacgcgctggatttgatgcgcagcggcacgtcagggcggatcttgctaaacatcagctga

SEQ ID NO: 51438 - protein, 347 aa, Bradyrhizobium japonicum USDA 110
MDIKTAKAAILVESGKPLIVDEFTLPDTLEHGQVLAHVHTSSICGAQINEIDAVKGADKFLPHLLGHEALATIVETGPGVVSCKQGDTVVMHWRPGKGIQSNTPVYSWHGKRLNAGWVTTFNEYAVVSENRVTPVPPSIDRSSAPLLGCAVTTALGVVNNDAQVAIGEAVLVFGVGGVGLNIVQFAAMVGAHPVVAIDRLDNKLEMARQFGATHTINSDAVKDLAAEVRSITGPDGPDKVVETTGVSRLIELAYEVTAKKGRCILVGVPRDKVEIYTLPLHFEKVLKGSEGGQCQPARDIPRLVRLDEAGKVSYRGIVTHEFALDDINDALDLMRSGTSGRILLNIS

SEQ ID NO: 51439 - DNA, 978 bp, Lactobacillus plantarum WCFS1
  CDS (1)..(978)
atgcaagcacttgttgtgccagatccatccgctcaaactatggaacagcttcaatggcaagaacggcccatgcccaacctcgggccaactgaggtgttgatcaagacccaagcagtcgggctcaatccggtagattttaaattagttgcggcgggtaacgccgcctggcaatatccacacacactaggactagacacagctggaatcgtggaggcggttggcgctgaggtcactaattttcggcctggcgaacgagtttgtgggcacgctaatctcgccaataatgggacgtttgccgaatacgtgagtttaccagcagccgtgctagctaagattccaacgactgtgagctttgaagcagccgccgctagtctctgcgctggattgacggcttatcaggccctcctgcgcaaagccaatttaaatgccgcgcaaactgtgctgatccatgcaggtgcgggcggtgtaggcagtatggctattcaactcgctaaggctgctggcaagaccgtcttcacgaccgtttcaaaggccaagcaagccttcgtggcaccgctgcatcccgatgcccaaatcgattaccatcatgaagatgtgaccacacgcattcaagacctaacgcagcagcacggtgttgatctgatcattaataccattggtcatgctgatgcggacttaccgcgcttagcttacaatggccagcttgtctgtgtattagcaactccggaccactttccaagtaatcaagtggtaactatcagtaaattggacctcggtggtgcccaccgtagcggtaacccagcgcaagttgccgatcttgggcaaatgaccgccgccttattagctttggtccaagctggcaaggtcgacccactaattactcaggtcttgcaccgtgaccaacttgtaactggtttacaacaactccaagctggtcaagtcgttggtaaactcgtcgtgacttttgacgcctgttga

SEQ ID NO: 51440 - protein, 325 aa, Lactobacillus plantarum WCFS1
MQALVVPDPSAQTMEQLQWQERPMPNLGPTEVLIKTQAVGLNPVDFKLVAAGNAAWQYPHTLGLDTAGIVEAVGAEVTNFRPGERVCGHANLANNGTFAEYVSLPAAVLAKIPTTVSFEAAAASLCAGLTAYQALLRKANLNAAQTVLIHAGAGGVGSMAIQLAKAAGKTVFTTVSKAKQAFVAPLHPDAQIDYHHEDVTTRIQDLTQQHGVDLIINTIGHADADLPRLAYNGQLVCVLATPDHFPSNQVVTISKLDLGGAHRSGNPAQVADLGQMTAALLALVQAGKVDPLITQVLHRDQLVTGLQQLQAGQVVGKLVVTFDAC

SEQ ID NO: 51441 - DNA, 1059 bp, Lactobacillus plantarum WCFS1
  CDS (1)..(1059)
atggaggctgtcgttaagacggaatctggttacgacaatatggaactgaagcaaattccaatccctgaagtaacaggagacaaagttttattaaaagtggcctacactgggatctgcggtactgatattcatacatttaagggtcagtatgccaatgcggtgacaccacttgttttgggccatgaattttcaggtgaagttgttgaagtgggaccagatgttaaaacgctaaagcctggcgaccgggtgactagtgaaacgacttttgcaacggatggcacatgtgtttactgccaagataaagaatataatttatgtcctaaccgtgtaggaatcggaactaaagctaatggttcaatggcaaattatgttctaactcgtgaggaaagtgctcacattttaccggataacgtttcctacaagatggctgcaatgtcggaacctttagcatcttgtgttcatgctatgtatcaaaagacaccattcacgttacacgacactttattaattatgggaccaggaccaatggggctactctcattgcagattgccaaagaaattggtgcctttgttattgtttctgggatcactaaggatgctgatcgtttacaaattgctaaagagttaggtgctgacattattgtagatacccaaaaagaagacttggccaaggtcgtgatggatgcgacagatggcgttggcgttaccaaggtttatgactgttcaggtgcaacgccagcggttaactctgcattaccattgatccgtaagggtggaactttccaacaggttggtctttttgcaaagccgatgaatgaattagatgaacgttcaattattcagcatgaaattacgtatcgtggctcacggtcacaaaatccgtatgattgggcgattgctttacatcttgaaagcaagggtgctattaaccaagatgcaatgattacgaaggtctttgatcttgaacactggcgtgacgcttttgatgcaatgatggccggtaaagagctcaaagttatgattgcctctaatcctgatgatccagatttagcagactaa

SEQ ID NO: 51442 - protein, 352 aa, Lactobacillus plantarum WCFS1
MEAVVKTESGYDNMELKQIPIPEVTGDKVLLKVAYTGICGTDIHTFKGQYANAVTPLVLGHEFSGEVVEVGPDVKTLKPGDRVTSETTFATDGTCVYCQDKEYNLCPNRVGIGTKANGSMANYVLTREESAHILPDNVSYKMAAMSEPLASCVHAMYQKTPFTLHDTLLIMGPGPMGLLSLQIAKEIGAFVIVSGITKDADRLQIAKELGADIIVDTQKEDLAKVVMDATDGVGVTKVYDCSGATPAVNSALPLIRKGGTFQQVGLFAKPMNELDERSIIQHEITYRGSRSQNPYDWAIALHLESKGAINQDAMITKVFDLEHWRDAFDAMMAGKELKVMIASNPDDPDLAD

SEQ ID NO: 51443 - DNA, 1026 bp, Salmonella enterica subsp. enterica serovar Typhi Ty2
  CDS (1)..(1026)
atgaaagtcaaagctgtgttcattaataagcctggtgaagttgaaacccgctgggtggattatccccataagaaagaaaatgaagtattaattaaggttgatgccgcaggcatttgcggatcggatatcggggcttttcgtggaacgaacccacttgttacttacccaagaattattgggcatgaagtgaccggaattgttcttcaggaaggcaccggaatgccggacaatattaaaaaaggcgaccgcgtgattgttgacccctatatttattgtggtcactgctacccttgctctgtcggcagaactaattgttgtgaaaatttaaatgtcattggcgtgcatatcgatggcgcaatgcaggaggtggttactcatcccgcacatttaattcataaaataccagataatgtgccttctgaaatggcgccgctggcagaaccgctgaccatcgctctacacgcgctgcatcgggcaaacgttaaggccggggaatatgttgccatcatcggcgcgggggccattggtcttatggcggcattaagcgcgcgtcattacaaggcaacgcctattctgatcgatattgtggaagaaaggctacgctatgcgcaaaagcttggcgttccttatgtactgaacgccgctgacgatcaggttatcgacgctattaaaaatatcacccacggcaccatggcgcaggtcgtgatagaagcctccggcgcaaatagcgctattcgaaatacgcttgatttagcatcgtttgctggtcgtatttcgtttaccggatggccaaaacaggaaacgtcgctgccgacgaacctgatcacctacaaagaactggatttacgcggctcccgcaccagtgccggtgaatttgatgaggcattacgcatgctgtcaacgctggagattaatccgcaagatgttgtcagtaaggtcgtcaatcttgatgagatccctgatgcagttaaagaacttgatcgctatccggagcgttacttaaagattaatgctgttttccattga

SEQ ID NO: 51444 - protein, 341 aa, Salmonella enterica subsp. enterica serovar Typhi Ty2
MKVKAVFINKPGEVETRWVDYPHKKENEVLIKVDAAGICGSDIGAFRGTNPLVTYPRIIGHEVTGIVLQEGTGMPDNIKKGDRVIVDPYIYCGHCYPCSVGRTNCCENLNVIGVHIDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 51445 - DNA, 1017 bp, Bacteroides thetaiotaomicron VPI-5482
  CDS (1)..(1017)
atgaaagcagttcaaattgtcaacccctccgaaatgaaggtggttgaactggaaaaaccgaccgtcggtgccggtgaagtattggtaagaatcaagtatgtcggattctgtggctccgatttaaacactttcctggggcgtaacccgatggtgaaactccctgtaataccggggcatgaagtaggagcagtgattgaagagatcggtccggatgttccggctggctttgagaaagggatgaatgtaacattgaacccatataccaattgtggtaaatgtgcttcgtgccgtaacgggcgtgtcaatgcctgcgagcataatgagacattaggcgtacaacggaatggagtgatgtgcgaatacgccgtgcttccttggacgaagattatcccggcaggtaatatctcatcccgtgactgtgctctgattgagccgatgagtgtaggatttcatgctgtttcccgtgctcaggtcatcgataatgagtatgtgatggtgattggctgtggtatgattgggattggcgctattgtacgtgctgccttgagaggagcgacggtgattgcggtcgatctggatgatgaaaaactggtactggccaaaagagtgggagcgtcttacgcagtaaactctaaaacagagaatgtacatgagcggatacaggaaatcaccgcagggtttggagctgatgtcgtgattgaagctgtcggcagtcctgtgacttatgtaatggctgtggatgaagttggctttaccggtcgtgtggtttgtattggctacgccaaaaaagaagtcgcttttcagaccaagtatttcgtccagaaagaactggatattcgtggttccagaaatgcattgcctgctgatttccgtgcggtaatcaactatatgaaagaaggtaagtgtccggtagaagaactgatctcaaagattgcaaaaccggaagatgctttggaggcaatgaaagaatgggcagctgatccgggaaaggtattccgtatcttggtagaaatgtag

SEQ ID NO: 51446 - protein, 338 aa, Bacteroides thetaiotaomicron VPI-5482
MKAVQIVNPSEMKVVELEKPTVGAGEVLVRIKYVGFCGSDLNTFLGRNPMVKLPVIPGHEVGAVIEEIGPDVPAGFEKGMNVTLNPYTNCGKCASCRNGRVNACEHNETLGVQRNGVMCEYAVLPWTKIIPAGNISSRDCALIEPMSVGFHAVSRAQVIDNEYVMVIGCGMIGIGAIVRAALRGATVIAVDLDDEKLVLAKRVGASYAVNSKTENVHERIQEITAGFGADVVIEAVGSPVTYVMAVDEVGFTGRVVCIGYAKKEVAFQTKYFVQKELDIRGSRNALPADFRAVINYMKEGKCPVEELISKIAKPEDALEAMKEWAADPGKVFRILVEM

SEQ ID NO: 51447 - DNA, 1029 bp, Coxiella burnetii RSA 493
  CDS (1)..(1029)
atgaaagtactttccaaactaaaaccagcccctggcctctggctccacaaggcaccaacgcctaaacccggccgggacgaagtattaattaaaattaaaaaaaccgccatttgcggcacggatttgcatatttataaatgggatgaatgggcgcaaaaaaccattcctgtccccatgcacgtcggccatgaatttgttggtgaaatcgtggaggtaggcgaggccgctagcgcgttggcggttggagatcgggtttcaggggaaggacacatcacgtgcggggattgtcgtaattgtcgcgccggtaagcgccatttgtgtcgctacaccgtaggcgttggcgtaaatcgtcccggcgcgtttgcggaatatttagttatccccgctaaaaatgcgtataaaattccggcaaaaattagcgatgatatcgctgccattttagatcctttcggcaacgccgcacattccgcgttggagtttgatttagtgggcgaagatgtattaattaccggcgcaggccccgtcggattgatgtcagcagccattgcgcggcacgtcggggcgcggcatgtagtgataacggatgtcaatgattaccgtttagctttagccgaaaaagtgggcgtaaccgctgccgttaactcgacaaaaactcccttaacggagacgatgaaaaatcttgggatgacagagggttttgatgtcggtcttgaaatgtcaggaaacgctgaggcttttcgcagcatgttaacggtaatgaataacggcgggaaaatcgcctttttgggtatcccaccggaaccgtttgcgattgattggaatcaagtcgttttcaaaagcttattgataaaagggatttatggacgccgcatgtttgagacgtggtataaaatgactaatttattactaagcgggttagacatttcacccatcatcacgcatgagtttccgatgaaggattttcaacaagcatttgatgtaatgctgtcgggtaaaacaggcaaagtgattttgaattgggagcaatga

SEQ ID NO: 51448 - protein, 342 aa, Coxiella burnetii RSA 493
MKVLSKLKPAPGLWLHKAPTPKPGRDEVLIKIKKTAICGTDLHIYKWDEWAQKTIPVPMHVGHEFVGEIVEVGEAASALAVGDRVSGEGHITCGDCRNCRAGKRHLCRYTVGVGVNRPGAFAEYLVIPAKNAYKIPAKISDDIAAILDPFGNAAHSALEFDLVGEDVLITGAGPVGLMSAAIARHVGARHVVITDVNDYRLALAEKVGVTAAVNSTKTPLTETMKNLGMTEGFDVGLEMSGNAEAFRSMLTVMNNGGKIAFLGIPPEPFAIDWNQVVFKSLLIKGIYGRRMFETWYKMTNLLLSGLDISPIITHEFPMKDFQQAFDVMLSGKTGKVILNWEQ

SEQ ID NO: 51449 - DNA, 1071 bp, Streptomyces avermitilis MA-4680
  CDS (1)..(1071)
atgaaagcactcgttttccacggatccggagagtcagtctgggaggacgtggcggaccccggtatccaggacgccggcgacgcgatcgtccgtgtcgacaccgtcaccatctgcgggacggacctgcacattctcaagggggatctcccggaggtacgccccggcaccgtgctcggtcacgaggccgtcggtgagatcgtcgaaacgggcggcgacgtacgcacggtccgccccggcgaccgtgtcctcgtctcgtgcatcacggcgtgcggccgctgccgcttctgccgcgagtcggcgtacgggcagtgccgcggcggcggaggctggatcctcggccacctgatcaacggcacgcaggccgaatacgtccgcgtgccccacgccgatctgtccgtgcatccgctgcccggggcgatggacagcaaggacgccgttctgctggccgacatcctccccaccgcctacgaggtgggcgtgctcaatgggcgggtacggcccggagacaccgtcgtcgtggtcggtgcgggccccgtcggtctcgccgccgtcgccacgtcccgcctctacacacccgagaagatcatcgcggtggacctcgccccggcccggctggacgcggccaaacgcctcggcgcggacgcggtggccgtcgcgggcgaggaagccgagccactggtcgccgacctcaccctggggctcggggccgacgtcgtcatcgaagcggtcggggtgcccgagaccttcgagatgtgcacgcgcatggtgcggccgggcgggcacgtggccaacgtcggcgtgcacggcaggcccgcggtgctgcacctcgaagacctgtggatcaagaacgtgacgatcaccaccggactggtcgacacgcgctccactccgaccctgctgcgcatgatggccgccggccacctgcccgcgtcgtccatggtcacccacaccttcccgctggacgccatggaggaggcgtacgacgtcttctcgagggccgccgataccggcgcgctcaaggtcgtcctcggtgagcagcagcacgacgtcctgatggtcagggcggcctga

SEQ ID NO: 51450 - protein, 356 aa, Streptomyces avermitilis MA-4680
MKALVFHGSGESVWEDVADPGIQDAGDAIVRVDTVTICGTDLHILKGDLPEVRPGTVLGHEAVGEIVETGGDVRTVRPGDRVLVSCITACGRCRFCRESAYGQCRGGGGWILGHLINGTQAEYVRVPHADLSVHPLPGAMDSKDAVLLADILPTAYEVGVLNGRVRPGDTVVVVGAGPVGLAAVATSRLYTPEKIIAVDLAPARLDAAKRLGADAVAVAGEEAEPLVADLTLGLGADVVIEAVGVPETFEMCTRMVRPGGHVANVGVHGRPAVLHLEDLWIKNVTITTGLVDTRSTPTLLRMMAAGHLPASSMVTHTFPLDAMEEAYDVFSRAADTGALKVVLGEQQHDVLMVRAA

SEQ ID NO: 51451 - DNA, 1029 bp, Streptomyces avermitilis MA-4680
  CDS (1)..(1029)
atgaaggcgctggtcaaggagaaggcggagcccgggctctggctcatggacgtcccggagcccgagatcgggcccggcgacgtactgatcaaggtcctcaggaccgggatctgcggcaccgacctgcacatccggtcctgggacggctgggcgcagcaagccgtccgtaccccgctcgtgctcggtcacgagttcgtcggtgaggtcgtcgagaccggccgcgacgtcgtcgacatcaaggccggtgaccgggtcagcggcgagggccacctggtctgcggcaagtgccgcaactgccaggccggacgccgtcatctgtgccgtgcgacggtcgggctcggcgtcggccgggacggggcgttcgccgagtacgtggccctgcccgcggccaacgtctgggtgcaccgcgttcccgtcgacctcgacgtggccgcgatcttcgacccgttcggcaacgccgtgcacacggccctgtccttcccgctggtcggcgaggacgtgctcatcaccggggcgggcccgatcggcctgatggcggccgccgtggcccgtcacgccggcgcccgcaacgtcatgatcaccgacgtcagcgaggagcgcctggaactcgcccgcaagatcggcgtgagcctcgccctgaacgtcgccgacacgaccatcgccgacggccagcgcgcgctcggcctgcgcgagggcttcgacatcggtctggagatgtccggccgccccgaggccatgcgcgacatgatcgccaacatgacgcacggcggccgcatcgccatgctcggtctgccgtcccaggagttccccgtcgactgggcccggatcgtcacctccatgatcacgatcaagggcatctacggccgcgagatgttcgagacctggtacgcgatgtccgtcctcctcgaaggcggcctcgacctcgctcccgtgatcaccggccggtacggctaccgcgactacgaggcggcgttcgccgacgcggcgagcggccgcggcggcaaggtcatcctcgactggaccctctga

SEQ ID NO: 51452 - protein, 342 aa, Streptomyces avermitilis MA-4680
MKALVKEKAEPGLWLMDVPEPEIGPGDVLIKVLRTGICGTDLHIRSWDGWAQQAVRTPLVLGHEFVGEVVETGRDVVDIKAGDRVSGEGHLVCGKCRNCQAGRRHLCRATVGLGVGRDGAFAEYVALPAANVWVHRVPVDLDVAAIFDPFGNAVHTALSFPLVGEDVLITGAGPIGLMAAAVARHAGARNVMITDVSEERLELARKIGVSLALNVADTTIADGQRALGLREGFDIGLEMSGRPEAMRDMIANMTHGGRIAMLGLPSQEFPVDWARIVTSMITIKGIYGREMFETWYAMSVLLEGGLDLAPVITGRYGYRDYEAAFADAASGRGGKVILDWTL

SEQ ID NO: 51453 - DNA, 1041 bp, Rhodopirellula baltica SH 1
  CDS (1)..(1041)
atgaaggcattgttgctgaccgaatacaaaaacatgcaggtgacggatgtggatgagcccgaggtgggcccagatgacgttttggtccaagtcgaagcgtgtgggatctgcggcagtgacattcatggatacgatggcagcaccgggcgtcgtatcccgcctttggtgatggggcacgaggctgccggggtggtggttcaggtcggcgaaaacgtccgcgatttggaactcggagcccgcgtcacgtttgattcgatggtgtcctgcggaaactgtgagttttgtcgcgaagggcacgggaacctttgtgacaaccgaatggttctcggcgtttcctgtggtgattaccgacgtcatggtgcgttcgcggaacgcatctcggttccgcgtcggatagtctatcgattacccgacactttgcccttcgaacacgcagctttggtcgaagcggtcagcgtcgcggtccatgcagcggaagtcactccgatcaagctaggtgataccgccgttgtggttggtgctggcatgatcggattgttggctgtgcaagccgtgcgagcagcgggtgcgacgcaggtcatcgcggtggatctaaacgacaaacgcctggaaacagccggaacgttgggagccgacgtgttgttgcgagccgatcaagtggacgtgccggaaaaggttcgcgaactgaccggtggccgcggggcagacgtggcattggaagtcgtcggtgcgacgccgacggtcaaaacagcgattgaatccgttcgcaagggtggagcggtcacgttggtcggcaacgtctcgccgacgatcgaattgcctttgcagtcagtcgttacgcgagaaattcgattgcagggcacatgtggttgcaacggtgaatacccacagtgcatcgatttgatgaatcgcggcgtcatcaacgttgaacctttgatcacggccaaaatttctttggcggacggtcccaaatggtttgaccgcctgcacgccggtgatgcggagcaaatgaaggtgttggtttgtcctcgttcggagtga

SEQ ID NO: 51454 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 51455 - DNA, 1005 bp, Bordetella pertussis Tohama I
  CDS (1)..(1005)
atgaaggcagtcgtgtgcagggagtatggcggcccggacgtcgccgcgtacgaagaggtgccggcgccggcgctcgcgccgggcgcggtgcgcatccaggtgcaggcgtgcagcgccagcttcgccagcctgctggtgatggagggcaagcaccagaaccgcgcgccgctgcccctgataccgggcaccgaggtcgccggcgtggtcaccgaactcggcgcgggcgccacgcgctttcgcgtcggcgaccgggtgatcgccggcgtgcaatccggctgctacgcccaggaagtggtggcccccgaggccacggtgttcgagctgcccgccgacgtgccgttcgagaccggcgcccagttccccaccatctacggcacggcctacggggccctgcaatggcgcgcccaggtcgagcccggcgaggtcgtgctggtgcatggggcggccggcggcagcgggctggccgcggtggaagtggccaaggcgctgggcgccaccgtcatctccacggtgggctcggacgccaagcaggccatcgtgcgcgagcatggcgccgaccacgccatcaactaccgcacgcaggactggcgcgccgaagtgctgcgcctgacgggacagcgcggcgccgacgtcatctacgacccggtcggcggcgagaccttcgacgcctcgctgcggtgcatcgcgccggacggacgcatcatcccgatggggttcgccagcggcgccatcccgaccgtgccggccaacatcgtgctggtgaagaacatcagcatcctgggcgtgtattggggctactacttcggctggggacgccacccggtcaggcccggcaacgacgcccggttgcgggccgcctacgcccggctcttcgaatggacccgccagggcaggatccggccgcgcgcgcacgcggtcgtgcccctggcggacttccgcaccgcactgcgcatgatcgcctcccgcgaagcgatcggcaggatcgtcatgcaaccgcagcaatag

SEQ ID NO: 51456 - protein, 334 aa, Bordetella pertussis Tohama I
MKAVVCREYGGPDVAAYEEVPAPALAPGAVRIQVQACSASFASLLVMEGKHQNRAPLPLIPGTEVAGVVTELGAGATRFRVGDRVIAGVQSGCYAQEVVAPEATVFELPADVPFETGAQFPTIYGTAYGALQWRAQVEPGEVVLVHGAAGGSGLAAVEVAKALGATVISTVGSDAKQAIVREHGADHAINYRTQDWRAEVLRLTGQRGADVIYDPVGGETFDASLRCIAPDGRIIPMGFASGAIPTVPANIVLVKNISILGVYWGYYFGWGRHPVRPGNDARLRAAYARLFEWTRQGRIRPRAHAVVPLADFRTALRMIASREAIGRIVMQPQQ

SEQ ID NO: 51457 - DNA, 1005 bp, Bordetella bronchiseptica RB50
  CDS (1)..(1005)
atgaaggcagtcgtgtgcagggagtatggcggcccggacgtcgccgcgtacgaagaggtgccggcgccggcgctcgcgccgggcgcggtgcgcatccaggtgcaggcgtgcagcgccagcttcgccagcctgctggtgatggagggcaagcaccagaaccgcgcgccgctgcccctgataccgggcaccgaggtcgccggcgtggtcaccgaactcggcgcgggcgccacgcgctttcgcgtcggcgaccgggtgatcgccggcgtgcaatccggcggctacgcccaggaagtggtggcccccgaggccacggtcttcgagctgcccgccgacgtgccgttcgagaccggcgcccagttccccaccatctacggcacggcctacggggccctgcaatggcgcgcccaggtcgagcccggcgaggtcgtgctggtgcatggggcggccggcggcagcgggctggccgcggtggaagtggccaaggcgctgggcgccaccgtcatcgccacggtgggctcggacgccaagcaggccatcgtgcgcgagcatggcgccgaccacgccatcaactaccgcacgcaggactggcgcgccgaagtgctgcgcctgacgggacagcgcggcgccgacgtcatctacgacccggtcggcggcgagaccttcgacgcctcgctgcggtgcatcgcgccggacggacgcatcatcccgatggggttcgccagcggcgccatcccgaccgtgccggccaacatcgtgctggtgaagaacatcagcatcctgggcgtgtattggggctactacttcggctggggacgccacccggtcaagcccggcaacgacgcccggttgcgggccgcctacgcccggctcttcgaatggacccgccagggcaggatccggccgcgcgcgcacgcggtcgtgcccctggcggacttccgcaccgcactgcgcatgatcgcctcccgcgaagcgatcggcaggatcgtcatgcaaccgcagcaatag

SEQ ID NO: 51458 - protein, 334 aa, Bordetella bronchiseptica RB50
MKAVVCREYGGPDVAAYEEVPAPALAPGAVRIQVQACSASFASLLVMEGKHQNRAPLPLIPGTEVAGVVTELGAGATRFRVGDRVIAGVQSGGYAQEVVAPEATVFELPADVPFETGAQFPTIYGTAYGALQWRAQVEPGEVVLVHGAAGGSGLAAVEVAKALGATVIATVGSDAKQAIVREHGADHAINYRTQDWRAEVLRLTGQRGADVIYDPVGGETFDASLRCIAPDGRIIPMGFASGAIPTVPANIVLVKNISILGVYWGYYFGWGRHPVKPGNDARLRAAYARLFEWTRQGRIRPRAHAVVPLADFRTALRMIASREAIGRIVMQPQQ

SEQ ID NO: 51459 - DNA, 1026 bp, Chromobacterium violaceum ATCC 12472
  CDS (1)..(1026)
atgaaggcgcttgccaagctgaaggccgctcccggcctggaaatgaccgatgttccgctgccggaagtcggccacaacgatctgttgatcaagatcgtcaagaccgcgatctgcggcaccgacatccatatctggaactgggacgagtggtcgcagaagaccatcccggtgccgatgcacgtcgggcacgagtacgtcggcgtcgtcgccggcatgggttcggaagtgcagggcttcaagatcggccagcgcgtgtccggcgaaggccacatcacctgcggctattgccgcaactgccgcgccggccgccgccacctgtgccgcaacaccaccggcgtcggcgtcaaccgcgaaggcgcgttcgccgaatacctggtgattccggccttcaatgccttcccgatcccggacgacatctccgacgacctggcctccatcttcgacccgttcggcaatgccgtgcacaccgcgctgtcgttcaacctggtgggcgaggacgtgctgatcacaggcgccggcccgatcggcatcatggcggtggccatcgccaagcatgtcggcgcgcgccatgtcgtcatcaccgacgtcaacgactaccggctggagctggcgaagaagatgggcgccacccgtgccgtcaacgtcgcccgcgaggacctgaaggcggtgatgcaggagctgcacatgagcgagggcttcgacgtgggcctggaaatgtccggcaatccgcaggctttccgccagatgctggaaacgatgaaccacggcggcaaggtggcgctgctgggcattccgccgtccaataccgccatcgactggaaccaggtgatcttcaagggcctggaaatcaagggcatttacggccgcgagatgttcgagacctggtacaagatggtggccctgatccagtccggcctggacatcagtcctatcatcacccaccacttcaaggtggacgagttcgagcagggcttcgccgcgatgctgtccggccagagcggcaaggtgatcctggactggcgctga

SEQ ID NO: 51460 - protein, 341 aa, Chromobacterium violaceum ATCC 12472
MKALAKLKAAPGLEMTDVPLPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAKKMGATRAVNVAREDLKAVMQELHMSEGFDVGLEMSGNPQAFRQMLETMNHGGKVALLGIPPSNTAIDWNQVIFKGLEIKGIYGREMFETWYKMVALIQSGLDISPIITHHFKVDEFEQGFAAMLSGQSGKVILDWR

SEQ ID NO: 51461 - DNA, 1035 bp, Gloeobacter violaceus PCC 7421
  CDS (1)..(1035)
atgcactcggcgatgctgtacggggtggaagatgtgcggctggaggaagtgccttgtcccgagccggggcctggggaggtgctggtgcgggtggcggtggcacccacctgcggcaccgacctcaaagtctggctgcgcggcggccacgcgcggatgctggtccccccgacgcctttcggccacgagttcgcaggcgaaattgccgcccttggcgaaggagtgagcggctggcggagtggggagcgggtggtggccaacaattccgctccctgcttcgattgcttttattgccggcgcgagcgcttcagcctctgcgaaaacttgctcttcaacaacggaacgttcgctgaatacctgcgcattccggctgccatcgtccggcacaacttgcttgctgtcccgcctgggttgcccctcgaactcgcggcgatgagcgaaccgctcgcctgtgtgctgcacggcgtcgaagaagcgggggtcagggcgggcgatacggtggtggtgatgggggacggtgcgatcggcctgatgctggtggccgtctgtgctgtgcgcggggctgcggtgatcctcgcaggcggccaatcggcccggcttgccgtggcggaacaattgggagcacaggtgaccctcaactaccgccaggcaggcgatccggtggggcggttacgagcattgaccgagggtggccggggtgcggatatcgttatcgaagccaccggcaaaccggccgcctgggaggcggccatcgccacggcccggccgggggcgacggtgctgctgtttgggggctgtccgcgcggaacggcggtgagcgtcgatacggaaaacctccattacaacgaactgaccctcaagggggtctttcacaacaccccgcgccatgtgcgcgaggcgctggcattgattgcttgccggcgcattgcttttgaattgctcgtgagcgacagtttgcccctcggcaaactggatgaggccctggcgcgcatgcgcgatcggacagccatcaaagtggcgatgctgccgggaagctga

SEQ ID NO: 51462 - protein, 344 aa, Gloeobacter violaceus PCC 7421
MHSAMLYGVEDVRLEEVPCPEPGPGEVLVRVAVAPTCGTDLKVWLRGGHARMLVPPTPFGHEFAGEIAALGEGVSGWRSGERVVANNSAPCFDCFYCRRERFSLCENLLFNNGTFAEYLRIPAAIVRHNLLAVPPGLPLELAAMSEPLACVLHGVEEAGVRAGDTVVVMGDGAIGLMLVAVCAVRGAAVILAGGQSARLAVAEQLGAQVTLNYRQAGDPVGRLRALTEGGRGADIVIEATGKPAAWEAAIATARPGATVLLFGGCPRGTAVSVDTENLHYNELTLKGVFHNTPRHVREALALIACRRIAFELLVSDSLPLGKLDEALARMRDRTAIKVAMLPGS

SEQ ID NO: 51463 - DNA, 1083 bp, Gloeobacter violaceus PCC 7421
  CDS (1)..(1083)
gtggatggcaacaagcccatggacgttccccagctgatgcacgcggcggttttctacggcgtaggcgatctgcgctacgaacaggtgccggttcccgaagtcgcggcggacgaggtgctggtgcaggtgcgcgcctgcggtctgtgccagtcggacatcaaaaagctgcgctacccgctactcgacccgccgcgcatcttcggccacgagacgagcggcacgatcgtgcgcgccggggaagcggtggagcactggcgggtaggcgagcgggtggtggtgctgcaccatattccttgttttcactgcccctactgccttaacgagaactactcgatgtgccgggtctacaaagaagtgaccactaccgccggctttgcacccgccggcggcggcttcgccgagtacgtcaaggtgcccggccacatcgtgcgctcgggaggtctgatggcgattcccgacggggtgagcttcgaagaagcgagcttcgtcgaacccaccaactgctgcttgaaggccgtgaaaaaagcccaggtccagcccggccagtgggtgctgatcaccggcgccggtcccatcgggctgatgttcgccatgctctgccgccagttcggagcgaaaccgatcgtcaccgacttgctcgcctcgcgcgtcgagcgcgcccgcgcgctcggggccgaggctgccctcgatgcgcgctccgccgatctgaccgcccggatccacgccctcaccggcggcctcggagtggatgtcgccttgctcgcggtgcccagcgtgcaggccttttcccaggccctcgatgcgacgcgcaagggcggcaagattctgttttttgccgaatttgccgaatcggtgcaaatcccgctcgatccgaacgtgctctaccggcgcgaaatcgacttgatgggctcctacagctcctcgttcaaagtccagcacctggcagccgatcttgtcttcgggcggcgcatcgacgtgcaggcgctcatctcggacttttatccgctcgctgaactggcggcggcggtggagcaggccgtgcatccaacccccgagacctgcaaaattcttatccggccttga

SEQ ID NO: 51464 - protein, 360 aa, Gloeobacter violaceus PCC 7421
MDGNKPMDVPQLMHAAVFYGVGDLRYEQVPVPEVAADEVLVQVRACGLCQSDIKKLRYPLLDPPRIFGHETSGTIVRAGEAVEHWRVGERVVVLHHIPCFHCPYCLNENYSMCRVYKEVTTTAGFAPAGGGFAEYVKVPGHIVRSGGLMAIPDGVSFEEASFVEPTNCCLKAVKKAQVQPGQWVLITGAGPIGLMFAMLCRQFGAKPIVTDLLASRVERARALGAEAALDARSADLTARIHALTGGLGVDVALLAVPSVQAFSQALDATRKGGKILFFAEFAESVQIPLDPNVLYRREIDLMGSYSSSFKVQHLAADLVFGRRIDVQALISDFYPLAELAAAVEQAVHPTPETCKILIRP

SEQ ID NO: 51465 - DNA, 1029 bp, Photorhabdus luminescens subsp. laumondii TTO1
  CDS (1)..(1029)
atgaaagcattagtattagaaaaagcaggtcagatttcaattcaagactgggaaacccccgaaatattgggtgaaaatgatgttgaaataaaaattcactcggtggggatttgtggcagcgatgtgcattattatcaatacgggcgtattgggccatttattgtcgaaaagccgatgatcctcgggcacgaagcatcaggtgtcatcaccgcagtaggtaaaaatgtgactcacttaaaaatcggcgatcgtgtctgtatggaacctggcattcctaatctgcaatcaccacaatcacgggcaggtatttataacttagatccagaagtgcgtttctgggcgacgccccctattgatggttgcttacgtgaaagagttattcatccggcagcatttacgttcaaattaccggataatgtcagttttgccgaaggtgcaatggttgaaccattagctatcggtatgcaagccgccacaaaagcagaaattaaaccaggagatatcgcattagttattggtgctggcacgatcggaattgttaccgcacttgccgcattagccggtggttgttctgatgtcattatttgcgatgtgttcgatgaaaagctagaaattgcaaaacagtatccaggtcttcacccggttaatagcaaagtacttactgagaaagtgaatgcattaaccgagggtaatggcgtcaatattctctttgaatgtagtggcgcaaaaccggtcattgccactatttcagagcacattgcaccgggaggaatagctgttctagtcggtatgcctatcgatccggcaccatttgatgttgtctctgctcaagctaaagagatcacattcaaaactattttccgctacgcaaatatgtaccctcgtactattcgtttacttagctcaggtaagctcaaagtaacccctctattatccgcaacctataaatttaaagacagcgttcaggcgtatgaacgagccgcggagggtcgcccgacagatatcaaaattatgttggaaatggagtaa

SEQ ID NO: 51466 - protein, 342 aa, Photorhabdus luminescens subsp. laumondii TTO1
MKALVLEKAGQISIQDWETPEILGENDVEIKIHSVGICGSDVHYYQYGRIGPFIVEKPMILGHEASGVITAVGKNVTHLKIGDRVCMEPGIPNLQSPQSRAGIYNLDPEVRFWATPPIDGCLRERVIHPAAFTFKLPDNVSFAEGAMVEPLAIGMQAATKAEIKPGDIALVIGAGTIGIVTALAALAGGCSDVIICDVFDEKLEIAKQYPGLHPVNSKVLTEKVNALTEGNGVNILFECSGAKPVIATISEHIAPGGIAVLVGMPIDPAPFDVVSAQAKEITFKTIFRYANMYPRTIRLLSSGKLKVTPLLSATYKFKDSVQAYERAAEGRPTDIKIMLEME

SEQ ID NO: 51467 - DNA, 1026 bp, Photorhabdus luminescens subsp. laumondii TTO1
  CDS (1)..(1026)
atgaaagcattgtcaaagttaaaagcagaagaaggcatctggatgatcgatgtgcccgagccagagctggggcacaatgatgtgatgatcaaaatccgtaaaacagcgatttgtggtacggatgtgcacatctataactgggatgattggtcacaaaaaaccattcctgtaccgatggttgtcggtcatgaatatgttggtgaagttgttgccattggtcaggaagtaaaaggttttaaaattggtgatcgggtgtctggcgaagggcatattacttgtggttactgccgtaactgtcgtggtggccgtactcacttatgccgtaataccattggcgtaggggtaaaccgcgctggttgttttgcacaatatctggttattcctgcatttaatgcgttcaaaattccagataacatctctgatgaactggctgctatttttgacccatttggcaatgctgttcataccgcgctttcgtttgatctggttggtgaagatgtgctggtttctggtgctggcccaattggtattatggcggcggcagtatgtaaacatgttggcgcgcgtcatgttgtcatcaccgacgttaacgaatatcgccttgagttggcacgtaaaatgggtgtcacccgtgcggtgaacgttagtcaggaaaatctgaccgatgtcatggcggaattgggcatgacggaaggttttgatgttggtttggaaatgtctggtgccccggcggcgtttcgtaccttattaaataccatgaatcacggcggccgtgttgcattgttgggcattcctccatcagatatggcaattgattggaatcaggtgatttttaagggattgtttatcaaaggtatttatggccgtgagatgtttgaaacctggtacaaaatggctacattaatccagtctggtttggatctgacacccattatcacccaccggttctctatcgatgatttccagaaaggctttgacatcatgcgttcagggcagtctggtaaagttattctgaactgggattaa

SEQ ID NO: 51468 - protein, 341 aa, Photorhabdus luminescens subsp. laumondii TTO1
MKALSKLKAEEGIWMIDVPEPELGHNDVMIKIRKTAICGTDVHIYNWDDWSQKTIPVPMVVGHEYVGEVVAIGQEVKGFKIGDRVSGEGHITCGYCRNCRGGRTHLCRNTIGVGVNRAGCFAQYLVIPAFNAFKIPDNISDELAAIFDPFGNAVHTALSFDLVGEDVLVSGAGPIGIMAAAVCKHVGARHVVITDVNEYRLELARKMGVTRAVNVSQENLTDVMAELGMTEGFDVGLEMSGAPAAFRTLLNTMNHGGRVALLGIPPSDMAIDWNQVIFKGLFIKGIYGREMFETWYKMATLIQSGLDLTPIITHRFSIDDFQKGFDIMRSGQSGKVILNWD

SEQ ID NO: 51469 - DNA, 975 bp, Rhodopseudomonas palustris CGA009
  CDS (1)..(975)
atgaaggctattctctgccagcaatattgcggtcccgacgatctcgtttatgccgacgtgcccgatccggtcgccggccccggtgaagcggtgatcgcggtcaaggcggcggcgctgaacttcttcgacatcctgatgatccagggcaagtaccagatcaagccgccgttcccgttctcgccgggtgcggaagtcgcgggcgtgatcgaaagcgtcggcgaaggcgtcaccgacctgaaggtcggcgatcgcgtggtggcctcgtgcggtcacaatggcgcgcgcgagaagatcgcgctgccggcacagatgatcgtgaagattcccgataatctcgatttcgatcgcgccgccggcatcatcatcatctacggcaccgcgctgcatgcgctggaagaccgcgccagcccgaagccgggcgagacgctggcggtgctcggcgctgccggtggcaccggcctcgcagcctgcgagctcggcaagctgatgggcctcaaagtgatcgcctgcgcctcgtcggaggagaagctggcgtttgccaagcagcacggcgccgaactgacgctgaactacgcgaccgaagatctgaaagagggtctgaagaagctgaccggcggcaagggcgtcgacatcatctttgatccggtcggaggcacttacgccgaggctgcgttgcgctcgatcgcctgggaaggccgcttcctggtgatcggctttgcggccggcgacattccgaagatgccgctcaacctcgcgctgctgaagggctgcgatatccgaggcgtgttctggggcgcgtggacccggctcaatccggagaagaaccgcgccaatctcgagaagctggtcaagtgggcggccgagggcaagatttcctcacacgtcgaccgcactttcccgctggcgcagaccgccgacgccctgaaggtgctcgccggccgtcaggcgatgggcaaggtgatcctgcatccgtga

SEQ ID NO: 51470 - protein, 324 aa, Rhodopseudomonas palustris CGA009
MKAILCQQYCGPDDLVYADVPDPVAGPGEAVIAVKAAALNFFDILMIQGKYQIKPPFPFSPGAEVAGVIESVGEGVTDLKVGDRVVASCGHNGAREKIALPAQMIVKIPDNLDFDRAAGIIIIYGTALHALEDRASPKPGETLAVLGAAGGTGLAACELGKLMGLKVIACASSEEKLAFAKQHGAELTLNYATEDLKEGLKKLTGGKGVDIIFDPVGGTYAEAALRSIAWEGRFLVIGFAAGDIPKMPLNLALLKGCDIRGVFWGAWTRLNPEKNRANLEKLVKWAAEGKISSHVDRTFPLAQTADALKVLAGRQAMGKVILHP

SEQ ID NO: 51471 - DNA, 1002 bp, Rhodopseudomonas palustris CGA009
  CDS (1)..(1002)
ttgccagctcccgagcccctgatgaaagccgtcgtcgtcgacgactatgccgcgatcgatcaggtcgccttgaaacagatcgcgcggccgacggtgacgccgggatcggtgcgggtccgtgttcaggcggtcggcatcggcttcgtcgacggccttaaagtgcagggccgctatcagaccaaggatccgctgccgttcattcccggcacggaattcgccggcgtgatcgatgcggtcggcgacggcgtcgccaactacgcggccgggcagacggtgatggggatagcgcgctccggtgcgctcgccgaatacatcgtggtgccggccgaggcggtggcgccgctgcccgacggggtctcgccggaagaaggcgcctcgttccgggccaactacctcaccgcgtattacgcgctggccgagcgcgccaagctgcagcgggacgagatcctattggtcctcggcgccgccggcggcgtcggcaccgccgcgatccagatcggcaagctgctcggcgcccgcgtcatcgcaggcgcgtcgaccgcgcagaagcgcgacttcgcgctgaaactcggcgccgacgcggtgatcgactacacccagcccgactggcgcgacaccttcaagacgctgaccggcgggcacggcgccgacgtgatcttcgatccaatcggcgggccggtcgctgtcgaagcgtttcgctcgatcgcctggaacggccggcacatcgtggtcgggtttgcggccggcagcatcccggcgctgccgttcaatctgccgctgctcaaaggcggcagcctgctcggcgtcgacctcgcccagctgccgcggcgcgaaccggatgtgctggcgcgctgcaccgcggagctgtcgcggttgctcgccagcggcgcgctgaaaccggcgatcgtctcggcatttgcgctggaggatttccgcgccgcgttcaccgccctcgccggtcgcgacgcgctcggcaaggtggtggtgcggatcgcgccgtag

SEQ ID NO: 51472 - protein, 333 aa, Rhodopseudomonas palustris CGA009
MPAPEPLMKAVVVDDYAAIDQVALKQIARPTVTPGSVRVRVQAVGIGFVDGLKVQGRYQTKDPLPFIPGTEFAGVIDAVGDGVANYAAGQTVMGIARSGALAEYIVVPAEAVAPLPDGVSPEEGASFRANYLTAYYALAERAKLQRDEILLVLGAAGGVGTAAIQIGKLLGARVIAGASTAQKRDFALKLGADAVIDYTQPDWRDTFKTLTGGHGADVIFDPIGGPVAVEAFRSIAWNGRHIVVGFAAGSIPALPFNLPLLKGGSLLGVDLAQLPRREPDVLARCTAELSRLLASGALKPAIVSAFALEDFRAAFTALAGRDALGKVVVRIAP

SEQ ID NO: 51473 - DNA, 969 bp, Mycobacterium avium subsp. paratuberculosis str. k10
  CDS (1)..(969)
atgcgggcggtcgtctgccgttcctacggcacaccggaggacctggtgctcgacgaggtgcccgacccggtgcccggccccggccagctgctggttcgggtccgcgcggccgcggtcaacttccccgacgtactgttcatcgccggcaaatatcaggtgaagattccgccgccgttcattcccggcaacgagatcgccggcgaggtcatcgccgccggcgaaggcgcccggttcgttccgggacagcgggtggccggaaccacgttcggggcgttcgccgagcaggcgctgctgaatgccgatcaggccgagcccatccccgacgacgccgacttcgcctccgccgcggccttcggcgtcacctaccgcaccgcctatcacgcgctgcgctcgaccgccggtgtgacggcgggagattgggtggtggtgctcggcgccgcgggcggggtcgggctggccgccgtggatctggcggtcgcgatgcaggcccgggtgctggccgccgcgtccagcccggagaagctcgagctgtgccggcggcgcggtgcggaggcgacggtggattacgaccgcgaggacctcaagacgcggatccgggagctcaccggcgaccgcgcccgcgtcgtcctggacccggtcggcgggccctactcggagccggccctgcgcggcctggcccgcggcggcaccttcgtcaccctgggctacgcgtccggcaccatcccggccattccgctcaatctcgttttgctcaaggacatctgcgtgcgcggcatggagatccgcaccttcatgaccgaccggcccgacgacgccgtgcgcgacctgacggagttgtcgcagatgttcgccgccggcaccgtccggccgtacatcggggcgcggtttccgctcgagcggaccgccgcggcgttgcggcacgtcgccgaccgcaaggtgctgggcaaggtggtgatcgacgtcgcgtga

SEQ ID NO: 51474 - protein, 322 aa, Mycobacterium avium subsp. paratuberculosis str. k10
MRAVVCRSYGTPEDLVLDEVPDPVPGPGQLLVRVRAAAVNFPDVLFIAGKYQVKIPPPFIPGNEIAGEVIAAGEGARFVPGQRVAGTTFGAFAEQALLNADQAEPIPDDADFASAAAFGVTYRTAYHALRSTAGVTAGDWVVVLGAAGGVGLAAVDLAVAMQARVLAAASSPEKLELCRRRGAEATVDYDREDLKTRIRELTGDRARVVLDPVGGPYSEPALRGLARGGTFVTLGYASGTIPAIPLNLVLLKDICVRGMEIRTFMTDRPDDAVRDLTELSQMFAAGTVRPYIGARFPLERTAAALRHVADRKVLGKVVIDVA

SEQ ID NO: 51475 - DNA, 1026 bp, Mycobacterium avium subsp. paratuberculosis str. k10
  CDS (1)..(1026)
atgcgcaccgtagtcgtcgacgggccccgcagcatccgggtggacacccgccccgatcccgtgcttcccgggcccgacggggcgatcgtcgaggtgagcgcggccggtatctgcggatccgacctgcacttctacgaggccgacttcccgatgccggacccgattgcgctgggccacgaggcgatcggcaccgtggtggaggccgggccgcaggtgcgcaacgtcaaggtcggcgatcaggtcatggtgtcctcggtcgccggctgcggcagctgcgctggctgcgccacccgggatccggtgctgtgccactccggtttccagatcttcgggggtggtgtgctgggcggcgcgcaggccgatctgctggcggtgcccgcggccgacttccagctgctgaagatccccgagggcatcagcaccgagcaggcgctgctgctcaccgacaatctggccaccggctgggccgccgcgcagcgggccgacattcccttcggtggcacggtggcggtcatcgggctgggcgcggttggcttgtgcgcgctgcgcagcgcgctgttccagggcgcggcaacggttttcgcggtcgatcaggttgacggccggctggcgcgtgccgcccggtggggggcgacgcccgtcaaggcgccggcgctcgaggcgatcctcgcggccaccggcggccgcggcgccgacgcggtgatcgacgccgtcgccacggacgcctccctgaccgaggcgctcaacgcggtgcggccgggcggcacggtctcggtggtcggcgtgcacgacatgaacccgttcccgctcaacgcgctgggctgcctgattcgcagcatcaccctgcggatgaccacggcgccggtgcagcgcacctggccggaactgattccgctgttgcagtcaggccggctggacgtcgacggaatcttcaccacgacaatgcctttggacgaggcggccatcgggtatgcgaccgcggggtcgcggtcgggcgacgacgtcaagatcctgctgaaaccgtag

SEQ ID NO: 51476 - protein, 341 aa, Mycobacterium avium subsp. paratuberculosis str. k10
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPVKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 51477 - DNA, 1047 bp, Treponema denticola ATCC 35405
  CDS (1)..(1047)
atgtcgataaaaataaggactgcagcagttacaggcccgcataaagtcgaaatcctagagctgaacacgcctgatcttagaagcggtgaggtgcttgtcaaagttcatgcagttgctctttgtacattggagcagcgaatttttcggggtgaaattcccatgcccctgccttgtaccggaggtcatgaggtttcaggcgaagtagttgcccttggtgatggggtaaatacgaaaaaatggtctgcaggggatagggtggctgtgcgcttgctttataattgcggtgagtgtcattattgtcatagcggacataataatttatgcgaacgcgcacaaaaaaaacctgtaagagaaaatttattggtaggccccggaggcttatgtgattatatcattgttaatacttctgctctttttccaatttcagacgagctcagctacgaggaagcatgtcttacagaaccattggcctgctgtgtacacagtattgaaagagcaaatttacagttgggcgaagatgtagttgtaataggaggtggtattatggggcaatatcatataatgttagccaagtgccgcggttgtcgagttattttaagtgaagttgatccggaaagatgcaaactgggaaaacagctgggggcggatatagtctttaatcctttggagcatgaccctgttacatttatacaaagtttaacaaatggacgaggagcagatgcagtatttaatacaacacctattcctggagttgttcctcaagcaatcgcaatgaccggtaaatgcggaaggatgatccaatacagttcaatgcatcctgattctcccacacctgttagtcctcaaatgctgcatggtagtgagattgtgttaacgggagcaattagtcctgatgaaagaaatttttatactgcaaacagattattatctacaggtatcattaattgtaaacctttgattgctaaaaaatttccttttgaggaggctcaaaaagctttcgaagcagctattgttccgggcacatttcgtatgattattacagattaa

SEQ ID NO: 51478 - protein, 348 aa, Treponema denticola ATCC 35405
MSIKIRTAAVTGPHKVEILELNTPDLRSGEVLVKVHAVALCTLEQRIFRGEIPMPLPCTGGHEVSGEVVALGDGVNTKKWSAGDRVAVRLLYNCGECHYCHSGHNNLCERAQKKPVRENLLVGPGGLCDYIIVNTSALFPISDELSYEEACLTEPLACCVHSIERANLQLGEDVVVIGGGIMGQYHIMLAKCRGCRVILSEVDPERCKLGKQLGADIVFNPLEHDPVTFIQSLTNGRGADAVFNTTPIPGVVPQAIAMTGKCGRMIQYSSMHPDSPTPVSPQMLHGSEIVLTGAISPDERNFYTANRLLSTGIINCKPLIAKKFPFEEAQKAFEAAIVPGTFRMIITD

SEQ ID NO: 51479 - DNA, 1053 bp, Bacillus cereus ATCC 10987
  CDS (1)..(1053)
atgaaagcattactttggcataatcaacgtgatgtaagagtagaagaagtaccagaaccaactgtaaaaccaggagcagttaagattaaagtgaaatggtgtggtatctgcgggacagacctgcatgaatatttagcaggacctatttttattccaaaagaagagcatccattaacacatgtaaaagcaccggttattttaggtcatgagtttagcggtgaggtagttgaaatcggtgaaggcgttacatctcataaagtgggagaccgcgtcgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcaccatattccagatgaaatgacgtatgaacaaggtgcacttgtagaaccagcagctgtagcagttcatgcagtacgtcaaagtaaattaaaagaaggggaagctgtagcagtatttggttgtggtccaattggacttcttgttatccaagcagctaaagcagcaggagcaactcctgttattgcagtcgagctttctaaagaacgtcaagagttagcaaaattagcaggtgcggattacgtattaaatccagctactcaagatgtattagcagaaattcgtaacttaacaaatggtttaggtgtaaatgtgagctttgaagtaacaggtgttgaagtagtacttcgtcaagcaattgaaagtacaagtttcgaaggacaaactgtaattgttagtgtatgggaaaaagacgcaacaattactccaaacaatcttgtactaaaagaaaaagaagtggttggtattttaggataccgtcatatcttcccagctgttattaaattaattagctctggccaaattcaagcagagaaattaattacgaaaaaaatcacagtggatcaagttgttgaagaaggatttgaagcacttgtaaaagataaaacacaagtgaaaattcttgtttcacctaaataa

SEQ ID NO: 51480 - protein, 350 aa, Bacillus cereus ATCC 10987
MKALLWHNQRDVRVEEVPEPTVKPGAVKIKVKWCGICGTDLHEYLAGPIFIPKEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 51481 - DNA, 1023 bp, Bacillus cereus ATCC 10987
  CDS (1)..(1023)
atgaaagctgcagtgtggtatggtgaaagagatattcgtattgaggaaagagaaacgaaagaattacaacccaatgacgtaaaagttaaagtggcatgggctggtatttgtggttctgatttgcatgcatacttgcatccaggttcagtaccaataaatatgaatacggtaatgggacatgaattttctggtgaaattgcagaggttggttctcatgtaacaaaatttaaaaaaggtgacagagtatgtatctatccaatgatgcttaaagatccttcaaatgctgaaattgaacgtttcatcactttagacgcagttggtgcacaaatcgacggagggtttgctgaatatgtgatacttccacaaaaaacgatttttaaaattccagatcatttaccgctagaattagcagccatggttgaaccagcagctgtatctttccaatccattaaggattcaaatgtaagagaaggggatactgtcgttgtctatggagcgggtcctattgggctatttgctgttttaggtgcaaaagctgcaggtgcttctaatattattgttatcgatctatttgatagtcgacttgataaagcaactgaaatgggtgcaacacatgtctttaatgctaaagaagtaaatcctgttgaagaaattcggaaattattcccaggtggagcagatgttgcaattgaagctgcaggtgtcgagtcaacatttaatcaagctattcaatcaactaaagttcgtggcacaatgatggttatcagcttccacacgcaagatatccaatttaatgttcctgcttcactaatctttagtggtgcaaaattaatggggtctgtaggatacagcaatgaaacttacaatgaggttattgaattatttgctaatggaagattacccgcgcaatcaattattacaagtaaaattgatatagataatattgctgaacaaggctttgaagcgttaattcatgataaatctcaagcgaaaattttagttaaattaagtggcgcacattaa

SEQ ID NO: 51482 - protein, 340 aa, Bacillus cereus ATCC 10987
MKAAVWYGERDIRIEERETKELQPNDVKVKVAWAGICGSDLHAYLHPGSVPINMNTVMGHEFSGEIAEVGSHVTKFKKGDRVCIYPMMLKDPSNAEIERFITLDAVGAQIDGGFAEYVILPQKTIFKIPDHLPLELAAMVEPAAVSFQSIKDSNVREGDTVVVYGAGPIGLFAVLGAKAAGASNIIVIDLFDSRLDKATEMGATHVFNAKEVNPVEEIRKLFPGGADVAIEAAGVESTFNQAIQSTKVRGTMMVISFHTQDIQFNVPASLIFSGAKLMGSVGYSNETYNEVIELFANGRLPAQSIITSKIDIDNIAEQGFEALIHDKSQAKILVKLSGAH

SEQ ID NO: 51483 - DNA, 1116 bp, Anopheles gambiae str. PEST
  CDS (1)..(1116)
atgcagaagcagaatcggtcgagaatggcacagcgaaaagttaaaaatcttgccggcgtggtacacggcgtcgaagactttcgtgtggaagaaatccccatgccacggccgcgcgatcatgaggtcctgctcgagatggactgtgtgggcatctgcggctcggacgtgcactacgtgtcgcacggaggattcggcgactacaagctaaaggacaagatggtgctcggtcacgaatcgtccggtgtggtggtggccgttggagcagacgtaaccagcctgcaggtgggtgatcgtgtcgccattgaacccgcgattggctgtcgcacttgccggcactgtaaggccggccggtacaatatctgcccgcagggtgtttactgtgtgaccacggggcatggtaatttgtgcaactactacactcacgcggccgactgctgcttcaagctgccggcgaatgtgacgatggaggagggcgccctgctggaaccgcttgccgtgggggtgcactgttgccgccggggtggtgtcgggattggcagcacggtgctggtgctcggtgccggaccgatcgggctcgttacgctgctggtagcgaaagcgatgggtgcggcgaaggtgtgcgtcatcgatctggtggagcggaagctcgagctggccaagacgctcggggctgatgcaacgctggcggttagcggacacgatacgcaggatgagatcgtgaagcgcattcatgcgctgcttggtactgcgccagacatcagcatcgagtgcacgggggcggaagcgtgcgtacagctgggaattgaagctaccgtaccgggtggtgtggtgacgctggttggcatcggtgccatacagcagcgtgtcccgataacgacggccctggtgcgtgagattgacatccggacggcgtttcggtacgccaactgctatccagcagcgctcgcgatggtagcgaacggtacgatcgatgcactcaagctgatcacgcatcattacgagctgcaggaatcggaccaagcgttcaatacggcccggtacgggctgggcggtgcagtcaaggtcatgatccactgccaaccaaggaacaaaaacaatccacaacgaaaggtgtag

SEQ ID NO: 51484 - protein, 371 aa, Anopheles gambiae str. PEST
MQKQNRSRMAQRKVKNLAGVVHGVEDFRVEEIPMPRPRDHEVLLEMDCVGICGSDVHYVSHGGFGDYKLKDKMVLGHESSGVVVAVGADVTSLQVGDRVAIEPAIGCRTCRHCKAGRYNICPQGVYCVTTGHGNLCNYYTHAADCCFKLPANVTMEEGALLEPLAVGVHCCRRGGVGIGSTVLVLGAGPIGLVTLLVAKAMGAAKVCVIDLVERKLELAKTLGADATLAVSGHDTQDEIVKRIHALLGTAPDISIECTGAEACVQLGIEATVPGGVVTLVGIGAIQQRVPITTALVREIDIRTAFRYANCYPAALAMVANGTIDALKLITHHYELQESDQAFNTARYGLGGAVKVMIHCQPRNKNNPQRKV

SEQ ID NO: 51485 - DNA, 1062 bp, Gibberella zeae PH-1
  CDS (1)..(1062)
atgtccagcaatctctccttcgtcctcaacaaaccaggtgacgtctccttcgaggaacgtcccaagccctccctcgcaagccctcacgatgtcctcgtcgccgtcaactacaccggtatctgcggttccgacgtccactactgggtccacggctccatcggcaagttcgtcgtcgaggaccccatggttctaggccacgagtccgccggaactgttgttgaggttggcgacaaggtcaagaccctcaaggctggtgatcgcgtcgctcttgagcctggatacccttgccgtcgctgccagaactgcctcgctggcaagtacaacctctgccctgatatggtctttgccgctacgccgccttatcacggtaccttgactggtttctggtctgcccccgccgacttttgcttcaagcttcccgacaatgtttctctccaagagggagccttgatcgagcctctcgccgtcgctgtccacatcgtcaagcaggcgcgcgtcaagcctggtgactctgtcgttgtcatgggcgctggtcccgtcggtcttctctgcgctgccgtcgcaaaggcctacggtgcttccaagattgtcagcgtcgacattgtccagagcaagctcgatttcgccaaggactttgcttccacacacgtgtacgcctcgcagcgcatcgcacccgaggagaacgccaagaacatctgtgatctggccggtcttcccgacggtgctgatgtagttatcgacgcgagcggtgccgagccctcaatccaagcttctatccacgtcctcaagaacggtggcagctatgtgcagggcggtatgggcaaggccgacattactttccccatcatggctttctgcatcaaggaggccaccgcgagcggatccttccgatacggcgctggcgattaccctcttgctgttgagcttgttgccaccggcaaggtggatgtcaagaagctcatcactggtatcgtcgactttaagcaggccgaggaggctttcaagaaggtcaaggagggagaagcgattaaggttcttattaagggacctaatgagcagtaa

SEQ ID NO: 51486 - protein, 353 aa, Gibberella zeae PH-1
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAVHIVKQARVKPGDSVVVMGAGPVGLLCAAVAKAYGASKIVSVDIVQSKLDFAKDFASTHVYASQRIAPEENAKNICDLAGLPDGADVVIDASGAEPSIQASIHVLKNGGSYVQGGMGKADITFPIMAFCIKEATASGSFRYGAGDYPLAVELVATGKVDVKKLITGIVDFKQAEEAFKKVKEGEAIKVLIKGPNEQ

SEQ ID NO: 51487 - DNA, 990 bp, Ustilago maydis 521
  CDS (1)..(990)
atgtctacgatccaagcgctacagatccaatcgcagggtggaccagaggtcgtgcaggtgcgttgcatacctgcgcccacgctgtccggctcgggccaagtaatcgtgcgcaacgaatacgctggagtcaacatgatcgacacctaccatttcggtgggctgtatccgttgaaatgtccgattgtgatcggccaagaatcggcgggagtggtggaagcggttgatgcagatgtgacgagcgtagctgtgggagacagggttgtacagtacggtggagggtcgtacactgaaaagcagctgttgaacgctgagcgcgtgatcaagcttcccgaatcgatctcgaccaagacggcggcagctgcgtatttgcagggacttaccgctctgacgttgctcaaggaagcgcatccggtcaaacagggcgattggatactcgtcaccgctgcagctggcggcgtcggcctgctgctctgtcagatgggcaaagcgtttggagccaacgtgatcgctgttacctcaactgaagaaaaatgtcagctcgcaaaacagcacggcgccatccacgctctgcgctacaacaagcaagacccagcgcagtacatcgccgcgatcaaacacatcacccaagaccacggcgtcgacgccatcctcgacggcgtaggagccgacacgtgggaaagcaactttgaaatcgccgcgcgaaaagcaaccatcgtcacgttcggtaacgcttccggtccggtccccgcgttcgccccgctcaaactcgcctccaagaacctcaaagtggtccgcccaacgctgttcaactacgtcaccaccagggaagagagagaacggtattcacaagagctcttcgaccttatccagcagggaaacgtcaagatcaacgttcacgaagagtatcccttcaccaccgaggatatgaggagagcatttgcggacatcaaaagcaggaagacaacgggcaagctagttgtcaaaatgtga

SEQ ID NO: 51488 - protein, 329 aa, Ustilago maydis 521
MSTIQALQIQSQGGPEVVQVRCIPAPTLSGSGQVIVRNEYAGVNMIDTYHFGGLYPLKCPIVIGQESAGVVEAVDADVTSVAVGDRVVQYGGGSYTEKQLLNAERVIKLPESISTKTAAAAYLQGLTALTLLKEAHPVKQGDWILVTAAAGGVGLLLCQMGKAFGANVIAVTSTEEKCQLAKQHGAIHALRYNKQDPAQYIAAIKHITQDHGVDAILDGVGADTWESNFEIAARKATIVTFGNASGPVPAFAPLKLASKNLKVVRPTLFNYVTTREERERYSQELFDLIQQGNVKINVHEEYPFTTEDMRRAFADIKSRKTTGKLVVKM

SEQ ID NO: 51489 - DNA, 1176 bp, Aspergillus nidulans FGSC A4
  CDS (1)..(1176)
atgtctagcactctcgaaattgcgacagacaacgaaaacatgccgctcatgaaagcgctccagttccatggccccagggacgtaagggtcgaacagattgaagagcctgtctgcggaaagggccaggtgaagctgcgaaacacatactgcgggatctgcggcagcgacctccatgagtatacctccggacccgtcttaataccgaagggagcacatagcatcaccaaagctaccgcgccggttgtcatgggtcacgagtttggtggagtcgtcgaggaagtgggagaaggcatcacacacctcaagccgggacagaaggcggttgtgcgcccgaccatattcgacaggaagtgccccccatgcaaaattggctacgagtattgctgcgagaatattggcttcatcggactatctggtatgctctttttcagaatcaagcaagctgtacgatctggacaagctaacgtcccaatgcgaacaggttacggcggtggttttgccgagaaaatagtcgcgcctgcagaacacttctaccccattcctgataatgttacgccggaatccatggccatgatcgaaccactggcggtcgcatggcacgccgtcaacttgtcgccattcaaggagggtgacaatgtcttggtcgtcgggggcggtcctcttggtctatgcatcctgcaagtgctgaagatgcgaggcgccaacttcacgatcattgctgaattgacagaaacccgaaagaagtctgcgaaatactttggcgccacgcatatcctcgatcctagggaagtcgacatcccagacaatgtccgcgggttgaccgacggcgtcggcgcggatgtggtcttcgacacagcgggcgtggagaaggcgcttgacggagccattggtgcctgccgcgtccatggtacgatcgttaatgtcgctgtgtgggagaagaaaccgcagatcaaggtcaacgagatgatgtaccacgaggtgaaatatcttggctcggcattatacgatgagaagtcatttcaagacactatcgacgctatctcgaagggcctactgaaaccggagtccatgattacggataaaattaaactggaagatgtggtggagaagggattcaagacgctgctgcaggacaggaatacgcactgcaagatccttgtcgatccacagatatga

SEQ ID NO: 51490 - protein, 391 aa, Aspergillus nidulans FGSC A4
MSSTLEIATDNENMPLMKALQFHGPRDVRVEQIEEPVCGKGQVKLRNTYCGICGSDLHEYTSGPVLIPKGAHSITKATAPVVMGHEFGGVVEEVGEGITHLKPGQKAVVRPTIFDRKCPPCKIGYEYCCENIGFIGLSGMLFFRIKQAVRSGQANVPMRTGYGGGFAEKIVAPAEHFYPIPDNVTPESMAMIEPLAVAWHAVNLSPFKEGDNVLVVGGGPLGLCILQVLKMRGANFTIIAELTETRKKSAKYFGATHILDPREVDIPDNVRGLTDGVGADVVFDTAGVEKALDGAIGACRVHGTIVNVAVWEKKPQIKVNEMMYHEVKYLGSALYDEKSFQDTIDAISKGLLKPESMITDKIKLEDVVEKGFKTLLQDRNTHCKILVDPQI

SEQ ID NO: 51491 - DNA, 1062 bp, Aspergillus nidulans FGSC A4
  CDS (1)..(1062)
atgagagcggttcggttccacgggcgccgcgacatccgcgtcgaccagattgacgaaccatcttgtgcagaagggcaggttaaaatccgccctgcctttgttggaatatgcggcagtgatctacacgaatacctctctggcccaatcgccatcccgacaacaccccaccccctcacaggagcacagctccccgttacgctgggccacgaattcagcggcaccatcgaggaagtagggcaaggtgttacagggttcaaagttggagatcgagtggctgtccggccaaacttatcggatggaacctgcgcctcttgtgtatacgggaggcccaactgctgtcgcagccttgggtttattgggttcagcagtaattccggaggtctatcagattatgttactgttccagccaagcatgcgattctgttgcctgagagcgtccccctggatcttggtgcgctcgtcgagcctctaacagtagcctggcatgccgtagcccgcagcccccacgaaactgcgcgtactgcgctcgtcgtcggcggcggccccataggcctcgcagtcgtgcaggtcctcaaagcccggggcgtgcaaaccgtcgtcgtcgccgaggtctccacccagcgacgcgaatatgcgctcaccctcggcgccacacacgttttcaaccctctcacggacgatgtcgttgcgcgtgtccgcagcttaacggataatgcaggcgcagacatcagctttgaatgctcaggagtacaggcagggttcgatacagccatgaatggaatccgggtccgggggacgacgacgattgtgtcgctctgggagaaaaagcccatgatcgatgcgtttgatgtggtttcttatgagaagcatgttattggggcggcaatttgcgacgacggggactttgaggctgtgatcggggccatcaaagacggcaaactcaatccccgtcccatgatcactagcaagatccggatggaggacgtcgaagaaaagggcttcaaggcgcttgtcgacgagaaagataagcatgtaaagatcctgattgacattgccgcatga

SEQ ID NO: 51492 - protein, 353 aa, Aspergillus nidulans FGSC A4
MRAVRFHGRRDIRVDQIDEPSCAEGQVKIRPAFVGICGSDLHEYLSGPIAIPTTPHPLTGAQLPVTLGHEFSGTIEEVGQGVTGFKVGDRVAVRPNLSDGTCASCVYGRPNCCRSLGFIGFSSNSGGLSDYVTVPAKHAILLPESVPLDLGALVEPLTVAWHAVARSPHETARTALVVGGGPIGLAVVQVLKARGVQTVVVAEVSTQRREYALTLGATHVFNPLTDDVVARVRSLTDNAGADISFECSGVQAGFDTAMNGIRVRGTTTIVSLWEKKPMIDAFDVVSYEKHVIGAAICDDGDFEAVIGAIKDGKLNPRPMITSKIRMEDVEEKGFKALVDEKDKHVKILIDIAA

SEQ ID NO: 51493 - DNA, 1080 bp, Aspergillus nidulans FGSC A4
  CDS (1)..(1080)
atgagctcacagaccccaacagctcagaacctctccttcgtcctcgaaggcattcatcgggtcaaattcgaggatcgccccatcccaaagctcaaaagccctcatgatgtcatcgtgaacgttaaatacacaggcatctgcggcagcgatgttcactactgggatcacggagctattgggcaatttgtagtcaaggaacccatggtcctcggccatgaatcttccggaatagtcacacaaattggatcagccgtcactagtctaaaagtgggcgaccacgttgcaatggagcctggtattccctgccgacggtgcgagccctgcaaagcgggcaagtacaacctctgtgagaaaatggcttttgccgcaaccccgccgtatgacggtactttggccaagtactacacgctgcccgaagacttctgttacaaactgcccgagtcgatcagcctgcccgagggtgcactcatggagcccctgggagtcgccgtacacatagtgagacaagcgaatgttactccgggtcaaaccgttgtagtctttggagctggtccagtgggtctattgtgctgtgcggtagccaaagctttcggtgcgatcagaatcatagccgttgatatccaaaagccaagattggattttgcaaaaaaattcgccgcaacagccacattcgagccgtcgaaggcccccgcgaccgaaaacgctacccgcatgattgcagagaatgaccttgggaggggtgctgatgtcgcgattgatgcttcgggtgttgagccgtcagttcacacgggtatccatgttctccgccccggtggcacctatgtacaaggtggcatgggtcggagtgagatgaatttccccatcatggcggcttgcactaaggaactgaatatcaagggaagcttccgatatggtagtggtgattataagctggcagtacaactcgtggcttctgggcagatcaacgtcaaggaactgattactggcattgtcaaatttgaagacgccgagcaagcttttaaggacgttaaaaccggaaaaggcattaaaacgcttattgctggccctggcgccgcataa

SEQ ID NO: 51494 - protein, 359 aa, Aspergillus nidulans FGSC A4
MSSQTPTAQNLSFVLEGIHRVKFEDRPIPKLKSPHDVIVNVKYTGICGSDVHYWDHGAIGQFVVKEPMVLGHESSGIVTQIGSAVTSLKVGDHVAMEPGIPCRRCEPCKAGKYNLCEKMAFAATPPYDGTLAKYYTLPEDFCYKLPESISLPEGALMEPLGVAVHIVRQANVTPGQTVVVFGAGPVGLLCCAVAKAFGAIRIIAVDIQKPRLDFAKKFAATATFEPSKAPATENATRMIAENDLGRGADVAIDASGVEPSVHTGIHVLRPGGTYVQGGMGRSEMNFPIMAACTKELNIKGSFRYGSGDYKLAVQLVASGQINVKELITGIVKFEDAEQAFKDVKTGKGIKTLIAGPGAA

SEQ ID NO: 51495 - DNA, 1068 bp, Gallus gallus
  CDS (1)..(1068)
atggcggcgacggggcagaacctggccgtggtagtgcaccgagccggggacctgcggctggagaaccgtccgatcccagaaccgggtcccaatgaggtcctcctgcggatgcattctgttgggatctgtggttccgatgttcactactggcagcatggtcggattggagattttgtcgtgaaggaccccatggtgttggggcacgaagcttccgggactgtcatcaaagtgggagcaggagtgacacatctgaaaccaggtgatcgtgtggccatcgagcctggtgtcccgagagaaacagatgagttctgcaaaactggccgctacaacctgtctccaaccatcttcttctgtgcaacgcctcctgatgatgggaacctgtgccgctactacaagcacagtgccagctactgctacaagcttccagatagtgtcacctttgaagaaggggcacttattgagccactttcggtgggaatccacgcctgcaaaagagcaggagtcactctgggcagcagagtcttcgtaagtggctcaggaccaattggccttgttaatgtgattatagccaagatgatgggtgcagcagcagtggtagttacagatttatctgcctctcgcctgcagactgccaaggagctgggggcagatttcaccattcagataaagaacgagaccccacaggaggtggctgccaaagtggaaagtctgcttggctgcatgcctgagataactgtggagtgtactggagtccaagcctgcatccaggccagcatttatgccactcgttctggagggaccctggtgctggtggggctgggccctgagatggtgaccgtgcccattgtgaatgctgcggtgcgggaggtggatatccgggggatattccgctactgcaacacgtggccagtggccatttccttgcttgcatccaaacggatcaacatcaagcccttggttacacatcgcttccccctggaaaaggctcttgaggcatttgagaccacaaagaggggcgaaggggtaaaaatcatgctgaaatgtgaccccactgatcagaacccctga

SEQ ID NO: 51496 - protein, 355 aa, Gallus gallus
MAATGQNLAVVVHRAGDLRLENRPIPEPGPNEVLLRMHSVGICGSDVHYWQHGRIGDFVVKDPMVLGHEASGTVIKVGAGVTHLKPGDRVAIEPGVPRETDEFCKTGRYNLSPTIFFCATPPDDGNLCRYYKHSASYCYKLPDSVTFEEGALIEPLSVGIHACKRAGVTLGSRVFVSGSGPIGLVNVIIAKMMGAAAVVVTDLSASRLQTAKELGADFTIQIKNETPQEVAAKVESLLGCMPEITVECTGVQACIQASIYATRSGGTLVLVGLGPEMVTVPIVNAAVREVDIRGIFRYCNTWPVAISLLASKRINIKPLVTHRFPLEKALEAFETTKRGEGVKIMLKCDPTDQNP

SEQ ID NO: 51497 - DNA, 1062 bp, Kluyveromyces lactis NRRL Y-1140
  CDS (1)..(1062)
atgttcagtgcagtgagaagtgtggtttccagtggcattaaaaccagtatcagaaccatgtctaccattccaggcgtgcaaaaagttgtgttaatcagagaaaatggtggcccagaagtgttaaagtacgaagaagattacccagttcctaagatcggtgccaccgatcttctaatcaagaacaaatacgccggtatcaacttcatcgaagtctatttccgtaaaggcatttacccaagtgaaaaaccttatgtgttaggtagagaagccgttggtgaagtggtcgctaaaggtgaccaagttgataagtacaacgtcggtgataaagttgcctacttgtctgcatcgactttcgctcaattcactaagtacccacagaatgggcatttgattaagctacctaaagatatctctgctgagaaggaaaaaatcatcgctggttcgttggttcaaggtttgaccccgttaactttcatcgacgaggcttataacgttcagaagggcgatttcatccttgtttatgctgctgcaggtggtgttgggttgatctttgatcaattgttgaaagcaagaggtgctagaaccattgccgttgcctctaccgatgaaaaactgcaattggctaaggaatatggtgcagagttcttaattaactctactaaagacgatatcgtcgagaaggttaaagaattcacaaatggggaaggtgtcgctgccgctttcgattctatcggtaaggatacgtttgaaaccactcttcaagttgttaagagaaaaggtactattgtctcctttggtaatgcttctggtgctgttccaccattttcaatcaacagattgtcgcccaagaatttgaagctagtgagacctcaattgttcgcctacgtggccgatcctagtgaatgggaacattactcttctgaattgatcagattaatcgattcaggtgaattgaagatcactatttcgaaggtttatcctttgaaagattacaaagaggctactgaagacttggaatctaggaagacagtaggtaagttgattttggagattccagaatag

SEQ ID NO: 51498 - protein, 353 aa, Kluyveromyces lactis NRRL Y-1140
MFSAVRSVVSSGIKTSIRTMSTIPGVQKVVLIRENGGPEVLKYEEDYPVPKIGATDLLIKNKYAGINFIEVYFRKGIYPSEKPYVLGREAVGEVVAKGDQVDKYNVGDKVAYLSASTFAQFTKYPQNGHLIKLPKDISAEKEKIIAGSLVQGLTPLTFIDEAYNVQKGDFILVYAAAGGVGLIFDQLLKARGARTIAVASTDEKLQLAKEYGAEFLINSTKDDIVEKVKEFTNGEGVAAAFDSIGKDTFETTLQVVKRKGTIVSFGNASGAVPPFSINRLSPKNLKLVRPQLFAYVADPSEWEHYSSELIRLIDSGELKITISKVYPLKDYKEATEDLESRKTVGKLILEIPE

SEQ ID NO: 51499 - DNA, 1074 bp, Debaryomyces hansenii CBS767
  CDS (1)..(1074)
atgacattgacttatcaaaacccgtcccttcaagttactaaagaccatagaatagaactcaaagaagcacctgttaaacctccattaaaaggtcaagttttaattcatgttagagctactggaatatgtggttcggacattcatttctggaaatctggatctattggtgatttgaaggtactagataactgtatactagggcacgaagctgcaggagacgtcgtggagattggagaaggggttacaaatgtctctgtaggagatagggttgccattgaaccaggtgtaccttgtggaaattgtttcttgtgtagtcaaggagattataatctttgtgaagatgttcaatttattggggttttcccttatcatgggtcgatgcaaagatatattactcataattcaaggtacgtttatcgtttacccgataatatgacatattcccagggtgccttagttgaaccaatatcagtcgcgtatcatggtatcgaacgagctaatttgaagctaggtgaaggggtactaattgctggtgctggcccaattggcttagtagctctacttttagcaaaagcttctggttgcactcccttatgtattacagatttaagcaaagaaaaattggaatttgccaaaactttggttcctcaagtaagaacatataaagttaatacgaagttatcaccacaagagaatgctaaggaggtcagaagtatatttggtgaccaagaatgtaatttccctcatgtcacattggaatgcacgggagttgagtcgagtataattacatgcgcttatgtcactagaagatcaggtacattaatggttattggagtgggaaaggatattattaataactttccattcatgaggttatcattagctgagattgatgtgaaattcattaacaggtaccacgattcatggccaactgttattagattactaagccacggtattattaatgctgatttgttaattacacatcggtttacattagagaacgccattgaggcactcacattatcatccgatgcttgtaatggtagcatcaaagttattattgaagattaa

SEQ ID NO: 51500 - protein, 357 aa, Debaryomyces hansenii CBS767
MTLTYQNPSLQVTKDHRIELKEAPVKPPLKGQVLIHVRATGICGSDIHFWKSGSIGDLKVLDNCILGHEAAGDVVEIGEGVTNVSVGDRVAIEPGVPCGNCFLCSQGDYNLCEDVQFIGVFPYHGSMQRYITHNSRYVYRLPDNMTYSQGALVEPISVAYHGIERANLKLGEGVLIAGAGPIGLVALLLAKASGCTPLCITDLSKEKLEFAKTLVPQVRTYKVNTKLSPQENAKEVRSIFGDQECNFPHVTLECTGVESSIITCAYVTRRSGTLMVIGVGKDIINNFPFMRLSLAEIDVKFINRYHDSWPTVIRLLSHGIINADLLITHRFTLENAIEALTLSSDACNGSIKVIIED

SEQ ID NO: 51501 - DNA, 1269 bp, Oryza sativa (japonica cultivar-group)
  CDS (1)..(1269)
atgtctatcacctccgcttcccgccgcgccggcgccgccgcgctccccatcctccgacgaatcggcggcgcgttccgccgccccttctcgtcggagccggacccggcatcctccccggggtaccacgtcgccggcgggcccagcttcatgcgcggcgcggtgttctgggagcccggccgccctctcaccctcgaggacttccgcatgccgcgccccaaggccggcgagctcctcatcaagaccaaagcttgtggagtttgccactccgatctccatgttctcaagggtgagctcccattctccagcccctgcgttgttgggcatgagatcactggggaggttgttgaccatggtactcacacccctgctgagatcatcaacaggttcccagttggcagtcatgttgtgggtgccttcataatgccctgtgggaattgcttctactgtgttaagggccaagaagatctgtgtgagtctttctttgcatacaaccgtgctaaaggaacgctatacgatggtcaaacccgattattccttcgtagcaatggaaagccagtgtacatgtatagtatgggtgggcttgcagaatattgcgttgtgccagccaacgcactagcagttcttcccaactctttgccatacacagagtcggcgattctaggatgtgccgtgttcactgcatacggcgccctgaggcatgctgctgaaatgcgtgctggggattcagtagctgtgattggagtcggaggggttgggtcaagctgtttacagatagccaaagcctttggagcttccgaagtcattgcagtggatgttcttgatgagaaactccagaatgctagaacacttggagcaacccatactgtaaatgctgcaaaagaagatgcagttgaaaagattaaggaaattactgatgggaggggtgtggatgtagctgtggaagcacttggtaaggcattgacattttctcagtgcgccaaaagtgtacgagatggaggcaaagctgttatgattggccttgctgccacaaatgtgatgggggaggtggatataacccgtcttgttcgccgacaggtgaagatcattgggtcgtatggtgcaagggccaggcaagatcttcctcagatagtcaagcttgcagagagtggggccttcaatcttaagaacaccatatcaaggaaatgcaagtttgaagaggcgaacagcgcctacgaggatcttgaccgtggcaagatcgttgggcgagccgtagttgagatcatgtcgtag

SEQ ID NO: 51502 - protein, 422 aa, Oryza sativa (japonica cultivar-group)
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVGAFIMPCGNCFYCVKGQEDLCESFFAYNRAKGTLYDGQTRLFLRSNGKPVYMYSMGGLAEYCVVPANALAVLPNSLPYTESAILGCAVFTAYGALRHAAEMRAGDSVAVIGVGGVGSSCLQIAKAFGASEVIAVDVLDEKLQNARTLGATHTVNAAKEDAVEKIKEITDGRGVDVAVEALGKALTFSQCAKSVRDGGKAVMIGLAATNVMGEVDITRLVRRQVKIIGSYGARARQDLPQIVKLAESGAFNLKNTISRKCKFEEANSAYEDLDRGKIVGRAVVEIMS

SEQ ID NO: 51503 - DNA, 1110 bp, Oryza sativa (japonica cultivar-group)
  CDS (1)..(1110)
atggggaagggagggaaaggagccgaggcggcggcggcggcggtggccggagccggtgaggaggagaacatggcggcgtggctggtggcgaagaacaccctcaagatcatgcccttcaagctcccgccagttgggccttatgatgtccgtgtccggatgaaggcagtgggcatctgcggcagcgacgtgcactacctcagggagatgcgcattgcgcatttcgtggtgaaggagccgatggtgatcgggcacgagtgcgccggcgtgatagaggaggtcggcagcggcgtgacgcacctcgccgtcggcgaccgcgtggcgctcgagcccggcatcagctgctggcgctgcaggcactgcaagggcggccgctacaacctctgcgaggacatgaagttcttcgccacccctcccgtccacggatccctcgccaaccagatcgtgcaccctggtgatctgtgcttcaagctgccggagaacgtgagcctggaggaaggcgccatgtgcgagccgctgagcgtgggcgtgcacgcgtgccgccgcgccgacgtcgggccggagacgggggtgctgatcatgggcgcggggccgatcggcctggtcaccctgctggcggcgcgcgcgttcggcgcgacgcgcgtcgtgatcgtggacgtggacgaacaccgcctctccgtggcccgatccctcggcgccgacgccgccgtgagggtgtcggcgcgcgcggaggacgtcggcgaggaggtggaacggatcagggcggcgatgggcggggacatcgacgtgagcctggactgcgccgggttcagcaagacggtggcgacggcgctggaggcgacgcgcggcggcgggaaggtgtgcctcgtcgggatggggcacaacgagatgacggtgccgctgacgtcggcggcgatcagggaggtggacgtggtggggatattccggtacaaggacacgtggccgctctgcatcgagttcctccgcagcggcaagatcgacgtgaagccgctcatcacccaccgattcgggttctcgcaggaggacgtggaggaggcgttcgaggtcagcgcccgtggccgcgacgccatcaaggtcatgttcaacctctag

SEQ ID NO: 51504 - protein, 369 aa, Oryza sativa (japonica cultivar-group)
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 51505 - DNA, 1029 bp, Parachlamydia sp. UWE25
  CDS (1)..(1029)
atgaaaggtttagtcaagaaaatatcagctcccggtctttggatggaaaatctgccaataccgtcgcatgtgaaagatgatgaagttctgattaaaacaattaaaacatccatctgtggcaccgatgttcatatttataaatgggatgcttgggcgcagaaaaatgttcctgtgcctttggtgattggtcatgaatttatcggtgaaatagcagaatttggaaaaaatgttaaaggatttaaaattggagaacgagtatgcggggaaggacatatcgtttgtaatcaatgcccaaattgccgcatgggtcgtaagcatgtctgcatgcacacgaaagggctaggttatcatatttctggctgctttgctgaatattttgttcttcctgcagaaaatgttttttctctacccccttccatttctgatgatttaggcgccatcttcgacccttacggaaatgctgtccatactacgctcgcctttaatcttattggtgaagatgttcttattacaggtgctggcccaattggaatcatggcagccgccattgctaaacaagctggtgcaagacatattgtcatcacagatgtaaacgattatcgtctagaccttgcaagaactatgggtgtctcgcatgctattaatgttaatcgagaatctttagataattttatgcaatctctaggaatcaaatatggctttacagttggacttgagatgtctggccatcctgacggactaaaaactttaacggaaaaaattcgacatggaggaaacatcgcattacttggcattctcccaccagctacttctattgactggaatttagttatttttaaaatgttaactttaaaagggatttatggaagagaaattttctcaacctggtatcagatggttcaccttctggaaattggcttaaatttagctcctatcattacccatcatttttcagttgataattttgaaaaaggatttgaagtgatgttatcaggccaatcaggtaaagtgattcttgattgggtttaa

SEQ ID NO: 51506 - protein, 342 aa, Parachlamydia sp. UWE25
MKGLVKKISAPGLWMENLPIPSHVKDDEVLIKTIKTSICGTDVHIYKWDAWAQKNVPVPLVIGHEFIGEIAEFGKNVKGFKIGERVCGEGHIVCNQCPNCRMGRKHVCMHTKGLGYHISGCFAEYFVLPAENVFSLPPSISDDLGAIFDPYGNAVHTTLAFNLIGEDVLITGAGPIGIMAAAIAKQAGARHIVITDVNDYRLDLARTMGVSHAINVNRESLDNFMQSLGIKYGFTVGLEMSGHPDGLKTLTEKIRHGGNIALLGILPPATSIDWNLVIFKMLTLKGIYGREIFSTWYQMVHLLEIGLNLAPIITHHFSVDNFEKGFEVMLSGQSGKVILDWV

SEQ ID NO: 51507 - DNA, 1047 bp, Listeria monocytogenes str. 4b F2365
  CDS (1)..(1047)
atgaaagctttaaaattatatggaaaaagagatttgcgttatgaagaagcggatatgccaacaatcgaacagccagatgatgtgattttgaaagtgaaaacggttgggatttgcggatctgatatttcgagatacagtaaacttggtccgtatgtaccaggaatggtgtggggacatgaattttcaggagaagtgattgaggttggtagtgaggttacagatattgagattggtgatagggctgccggatgcccagcactctattgcggagagtgtgaatactgtaaaaaaggcgaattcgcccgctgtcggaagctaacagtaatcggagcaagacatcccggagcctatgctgagtatatcaaacttccagcagaaaatgtagtaaaaataccagacgaattagattatgaagctgctgcacttgtcgagccttccgcagtggtcgttcatgggttttatcatacgaaattacaagcaggcgatgatgtcgtcgttgtcggaagcggcaatataggtttgctagcaattcaatgggcaaaagtttttggcgcaaaaagagttattgcaattgatgtagacgataaaaagttagctcttgcaaaagaagtaggagcagacgtcgttattaattctttaaaagaagatccattagaagtagtcgcagcacatacagatggtctaaacgctgatttagttgtagaagctgcgggatcacctattacatctgcccaagtttttgcctatgcgaaaaaaggtggaggcgtcgttttcctagggattccatacgccgatgtaacaatcgaacgtttctattttgaaaaaattgttcggagtgagcttactgtttggggctcatggaatgcaatttctgcaccatttccaggaaaagaatggcaaacaaccattcatttcctagccaataaacaaatcaacattgaaccaatgattacacatcgtctttcacttgctgaaggaccagaagtttttgagcgaatctatgaaagaaatgaatttttcgggaaagtattatttttcccagaataa

SEQ ID NO: 51508 - protein, 348 aa, Listeria monocytogenes str. 4b F2365
MKALKLYGKRDLRYEEADMPTIEQPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGAKRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 51509 - DNA, 1053 bp, Listeria monocytogenes str. 4b F2365
  CDS (1)..(1053)
atgagagcagctgtgttatacgagaataatgtaataaaagcagaacaaattgatgaagcgacttgtgggaaagatcaagttcgtgtcgaagtaaaagcagtcggaatatgcggatcagatattcataaaatgcagactcgctggaaatacccattgcctgctgtaatgggacatgaatttgcaggtgtagttacagaaattggtagcgaagtaacaaacgtagctattggtgaccgtgttgcagggattccgcttgagccttgtatggaatgtaattattgtaaagcgggcgactttgcattatgtgacaactaccggatggtgggatcacacttccacggcggatttgctgaaaatgtcgtcatgaaagccgacaatgtcatttctatcggcgaccttgattttgaagaaggtgcgatgattgaaccacttgctgtatcaatgcacggagtacttggtattcagccgagacttggcgatacggtgattgtcttcggaattggaaccatcggaatcttggttgtacaatgcttacttcttgcgggagtaaaagatattatcgcggttgatatcagtgataaaaaattagcagacgcgcgggaattcggttgtaaatacaccattaatccaaaaaacgaagacttaaaagaacgcgtttttgcttatacaaatggtcttggggcagatattgcactcgagtgtgctggttccaaaataacgcaagaacaatgccttcttgtaacgaagaaaaaaggtaaagttggttacttaggaatcgcctacgcagatgtgcttttacacgaggaagcttttgaaaatatttttagacgtgaacttacgctgaaaggtttttggaattcttactcggcaccatttccaggtgaggagtggcgtacgtcgattgaattcgtgaaacaaggtcgaattaaactgaaaccactaatttcgcatcgttataagctagaagaaacgaaagaagcgtttgatatgattctttccagagagcatgattataacaaagtgatgatattgccgcagaaaggtgacgattaa

SEQ ID NO: 51510 - protein, 350 aa, Listeria monocytogenes str. 4b F2365
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 51511 - DNA, 1053 bp, Bacillus thuringiensis serovar konkukian str. 97-27
  CDS (1)..(1053)
atgaaagcattactttggcataatcaacgtgatgtaagagtagaagaagtaccagaaccaactgtaaaaccaggagcagttaagattaaagttaaatggtgtggtatctgcgggacagacttgcatgaatatttagcaggacctatttttattccgacagaagagcatccattaacacatgtaaaagcaccggttattttaggtcatgagtttagcggtgaggtagttgaaatcggtgaaggcgttacatctcataaagtgggagaccgcgtcgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcaccatattccagatgaaatgacgtatgaacaaggtgctcttgtagaaccagcagcagtagcggttcatgcagtacgtcaaagtaaattaaaagaaggggaagcagtagcagtctttggttgtggtccgattggacttcttgttatccaagcagcgaaagcagcaggagcaactcctgttattgcagttgaactttctaaagaacgtcaagagttagcaaaattagcaggtgcggattacgtattgaatccagcgactcaagatgtattagctgaaattcgcaacttaacaaatggtttaggtgtaaatgtaagctttgaagtaactggtgttgaagtagtacttcgtcaagcgattgaaagtacaagtttcgaaggacaaactgtaattgttagtgtatgggaaaaagacgcaacaattactccaaacaatcttgtactaaaagaaaaagaagtggttggtattttaggataccgtcatatcttcccagctgttattaaattaattagctctggtcaaattcaagcagagaaattaattacgaaaaaaatcacagtagatcaagttgttgaagaaggatttgaagcacttgtaaaagataaaacacaagtgaaaattcttgtttcacctaaataa

SEQ ID NO: 51512 - protein, 350 aa, Bacillus thuringiensis serovar konkukian str. 97-27
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 51513 - DNA, 1044 bp, Staphylococcus aureus subsp. aureus MRSA252
  CDS (1)..(1044)
gtgaaagctttgaaattatatggcgtggaagatttacggtatgaggataatgaaaagccagtcattgaaagtgcgaatgacgttattgttaaagtacgagcgactggaatatgtggttcagacacgtcacgatacaaaaaaatggggccatacattcaaggtatgccatttggtcatgaattttcaggtgttgtagatgccattggaagtgatgttacgcatgttaatgtaggcgacaaagtgacaggttgcccagccataccttgttatcaatgcgagtattgtttaaaaggtgaatatgcacgatgtgaaaagttgttcgtcattggctcatatgaacctggatcgttcgcggaatatgtcaaattgccagcgcaaaatgttttaaaggtaccagacaatgttgattacattgaagcagcaatggttgagccatcagccgttgttgcgcatgggttttataaatcgaatatacaacctggtatgactgttgcagtaatggggtgtggcagtataggattgttagctattcaatgggcacgaatatttggtgctgcgcatatcatcgctatagatatagatgcgcataaactagatattgctacatcattgggcgcacatcaaaccatcaattcaaaagaagaaaatcttgagaaattcatcgaaaatcattacgccaatcaaatcgatatagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccggggaaagagtggacggcaaccttacattatatgaagacgaaagatattaatgtaaagcctattatttctcattttttaccgttagaaaaaggcccggagacatttgataaattagttaacaagaaagaacgatttgataaagtcatgtttacgatttattag

SEQ ID NO: 51514 - protein, 347 aa, Staphylococcus aureus subsp. aureus MRSA252
MKALKLYGVEDLRYEDNEKPVIESANDVIVKVRATGICGSDTSRYKKMGPYIQGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDIAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 51515 - DNA, 1086 bp, Erwinia carotovora subsp. atroseptica SCRI1043
  CDS (1)..(1086)
atgaaagcattggcaaaattgcgaccggaagaaggtatctggatgatggatgcccccatgccagaactcgggcataacgacatcatgattaaaatccgcaaaagcgcgatttgcggaacggatgtgcatatctataactgggacgaatggtcgcagaagaccattcctgttccgatggtcgtcgggcatgagtacgtgggtgaaattgtcgcgattggtcaggaagttaacggttttcatattggcgaccgggtttctggtgaggggcatattacctgtggctactgccgtaactgtcgcgctgggagacgtcacttatgccgcaatgccatcggtgtcggggtaaaccgtcccggttcgttcgcggaatatctggtgattcctgcctacaatgcatttcgcattcccgacaatatttctgacgaattggccgctattttcgaccctttcggtaacgccgtgcataccgcactttccttcgatttagtgggggaagatgtgttgattacaggggcagggccgataggcatgatggccgcggcggtgtgccgtcacgttggtgcaaggaatgtcgtgattaccgatgtgaatgcgtaccgtctggagctggctagtaaaatgggggcaacgcgtgccgtcaatgtggcagaggaaaagctgactgacgtgatgatagaactgggtatgaccgagggatttgatattgggttagaaatgtcgggcgcaccatcggcctttcgcgcgatgctgaaagcgatgaatcacggtgggcgaatcgccatgctgggcattccgcacgaaccgatgtcgattgactggggcgaagtgatttttaagggattgtttattaaaggcatctacggacgggaaatgttcgaaacctggtacaaaatgtctgcgctgattcagtccggactggatttgtccccgattatcacccaccgctttcacattgatgagtttcaaaaagggttcgatgccatgcgctcaggtcagtcgggcaaggttattctcaattgggatgaggcatatactcgtcatacttcgagttgcatgtgcgttgactgcgctactcggcatacttaa

SEQ ID NO: 51516 - protein, 361 aa, Erwinia carotovora subsp. atroseptica SCRI1043
MKALAKLRPEEGIWMMDAPMPELGHNDIMIKIRKSAICGTDVHIYNWDEWSQKTIPVPMVVGHEYVGEIVAIGQEVNGFHIGDRVSGEGHITCGYCRNCRAGRRHLCRNAIGVGVNRPGSFAEYLVIPAYNAFRIPDNISDELAAIFDPFGNAVHTALSFDLVGEDVLITGAGPIGMMAAAVCRHVGARNVVITDVNAYRLELASKMGATRAVNVAEEKLTDVMIELGMTEGFDIGLEMSGAPSAFRAMLKAMNHGGRIAMLGIPHEPMSIDWGEVIFKGLFIKGIYGREMFETWYKMSALIQSGLDLSPIITHRFHIDEFQKGFDAMRSGQSGKVILNWDEAYTRHTSSCMCVDCATRHT

SEQ ID NO: 51517 - DNA, 1002 bp, Propionibacterium acnes KPA171202
  CDS (1)..(1002)
atgcatgcgatcaccgtccgcccgaccgacaagacagactccaaggggcgccatcgtcccggccctgaatgcattgaatggaccgaggtccccacaccgaaacctggccctggggaagtcctcgtcaaggtgaaggcggccggcattaaccgcggcgacctgctgcagcgccaaggcctctacccgccgccgaagggcgtctcggaaaccatgggcctggaggttaccggcgtcatttcctccctcggtcaagacgtcacaggctggtccgaggatgatgaggtcattgcgctgctagccggcggtggttacgccgagtacgtcatcgtcccggcaggccaactcctgcccatccctgagggcatcgacccggtaaccgcgtcaacactcattgaggttactgccactgtcatctccaacatggaccacgtcggcctagccaggggtgaaaccttcctcgtgcacggcggcgccggcggcatcggccagttcgctatccaatacgccaagtcgctcgaatgcacggtcatcaccacctgtggcaccgccgagaagcaggagttctgccgcactctcggtgccgacgtcgccctcgactatcacgaggactgggttgccggcgtcaaagacgctacggggggtcgtggtgccgacgtcatcctcgacgtcatgggcgctaagtacctcgacctcaacgtcgatgctctcgctattggcgggcgtctcgacatcattggaatgcagggcggcatcaagggagagctcaatattgcaaagcttctcaacaagcgcgccctcgtcaccgctactagcctgcggcctcgcccccttgaagaaaaagccaagatttgccagcgggtccgtgaggttgcatggccgctctacaccaatggcagcatcaaacccgccccagttgagtccttccccatgtccgaggcaggcagggcccacgaacggctcgaatccggtgaggtgctcggcaaggttgcactgaccctctga

SEQ ID NO: 51518 - protein, 333 aa, Propionibacterium acnes KPA171202
MHAITVRPTDKTDSKGRHRPGPECIEWTEVPTPKPGPGEVLVKVKAAGINRGDLLQRQGLYPPPKGVSETMGLEVTGVISSLGQDVTGWSEDDEVIALLAGGGYAEYVIVPAGQLLPIPEGIDPVTASTLIEVTATVISNMDHVGLARGETFLVHGGAGGIGQFAIQYAKSLECTVITTCGTAEKQEFCRTLGADVALDYHEDWVAGVKDATGGRGADVILDVMGAKYLDLNVDALAIGGRLDIIGMQGGIKGELNIAKLLNKRALVTATSLRPRPLEEKAKICQRVREVAWPLYTNGSIKPAPVESFPMSEAGRAHERLESGEVLGKVALTL

SEQ ID NO: 51519 - DNA, 1026 bp, Yersinia pseudotuberculosis IP 32953
  CDS (1)..(1026)
atgaaagcactttctaaactgaaagcagaagaaggcatttggatgaccgatgtgccacagccagagctgggtcacaacgatatcatgatcaaaattcgcaaaacggctatctgtggtactgacgtacatatttataattgggatgaatggtcacaaaaaaccatccccgtacccatggtcgttggccatgaatatgtcggtgaagtggtggccattgggcaggaagttaaagggtttaatattggtgaccgggtgtctggtgaaggccatattacctgtggtcactgccgtaactgccgtggtggtcgtacccacctttgtcgtaatacggtgggtgttggcgtgaatcgccctggttcgtttgccgaatatttggtgatccctgcttttaacgcgttcaagatcccagacaatatttctgatgagcttgcggctatttttgaccccttcggcaatgcagttcataccgcgttatcttttgatttagtcggcgaggatgtgttggtctccggggctggcccaattggtattatggccgccgcagtctgtaagcatgtgggtgctcgtcatgttgtcatcactgatgtgaatgaatatcgccttgatctggcccgtaaaatgggcgtgacccgtgccgttaacgtcagcaaagagaacctaaatgacgttatgacggaattgggcatgaccgaagggtttgatgtgggcttggagatgtcaggtgctcccccggctttccgttcattacttaattcaatgaatcatggtggtcgtatagcgatgctgggaataccgccatctgatatgtcgatcgactggaatcaggttatctttaaggggctgtttataaaggggatttatggccgtgagatgttcgaaacctggtacaaaatggccgcgttgattcaatctggtttggacttaactccgatcattacccaccgtttccctattgatgaattccagcaagggtttgacgccatgcgttcgggtaaatcaggcaaagtggtattaagctgggattag

SEQ ID NO: 51520 - protein, 341 aa, Yersinia pseudotuberculosis IP 32953
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVITDVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 51521 - DNA, 1056 bp, Symbiobacterium thermophilum IAM 14863
  CDS (1)..(1056)
gtggcagaaacgatgcgtgctttgcgaaaactggaagctggtcctggcgcgacactgcaggaggttccgatcccgaccatcggcccccgcgacgtcctggtgaaggtccgggcggcctcgatctgcggcacggactaccacatctacacctgggatccgtggtccgcgggccgggtgaagccgccgctcaccattgggcacgagctggccggtgaggtggtggccgtcggccgcgaggtcaccgcatgcaaggtgggcgactacgtctctgccgaaacgcacattgtttgcaaccgctgtccccgctgccacatgggggagtaccacctctgcgagaacacgaagatcctgggggtggacacggacggcgccttcgccgagtacgtcgcggtgccggagcagaacatctgggtgaacgacaaggacatcccctttgagctgcagtcgattcaggagccgctgggcaacgcggtccacacggccctgaacggcgacctcaccgcccggtccgtgctgatcaccggctgcggccccatcggcatcatgtcggtccccgtggccaagatggccggcgcggagatcgtgatggcgatggacatcaacgaataccggctgcagctggcgggccagctgggggccgacgtgctcatcaaccccacgaagcaggatccggtcgaggtggtgcgcagctacacccgcggctacggcgccgacgtggtgctggagatgtcgggtaaccccaccgccatccggcaggggctgaaggccgcccgcaacggcgcccgcatctcgctcctcggtctgcccggccggccgctggagctggacctggcagcggacgtgatcatgcggggcctggtgctgcagggcatcaccggccgccggatgtggcagacctggtatcaggtgcgttccctctaccgggccgggctggcggagcggctgcggccgctggtgacgcaccggatgccgctggagcagatcgacgccgccatggagctcatgggttccggccagagcggcaagatagtgctggtgcctgacctgaaggcgtga

SEQ ID NO: 51522 - protein, 351 aa, Symbiobacterium thermophilum IAM 14863
MAETMRALRKLEAGPGATLQEVPIPTIGPRDVLVKVRAASICGTDYHIYTWDPWSAGRVKPPLTIGHELAGEVVAVGREVTACKVGDYVSAETHIVCNRCPRCHMGEYHLCENTKILGVDTDGAFAEYVAVPEQNIWVNDKDIPFELQSIQEPLGNAVHTALNGDLTARSVLITGCGPIGIMSVPVAKMAGAEIVMAMDINEYRLQLAGQLGADVLINPTKQDPVEVVRSYTRGYGADVVLEMSGNPTAIRQGLKAARNGARISLLGLPGRPLELDLAADVIMRGLVLQGITGRRMWQTWYQVRSLYRAGLAERLRPLVTHRMPLEQIDAAMELMGSGQSGKIVLVPDLKA

SEQ ID NO: 51523 - DNA, 1023 bp, Bacillus cereus ZK
  CDS (1)..(1023)
atgaaagccgcagtgtggtatggtgaaaaagatattcgtatcgaggaaagagaaacaaaagagttacaacccaatgatgtaaaagttaaagtggcatgggctggtatttgtggttctgatttacatgcatacttgcatccggattcagtaccaatgaataagaatacggtactcggacatgaattttctggtgaaattgtagaagttggttctcatgtaacaaaatttaaagaaggggacagagtatgtatttatccaatgatgcttaaagatccttcaaatgctgaaactgaacgttttatcactttagacgcagtaggtgcacaaatcgacggagggtttgctgaatacgtgatacttccacaaaaaacgatttttaaaattccagataatttatcactagaagtagcagcaatggtagaaccagcagctgtatcattccaatcaattaaggattcaaatgttgaagaaggagatactgttgttgtctatggagcaggtcctattggactatttgctgttttaggtgcaaaagctgctggtgcttctaatattattgttgttgatttatttgatagtcggcttggcaaagcaaccgaagtgggtgcgacgcatacttttaatgctaaagaagtaaaccctgtagaagaaattcgtaaattattcccagatggagcggatgtgacaattgaagctgcaggtgttgagtcaacatttaatcaagccattcaatcaactaaagttcgtggcacaatgatggttatcagcttccatactcaagatatccaatttaatgctcctgcttccttactctttagtggcgtaaaattaatgggatctgtggggtacagtaatgaaacttataatgaagtcattcaattacttgctaatggaagattacctgcgcaatccattattacaagtaaagttgatatagataatattgctgaacaaggttttgaagcgttaattcatgataaagcgcaagcaaaaattttagttaagttaagcggcgcacattaa

SEQ ID NO: 51524 - protein, 340 aa, Bacillus cereus ZK
MKAAVWYGEKDIRIEERETKELQPNDVKVKVAWAGICGSDLHAYLHPDSVPMNKNTVLGHEFSGEIVEVGSHVTKFKEGDRVCIYPMMLKDPSNAETERFITLDAVGAQIDGGFAEYVILPQKTIFKIPDNLSLEVAAMVEPAAVSFQSIKDSNVEEGDTVVVYGAGPIGLFAVLGAKAAGASNIIVVDLFDSRLGKATEVGATHTFNAKEVNPVEEIRKLFPDGADVTIEAAGVESTFNQAIQSTKVRGTMMVISFHTQDIQFNAPASLLFSGVKLMGSVGYSNETYNEVIQLLANGRLPAQSIITSKVDIDNIAEQGFEALIHDKAQAKILVKLSGAH

SEQ ID NO: 51525 - DNA, 1041 bp, Bacillus licheniformis ATCC 14580
  CDS (1)..(1041)
ttggacggaaatatgaaagcgcttatcaagaagccgggggagccgggcgccagcttcgagctcgtcccgattccgaagatcgacaaacacgaggtcctgatcaaagtcaaagccgcatcgatttgcggaaccgatgtccatatttataattgggatgaatgggcgaaaagcagggttaaaccgccttatgtgttcggccacgaattttccggcgaagttgttcaagtgggggaaaatgtgactacggtaaaagaaggggagtatgtttcggcagaaacgcacatcgtttgcggaaagtgcctgccgtgtttgaccggaaaagagcatgtctgcaaaaaaacgctgattctcggtgtcgatacagacggctgttttgctgaatatgtcaaaatgcccgccgcaaacatttggaaaaacccggccggcatgcctgaggatctcgcttctattcaagaaccgctcggaaatgccgtgcatacggttctgacgggaatgacggctggagtgaaagtcgctgtcgtcggctgcggaccgatcggactgatggccgtggcagttgcaaaagcgtctggggcggcgcaggtgatcgccatcgataaaaatgaatacaggctcgaccttgcattgcaaatgggggcaaccgatatcatctccgttgaaaaagaagatccgctcaaaaatgtaagcgctttaacaaatggtgaaggggcggacttggtttgcgaaatgtcaggccatccgacggcaatccgccaaagtttaaaaatggcggcaaacggaggacgggttcatgtcttaagcttgcctgagcatcccgtatgcatcgacatgacaaatgatatcgtctttaaaggattgacggtccaaggaattaccggccgcaaaatgtttgaaacgtggagacaggtcagcggtctcctccaatccggcacgattcaaatcaagcctgtcatcactcaccgtttcccgatggaagagtttgaaaaaggctttgaactgatgagaaaagggcaatgcggcaaagtcgtactgataccgtag

SEQ ID NO: 51526 - protein, 346 aa, Bacillus licheniformis ATCC 14580
MDGNMKALIKKPGEPGASFELVPIPKIDKHEVLIKVKAASICGTDVHIYNWDEWAKSRVKPPYVFGHEFSGEVVQVGENVTTVKEGEYVSAETHIVCGKCLPCLTGKEHVCKKTLILGVDTDGCFAEYVKMPAANIWKNPAGMPEDLASIQEPLGNAVHTVLTGMTAGVKVAVVGCGPIGLMAVAVAKASGAAQVIAIDKNEYRLDLALQMGATDIISVEKEDPLKNVSALTNGEGADLVCEMSGHPTAIRQSLKMAANGGRVHVLSLPEHPVCIDMTNDIVFKGLTVQGITGRKMFETWRQVSGLLQSGTIQIKPVITHRFPMEEFEKGFELMRKGQCGKVVLIP

SEQ ID NO: 51527 - DNA, 7641 bp, Burkholderia pseudomallei K96243
  CDS (1)..(7641)
atggttaacactaagatcgcaattatcggtgcgtcttgccgattccccggcggcgttgccgggctggaagaatactggcaattgctcaagagcgaacgcgacgcagtaaccgaaatcccgccggagcgcttcggcacggacttttaccggcacccgtccaaacgcgaaccgggcaagagctacacgttctcggccggcgttctcgataacgttgcgggtttcgacgccgcgttcttcggcatttccccgcgcgaagccacccagatggacccgcagcagcgcttgctgctcgaactcgcgtgggaagcgttcgaggatgcgggggtgcgcccggccgacatgcgcggcagcaattgcggcgtctatgtcggtgtcgcgggcaccgactacggcaaccgcagcatggacgatctgaacgcgatcgatccgtattcggcgaccggcaacacgctgagcatcgcgtcgaaccgcgtgtcctacctgttcgacctgcgtggcccgagcatgtccgtcgacacggcctgctcgtcatcgctcgtcgcacttcatcaggctgtccaggcgctgcagtccggcgaagcggaaacggcgctcgccggcggcgtcaacctgctgctgcacccgttcggcttcgtcagcttctccaaggcttcgatgctctcgccgcgcggccgctgccgcgcgttcgatgcgaccggcgacggctacgttcgcgcggaaggcggtgcgttcgtgctgctcaagccgcttgaccgcgcgatcgccgacggcgacacgatccatgcggtgatcgccggctccggcgtgaattcggtcggccactcgccgggcggcatcagcgtgccgggcgcggcggcgcaggcggcgctgctgcgtagcgtctacgcgcgcgcgggcgtcgatccgcagtctctcgcctacctggaggcgcatggcaccggcacggcggtcggcgatccgatcgaggcgcgcgcgctgatcgacgtcgtgtcgggcgcacgcccggcggaccgcccgctgctcatcggctcggtgaagaccaacatcggccacctcgagacggcatccgggatggcaggcctgctgaaggccgtgctgtgcctcaagcatcgcgcggtgcctcgctcgctgcatttctccattcccaatccggccatcgatttcgacggcgggcgcctgcgtgtcgtcgatcgctatatgccgctcgaagccggcaatgcccccctgaccgtcggcgtcaactcgttcggtttcggcggaacgaacgcgcacattgtgctgaccgaggcgccggtgtcggcggtggtcgcggacgatgtgccgacgagcgcgacgcaagccgcccgcgcaccgtccgcgctcgtgctgactgcgcgcagcccgaacgcgctcggcgcgctcgcgaaccgctatctggcggcgctcgagaacggcggcgactggcaggcgctggccgcggcggccgcgcgtcgtcgccaatggctcgagcatcgcgcgatcgtcgcgccggccgacgcggccgaaggccgcgcggcactcgcggcgctggcgcggccggcgccggaaggcgggccgagctgcgtgacgaccggccgggcgcccgccgacgcgccgcgcactgcgcttgtcttctcgggcaacggttgccagtgggtcgggatgggcaacgcgctctatgccgaggacgccgtcttccgtgcggcgctggacgaggtcgacgcgctgtggtgcgccgacggcagcccgtcgctggtcgacgtgatgcgcggcggcccgggtgcgcaatggctggccggtgcgggcgccgaatggctcgccgcgacggagaacgcgcagccgctgctgttcgcgatccaggtcggcatgatccgcgtgatcgatgcgcgcggcatgcgctacgacgcggcaatcggccacagtgtcggcgaagttgccgcggcgtgggtaacgggcgcgttgtcgctcaccgacgcagtgcgcgtgatcaagattcgcagccgcgcgcaggcgatgacgcgcggctgcggccggatggcggccgtcggtatcggcgacgcggcggcgcgcgagctgatcgcgcgccacgggctggcgcgccgtgtcgagatcgccggcgtcaacagccccgatgcggtgacgctcgcgggcgagccgcagggattgcaggtgctggaggctgcgctgcgcggcagcggcaagttcttccagatgctggatctcgactacgcgttccacagcagccacatggaccgcatcgagccggtcgtattggccggactggccggcttgcggccgcaaccgggcaacggcgcgttcgtatcgactgtgaccggcggcgcgctcgccggcagcgaactcgatgcgcgctactggtggcgcaatatccgcgagcccgtgcgcttcggcgacggcatcgcccatctgatcgaacagggtgtccggctgttcgtcgaggtctcgccgcattcgatcctgcgcacctacgtgaagcaggcgctcgcggcggccggcgtgaccggcgtggcgctgccgacgctcaagcgcgatcacggcagcgcggcgacgctgcggcaagcgattctcgcggcgatcgcgcatggcgcgagcgtcgatccagaccgcttcgcgccgggcgcgtcgcgtgccgcgttgccgtcctatccgtggcagcgcgagcgcttctggctgacgccgaccgtcgaaggctacggcctcgtcaaccgccgccgcgaacatccgctgcttggctatcgcctgcacgaacacgcgttcgcgtgggaaaaccagctcgatccggcgaagctgccgatgctcgccgaccacgtcgtggatggcggcgtggcgtttccgggcgccgggtacgtggaaatggcgctcgccgcggcgtgcgccttcttcgatacgccggatgcggcgctcgagaacgtcgagattcgcatgccggtcgtcttccagccgcagcaggcgaagctgttccggctcgtgatcgagccgcgcaccgcgaccttcacgatcgagacgcgcgaccggatgtccgacggcgcatggacgctgaacgtgacggggcgaatgctggaaagcggcaacgcgctcggcgcggcgggcgtcgtgccgtccgacatgctcgagcgcctgctcgcgctgccggccgcccacggcgacatgctgtacgcgaacacggcggcgatcggcctcggctacgggccggcgtttcgctgggttcgcacggtgcgggtcgccgaaggcgacgacgcggcactcgccgacgtcgccgcgccggacgcatgtggtgacgcgcgcacgctgtccgcttatcggttgcatccggcgctgatggacagcgggtttcatccgctgttcgcattgctcgccgcgcacgcgcgcgacggcgagcatccggcctacgtgccggtgcagatcggccgggtcgactatctgcgcggcgatacggtcgcccgcgtgctcgcgcggatcgaccggcgcagcccgcattcgatcgtcgcgcattttgaattcctcgacgcgcagggcgcgatcgtcgcgcggctcggcgcttgccggtttcggcgcgtcgatctcgtcggccgccggcagaacctgcccgcgcgcttcgtctaccgtctcgaagcaatgccgctgccgggcgatgtcgacgcagccggtttgccggcgcccgacgcgctgctcgcacgagccgtcgcgcggctcgatgccggacacgacggccggcgtacgcggcatctgaccgaaatcctgccgttgctcgacgtgctggcgagcctctacgtgcttcaggcattcgatgcgctcggcgcattcgccggcacgtggcggccggcgcacgggtgcgcggcgctggccgcgcgtcttgcggacatgctcgtcgaggacggtctggcgcatcgtgacggcgatcgtctcgtgcgcgacgacgcggcatgcgcggcgctgccgccactcgacgaattgtggcgcgggctgctggccgagtcgccggcgcacgtggccgagctcacgctgctcgcgcattgcggctcggcgttgccgggcgtgctgagcggcgcgaaggacggcacacgtctgctgtcgccgaccgggcacagtctggtcgagcatctcctcgcggcctcgccgacctggcagcacgtgtatgcgctgctgacggcgagcgtcgagcaggcggtcgacgcgtggcaaccggcgcgccggttgcgcgtgctcgaactgggggcgacggacggcgatgtgctgcagacgctcggcatgcatctcgcgcccgcgcgctgcgatcacacgatcgccgcgacggccggtcaattggccgggttcggcgccgatgcgcaagcggcggtgacgacggtggcgctgcagccgggcgaacggctgtcgctggcggccgacgaagccgggccctacgacgtgatcgtcgcgaatcgcgcgttgagcggccgtcgggacgtggccgacgcgctgaacgcgatgcggtcgtggctggccccgggcggattgctgctgcttgccgagtcgcgccgcggccgtttctccgacatcgtgttcggcatgcaggcgccatcgacgcaaaccgatgcgcccgcaccgctcgcgccggcggatctcgaggcggcgctcgcgcacgcgggttacgtcggcgtcgtgcggcatgtcgagcagtcgctcgatctggaaggcacgccgatgttcgtcatcgcgcgcaatcccgcaagcgccgttgccgcaccgagcggcggcgattcgagcgatctcgatacgctcgcacgcagcgagcaatggctcgtgctgcacgcaccggatgtcgtcggcggtttcggggcgcggctggccgacgcgctggcgcatgcgggctatccggccgatatcgtggagatcacgcatgcggccgatgcgattgcgtcgttgccggccgggcagccggcgcatgtcgtgttctgcgcgccggaaacgccgctcgccgaggcggcgacgggcgacgacctgatggccacgcaacgcaatggcgtgatcgcgctggcggcattggttcgcgtgctcggcgcgcagccgaacgcaaccacgcggctgaccatcgtcacgcgcggcggcgcgccgtttgccgggaccgcgcatgcgcatccggagcaggcgacgctctggggcctcggccgcgtgctggcgaacgagcatcccgaactcgcgtgccgcctgatcgatatcgactgcgcggcggatcggattcccgaggcgctgattcgcgagctgaccggtgcggcgctcgaggaagaagtcgttctcggcgcgcacgggcggcgggtgccgcgcatgctcacggccgcgcaggacgccgcgcgcaacgatggcgcgatcgcgcgcgcagccgtgctcgcgttcgacgcgccgggttcgttgcgcaatctcgaatggttcgcgttggccgaaagcgcgctgggcgcggacgaggtggaaatcgagcccgttgcaacgggcctgaattttcgcgacgtgatgtatgcgatggggctgttgtccgacgaggcggtcgagaccggcttcgcgggcgcgacgatcggcatggagctgtccggccgcgtcgtgcgggtgggcagcgccgtgacggaattcgcgccgggcgacgcgattctcgggttcgcgccggcctcgttcgcgacgcgtgtcaggacgcgcgcgcaggcgatcgcgccgaaacccgagcgcctgtcgttcgaggaggcggcgaccgtgccgaccacgttcttcaccgcgtattacgcgctcgtcgaactcgcgcggctgcgccgcggcgagcgcgtgctcgtacatggcggcgcgggcggcgtcgggatcgcggcgatcctgctcgcgcgctacttcggcgcggaagtgttcgcgacggccggcagtgacgagaagcgcgagttcgtgcgcctgctcggtgccgaccacgtgctcgattcgcgcagcctggcgttcgcggacgagattcgcgcgatgacgggcggcgagggcatcgacatcgtgctgaattcgctcgccggcgaggcgatggtgcgcagcatcgacacgttgcgcccgttcggccgtttcctcgagctcggcaagcgcgatttctacgaaaacagccatatcgggctgcggccgtttcgcaacaacatcagttacttcggcatcgatgccgaccagttgatgggcgcgctgcccgagctgaccgcgcgcctgttcggcgacgtgatggggctgttcgcggcgggcgtgctgcatccgctgccgtatcgcgcgtttcccgccgaacgggccgaggacgcgttccgctacatgcagcaggcgcgccagatcggcaaggtgctcgtgacctatccgtgcggcacgccggcgccgacgcacggagccgcgcgcgccgattcgctcgcgctcgatccgcatggcgcgtacctggtggtcggcggcacgggcgggctcggtttcgcgagcgcgcgctggatggtcgagcgcggcgcacgccgattgacgctggcgagccgttccggcgaactcgccgtcgcggcgcgcgacgaaatcgagtgctggcgagccacgctcggcgtcgcggtcgacatcgtgtcgtgcgatgtgaccgacgcggcggcggtcgatgcgatgattgccgcgatcgtccggcgcgatatcccgctcaagggcgtgctgcattccgcgatggcgatcgacgacgggctcgtgcgcaatctcgacgatgcgcgcatggccgctgtgctcgccccgaaggtggcgggcgcgtggaacctgcatcgcgcgacgcgttcgctgccgctcgacctgttcgtggtctattcgtcggcgacgacctatctcggcaatccggggcaatcgaactacgtcgcggccaacagcttcctcgaggcgctcgtcgagcatcgccgcgcggcgggattgcccggtacgttcatggcatgggggccgctcgaggacgtcggcttcctcgcgcgccatgccgatacgcgcgaggcgctgcagtcgcgcatcggcggcgcctcgatcacgtccggcgaggcgatgatcgcgctcgagcgcgcgctggtcgcgggcgcggccggcgaagcggtggtccggctcgactggcacgccgtcgcgcgcggcatgccggccgcgaaggcgcgccggtattcgctgctgcaatcgcatgcgaacggcggcgatgcgcgcgacggtggcacgcagttgcgcgaagaggtgctcgcgctgccccgcgatgaagcgatcgcgctggttgccgggacgctgcaggcgcagatcgcacggattctgcacatgacgcccgatcgcatcgcgctcgacaaatcggtgctcgacatgggcatggattcgctgatggggatggagcttggtctcgcggtcgaggaggcgttcgaggtcaagctgtcggtgatggcgattgccgagggcgcatccgcgatgacgctggccgggcgcatcgtcgattcgatcggcgcatcggcggatgccggcgccggcgccgccgccgactccgcgcacgaggccgtcgctgcgctcgccgcgaagcatgcgatcgacggcgacgcgcgcgcggtgctcgatatccggccggcgcccgtggcaggccaggtgtcgccgacgctggaggtcgcgcgatga

SEQ ID NO: 51528 - protein, 2546 aa, Burkholderia pseudomallei K96243
MVNTKIAIIGASCRFPGGVAGLEEYWQLLKSERDAVTEIPPERFGTDFYRHPSKREPGKSYTFSAGVLDNVAGFDAAFFGISPREATQMDPQQRLLLELAWEAFEDAGVRPADMRGSNCGVYVGVAGTDYGNRSMDDLNAIDPYSATGNTLSIASNRVSYLFDLRGPSMSVDTACSSSLVALHQAVQALQSGEAETALAGGVNLLLHPFGFVSFSKASMLSPRGRCRAFDATGDGYVRAEGGAFVLLKPLDRAIADGDTIHAVIAGSGVNSVGHSPGGISVPGAAAQAALLRSVYARAGVDPQSLAYLEAHGTGTAVGDPIEARALIDVVSGARPADRPLLIGSVKTNIGHLETASGMAGLLKAVLCLKHRAVPRSLHFSIPNPAIDFDGGRLRVVDRYMPLEAGNAPLTVGVNSFGFGGTNAHIVLTEAPVSAVVADDVPTSATQAARAPSALVLTARSPNALGALANRYLAALENGGDWQALAAAAARRRQWLEHRAIVAPADAAEGRAALAALARPAPEGGPSCVTTGRAPADAPRTALVFSGNGCQWVGMGNALYAEDAVFRAALDEVDALWCADGSPSLVDVMRGGPGAQWLAGAGAEWLAATENAQPLLFAIQVGMIRVIDARGMRYDAAIGHSVGEVAAAWVTGALSLTDAVRVIKIRSRAQAMTRGCGRMAAVGIGDAAARELIARHGLARRVEIAGVNSPDAVTLAGEPQGLQVLEAALRGSGKFFQMLDLDYAFHSSHMDRIEPVVLAGLAGLRPQPGNGAFVSTVTGGALAGSELDARYWWRNIREPVRFGDGIAHLIEQGVRLFVEVSPHSILRTYVKQALAAAGVTGVALPTLKRDHGSAATLRQAILAAIAHGASVDPDRFAPGASRAALPSYPWQRERFWLTPTVEGYGLVNRRREHPLLGYRLHEHAFAWENQLDPAKLPMLADHVVDGGVAFPGAGYVEMALAAACAFFDTPDAALENVEIRMPVVFQPQQAKLFRLVIEPRTATFTIETRDRMSDGAWTLNVTGRMLESGNALGAAGVVPSDMLERLLALPAAHGDMLYANTAAIGLGYGPAFRWVRTVRVAEGDDAALADVAAPDACGDARTLSAYRLHPALMDSGFHPLFALLAAHARDGEHPAYVPVQIGRVDYLRGDTVARVLARIDRRSPHSIVAHFEFLDAQGAIVARLGACRFRRVDLVGRRQNLPARFVYRLEAMPLPGDVDAAGLPAPDALLARAVARLDAGHDGRRTRHLTEILPLLDVLASLYVLQAFDALGAFAGTWRPAHGCAALAARLADMLVEDGLAHRDGDRLVRDDAACAALPPLDELWRGLLAESPAHVAELTLLAHCGSALPGVLSGAKDGTRLLSPTGHSLVEHLLAASPTWQHVYALLTASVEQAVDAWQPARRLRVLELGATDGDVLQTLGMHLAPARCDHTIAATAGQLAGFGADAQAAVTTVALQPGERLSLAADEAGPYDVIVANRALSGRRDVADALNAMRSWLAPGGLLLLAESRRGRFSDIVFGMQAPSTQTDAPAPLAPADLEAALAHAGYVGVVRHVEQSLDLEGTPMFVIARNPASAVAAPSGGDSSDLDTLARSEQWLVLHAPDVVGGFGARLADALAHAGYPADIVEITHAADAIASLPAGQPAHVVFCAPETPLAEAATGDDLMATQRNGVIALAALVRVLGAQPNATTRLTIVTRGGAPFAGTAHAHPEQATLWGLGRVLANEHPELACRLIDIDCAADRIPEALIRELTGAALEEEVVLGAHGRRVPRMLTAAQDAARNDGAIARAAVLAFDAPGSLRNLEWFALAESALGADEVEIEPVATGLNFRDVMYAMGLLSDEAVETGFAGATIGMELSGRVVRVGSAVTEFAPGDAILGFAPASFATRVRTRAQAIAPKPERLSFEEAATVPTTFFTAYYALVELARLRRGERVLVHGGAGGVGIAAILLARYFGAEVFATAGSDEKREFVRLLGADHVLDSRSLAFADEIRAMTGGEGIDIVLNSLAGEAMVRSIDTLRPFGRFLELGKRDFYENSHIGLRPFRNNISYFGIDADQLMGALPELTARLFGDVMGLFAAGVLHPLPYRAFPAERAEDAFRYMQQARQIGKVLVTYPCGTPAPTHGAARADSLALDPHGAYLVVGGTGGLGFASARWMVERGARRLTLASRSGELAVAARDEIECWRATLGVAVDIVSCDVTDAAAVDAMIAAIVRRDIPLKGVLHSAMAIDDGLVRNLDDARMAAVLAPKVAGAWNLHRATRSLPLDLFVVYSSATTYLGNPGQSNYVAANSFLEALVEHRRAAGLPGTFMAWGPLEDVGFLARHADTREALQSRIGGASITSGEAMIALERALVAGAAGEAVVRLDWHAVARGMPAAKARRYSLLQSHANGGDARDGGTQLREEVLALPRDEAIALVAGTLQAQIARILHMTPDRIALDKSVLDMGMDSLMGMELGLAVEEAFEVKLSVMAIAEGASAMTLAGRIVDSIGASADAGAGAAADSAHEAVAALAAKHAIDGDARAVLDIRPAPVAGQVSPTLEVAR

SEQ ID NO: 51529 - DNA, 1053 bp, Nocardia farcinica IFM 10152
  CDS (1)..(1053)
gtgaaagcactgacctacgcggggccgcaagcgatttcgtgcaccgaggtggacgatccggccctgccgggcccggacggcgcgatcgtgcgcgtgacggcggccgggatctgcggcagcgatctgcacatctacggaggtcacggcttcaccccgggcaccgggtacggcgtcgggcacgaggcggtcgggcaggtcgtggagctcgggccgcaggcgcacgggttgtcggtcggcgaccgggtgctggtgccggcctccgcgggctgcgaccggtgcgggaactgccgggccggcgtcgtggcggcgtgtgcgcggcagccgctgccggtggacgcctgctacgggctgggcggggcactggccggtgcgcaggcgcagctgctggcggtgccgcacgccggcggcaacctggtccggttgccggacgcgatcggtgacgaggcggcggtcgtgctcaccgacaacgcccccaccgcctggtacggcgcccggcgcgcacggatcgccccgggcgacacggtggtggtgatcggtctcggtccggtcgggctgatggccgtgcaggccgcgttcgtgatgggggcggcccgggtgctcggcgtcgacctggtcgccgaccggcgcgcccgcgccgccgcactcggcgcggaaccggtcgaggacgacgatcccaagcaggccgtgcgcgagatgctcggcggcggcggcgccgacgtcgcggtggaggccgtgggcgccgacgccaccatcgcgctggcgaccgccgtggtcggccatcgcggccgggtggccgtcgtgggcgtcagccagaaccgggcgttcccgttccatctgccgctcgcgcaggtcaaggaactcgagttccacatcggcctgtgctcggtgcagtacgaactccccgccctgctgagtctcacggccgcgggcaggctacgccccgaggtggtggtgtcgcaccggctgccgatgtcggccggggcgcgggcctaccggatgttcgccgaccgcgccgacgacgtgtgcaaggtcgtgctcgacccgtggcgatga

SEQ ID NO: 51530 - protein, 350 aa, Nocardia farcinica IFM 10152
MKALTYAGPQAISCTEVDDPALPGPDGAIVRVTAAGICGSDLHIYGGHGFTPGTGYGVGHEAVGQVVELGPQAHGLSVGDRVLVPASAGCDRCGNCRAGVVAACARQPLPVDACYGLGGALAGAQAQLLAVPHAGGNLVRLPDAIGDEAAVVLTDNAPTAWYGARRARIAPGDTVVVIGLGPVGLMAVQAAFVMGAARVLGVDLVADRRARAAALGAEPVEDDDPKQAVREMLGGGGADVAVEAVGADATIALATAVVGHRGRVAVVGVSQNRAFPFHLPLAQVKELEFHIGLCSVQYELPALLSLTAAGRLRPEVVVSHRLPMSAGARAYRMFADRADDVCKVVLDPWR

SEQ ID NO: 51531 - DNA, 984 bp, Photobacterium profundum SS9
  CDS (1)..(984)
atgaatgaagtagacaagcctgaaatgggccataatgatctacttattcgtattaagaaaaccgctatttgtggtacagatgtacatatctacaactgggatgaatggtcacaaaagacgattccagttccaatggttgtaggtcatgaatatgttggcgaagttgttggtattggccaagaagttcgtggttttacaatcggtgatcgtgtgtctggtgaaggtcatattacatgtggtcattgccgtaattgtcgtggtggtcgtacacacctttgtcgtaatacgacaggcgttggtgttaaccgtgatggcgcatttgctgagtttttggttattcctgcattcaatgcgttcaagatccctgcaggtatctctgacgatctagcatcaatcttcgacccgtttggcaatgctgttcatactgcattatcattcgatcttgttggtgaagatgtgctaattacaggtgctggtcctattggtattatggctgctgctgtcgctaaacacgttggtgcacgccatgttgtgattaccgatgtgaacgaataccgtctagatcttgctcgtaaaatgggcgtgactcgcgctgttaacgtagcaaacgaaaaacttgaagatgtaatgtctgaacttggcatgacagaaggttttgacgttggtttagaaatgtctggcgtaccatcagcatttaacggcatgctagctagcatgaaccacggtggtaaagtggcgttgttgggtattccaccatcagacatggcagtagattggacccaagttatctttaaaggtttggttattaaaggtatctacggccgtgaaatgtttgaaacttggtacaagatggcaagcttgattcaatcaggcttagatctaacaccaattatcacgcaccattacaaaattgatgatttccaaaaaggctttgacatgatgcgttcaggcatgtcaggtaaagttattctcgattgggaataa

SEQ ID NO: 51532 - protein, 327 aa, Photobacterium profundum SS9
MNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 51533 - DNA, 1032 bp, Haloarcula marismortui ATCC 43049
  CDS (1)..(1032)
atgcgaactgctgtactggtagaaccaactgagttcgagctggaggaccgtcccagaccgtcgcccggccccgatgaggtacttgtagccgtgcgagacgtgggtatctgtggctccgacgtccactactacgaacacggtcgtatcggggactacgtcgtggaagacccgctcgtcctcgggcacgagagcgccggtaaggtcgtcgaagtcggcgagaacgttactgatcacgaaccgggggaccgcgtcgcgctcgaacccggcgttccgtgccgtcgctgtgcccactgcaagcgcggcgactaccacctctgtgaatcagttcggttcatggcgacgccgccacacgacggcgcgttcacagagtacgtctcgtggccggccgatttcgcctacacgcttccggagtccgtctctacagctgaaggggcactgtgtgaaccgctttcggtcggaatccacgcctgccgccgcggtagcgtcggaaccggagatacagtgctgataaccggagcgggacctatcgggctgatggtgcttgaggccgcgcgcgccgcaggcgcgacggacataatactgaccgacgttgtcaaggaaaaactagagttcgccgaaaagcggggagcagacctgacagtcgacgttaccgagacggatctcgatacggcagtcgccgagtacacggacggcgtcggtgctgatgtggtcgtcgaagcctccggtgcggagccgtcgatcaagtcgacaatcgacgtggtccgtcggggcggcacggtcgttctggtgggtctggccagcgaagcggaggtcccattcgacgtgctggaactcatcgacaacgaggtcgacgtccacggctccttccggtacaagaacacctacgacgcggctgtcgacctgttggccgacggcgaagtcgacgtcgagggcataatcgacttcgaatccgaacttgaagacatcgacgacgcgttccgccgatccatggagccgactgtggtcaagggcatgatatcacttgattcgtaa

SEQ ID NO: 51534 - protein, 343 aa, Haloarcula marismortui ATCC 43049
MRTAVLVEPTEFELEDRPRPSPGPDEVLVAVRDVGICGSDVHYYEHGRIGDYVVEDPLVLGHESAGKVVEVGENVTDHEPGDRVALEPGVPCRRCAHCKRGDYHLCESVRFMATPPHDGAFTEYVSWPADFAYTLPESVSTAEGALCEPLSVGIHACRRGSVGTGDTVLITGAGPIGLMVLEAARAAGATDIILTDVVKEKLEFAEKRGADLTVDVTETDLDTAVAEYTDGVGADVVVEASGAEPSIKSTIDVVRRGGTVVLVGLASEAEVPFDVLELIDNEVDVHGSFRYKNTYDAAVDLLADGEVDVEGIIDFESELEDIDDAFRRSMEPTVVKGMISLDS

SEQ ID NO: 51535 - DNA, 990 bp, Haloarcula marismortui ATCC 43049
  CDS (1)..(990)
atgtccgccagaacgctgtactttaccggcgggaagtcggttcgggttgacgaagaagcggtgcctgaccccggaccatcggaggtccgtgttcgaaccgaactctcaggaatcagtcccggaacagagctgttggtgtaccgtggtgaggtcgattcggaactcgcgaccgacgagacgatcgacgcccttgatggtacgttctcgtatccactgcagtacggctacgccgctgtcggctgtgtcacggccgtcggggacgcggttgacgacgactggctcgaccagcgtgtgttcgcgttcaacccacacgaaagccacttcctcgccgagccgtcgtcgcttattcccacgacgttaccgccggagcaggcggtgttcatcccgaacgtcgaagcagcggtcaacttcgtgatggacgctcgaccgcgtatcggggctcgggttgtcgtcttcggtcaggggccggtgggcctgttgacgaccgggctgctggccgattttccgctggcgtcgctcgtgacggtcgatccctgtgcgggccgccgtcggctctcggaagcgctcggggcagaccgctcagtctctcccgggaatctcgatgacgacgacgccgacatcacgttcgagctctcggggaacccaaccgcactcgacagagcgatcgacgccactggctatgccggtcaggtcatcgtcggttcgtggtacggctcaaaggatgtctcgcttgacctcggacatcacttccaccggagccacatccgccttcgcagcagtcaggtgagccgcatcgatccggatcacgccgaccgctgggacaaggaccggcggctggatgtcgtccggtcgtggctgagcgacactgacctctcggcgctactgacacatgagatcgatatcgagcgtgcagccgaagcgtatcaactgctagagagccggccagacgacgctgtacaggtagtgttgacgtacaacggacacccgtga

SEQ ID NO: 51536 - protein, 329 aa, Haloarcula marismortui ATCC 43049
MSARTLYFTGGKSVRVDEEAVPDPGPSEVRVRTELSGISPGTELLVYRGEVDSELATDETIDALDGTFSYPLQYGYAAVGCVTAVGDAVDDDWLDQRVFAFNPHESHFLAEPSSLIPTTLPPEQAVFIPNVEAAVNFVMDARPRIGARVVVFGQGPVGLLTTGLLADFPLASLVTVDPCAGRRRLSEALGADRSVSPGNLDDDDADITFELSGNPTALDRAIDATGYAGQVIVGSWYGSKDVSLDLGHHFHRSHIRLRSSQVSRIDPDHADRWDKDRRLDVVRSWLSDTDLSALLTHEIDIERAAEAYQLLESRPDDAVQVVLTYNGHP

SEQ ID NO: 51537 - DNA, 1047 bp, Haloarcula marismortui ATCC 43049
  CDS (1)..(1047)
atgacgatgcaagccgttcagttcgacagtcacggcgaccgtgatgtgcttgagtatggcgagtttcccgaccccgaaccgggccgcgatgaggtggtcatcgatgtgaaggcggccgcgctgaaccacctcgacatctggacgcggcgcgggctccccggcatcgacctcgagatgccacacattccgggcagtgacgccgcgggtgttgtcgacgaggtcggcgacggtgtctcgcggttcgaaccgggcgaccgggtggccgtcctcgccggcaagagcggcggcggcgacgagttcagtcgcaagggtgaccagacactcgcaccggacttccacatcatcggcgagcacgtccggggtgtccacagcgagtacgccgccgtgccggcggagaatctcaccccagtccccgagggcgtcgactgggagacagccgccgcatcgccgctggtgttccagaccgcctggcggatgctgcgcgaccgcggcgacctgaaggccggcgagtcggtactggtgctcggtgcgtccggcggtgtgggccacgccgccgtccagattgccgaccacgccggcgctgaggtgttcgcgaccgccagcagccaggagaaactcgattacgccaaagaactgggtgcggaccatacaatcaactacgaggagacggacttcgcgagcgagattcgggacctgaccgacggccgcggcgtcgacatggtcgttgaccacatcggcgcacagacctggcaggactcgctcaagagcctcgtcaagggcggccgggtcgtcacctgcggggcgacgactggcggcaacccggaaacggacatcaaccgcatcttctggaatcagttgcaggtcatcggctcgacgatggccaccccagggcaggctgatgaagtgctggatctggtctggcagggtgagatggagccgcgagtccgcgagacgctgccgatgagcgaaatcgcccgggcacacgagataatcgaggaccgcgaaggcttcgggaaggtcgtggtcgttcccgacagcgaactgtag

SEQ ID NO: 51538 - protein, 348 aa, Haloarcula marismortui ATCC 43049
MTMQAVQFDSHGDRDVLEYGEFPDPEPGRDEVVIDVKAAALNHLDIWTRRGLPGIDLEMPHIPGSDAAGVVDEVGDGVSRFEPGDRVAVLAGKSGGGDEFSRKGDQTLAPDFHIIGEHVRGVHSEYAAVPAENLTPVPEGVDWETAAASPLVFQTAWRMLRDRGDLKAGESVLVLGASGGVGHAAVQIADHAGAEVFATASSQEKLDYAKELGADHTINYEETDFASEIRDLTDGRGVDMVVDHIGAQTWQDSLKSLVKGGRVVTCGATTGGNPETDINRIFWNQLQVIGSTMATPGQADEVLDLVWQGEMEPRVRETLPMSEIARAHEIIEDREGFGKVVVVPDSEL

SEQ ID NO: 51539 - DNA, 993 bp, Silicibacter pomeroyi DSS-3
  CDS (1)..(993)
atgaaagccatgctgagcaccgccgtgggcggccccgaaacgctggaactgaccgagatggcagacccggcgccgggcaagggagaattgttggttcgggtgcatgcggcgggggtgaactttcccgatacgctgatgatccgcgacctctaccaaatgaagccgccccgcccctttgcccccggcggcgagatcgcgggagaggttctggcggtgggcgaaggtgtcagcggctatacacccggcgaccgggtgttggcactgacggggtttggcggctttgccacccatctgacggtcaaggccaacgtcgcggtgaaaatccccgatgccatgccgtatgacgaggccgcctgtttcatcttcacctatggcacctcgcatcacgcgctcaaggatcgcgcggcgctgcaaccgggcgagaccctgctgatcctgggtgccgcgggtggcgttggtgccgccgcgatcgaactgggcaaggccgctggcgcgcgggtgatcgccgccgtctcatcgcaggagaaggccgaattctgtcgtcagatcggtgcggacgagacgttggtttacccgcgcgagctggaccgcgacggacaaaaggcgctgtcgggcgagatcaagaaactggccgggggcgacggggtcgatgtggtctatgacgcggtgggcggcgcctatgccgaaccctgcctgcgcgcgatggcctggcaggggcgctatctggtcgtcgggttcccggcgggtatccccagcatcccgctgaacctgaccctgctcaagggctgccagatcgtcggcgtgttttggggggcgtcggtgttccgcgaccccaagggccatgcggcaaacgtgggcgacctgttccgtctgtacgccgagggccggatcaagccgcagatctgtgcgcgctttccgctggatcaggcgggcgcggcgctggagatgatgcaggaccgcaaggtgctgggcaaagtggtgattaccccctga

SEQ ID NO: 51540 - protein, 330 aa, Silicibacter pomeroyi DSS-3
MKAMLSTAVGGPETLELTEMADPAPGKGELLVRVHAAGVNFPDTLMIRDLYQMKPPRPFAPGGEIAGEVLAVGEGVSGYTPGDRVLALTGFGGFATHLTVKANVAVKIPDAMPYDEAACFIFTYGTSHHALKDRAALQPGETLLILGAAGGVGAAAIELGKAAGARVIAAVSSQEKAEFCRQIGADETLVYPRELDRDGQKALSGEIKKLAGGDGVDVVYDAVGGAYAEPCLRAMAWQGRYLVVGFPAGIPSIPLNLTLLKGCQIVGVFWGASVFRDPKGHAANVGDLFRLYAEGRIKPQICARFPLDQAGAALEMMQDRKVLGKVVITP

SEQ ID NO: 51541 - DNA, 1050 bp, Bacillus clausii KSM-K16
  CDS (1)..(1050)
atgagagcagccgtatggtacaaagagaaagatatccgtgtagaggaaagagaacctgcgaaactaggcgcccgtgatgtaaaagtgcgcgtagcgtgggctggtatttgcggaagtgatcttcacgaatacttgcacggtccggtgattatcccaaaaggagaacctgatcctattactggcggcgaatcaccccttacattagggcacgaatttgccggtgtgattgaggaagtaggaacggaggttaaatcctttcagaagggggatcgtgtcgtcattaatccactctttacctacggaaataagcctgcttcagttgatctctatgatggtttctcgtttgctggtcttgctacagatggaggatttgctgattttgcagtactcccagagaaaaatgtatataaattgcctgataacttaacgttggaagaaggagcactcgttgagccgatggcagtggcggtgcaagcggtaaaagaagccgattttaaatttggacaatcagttgccgtctttggggcggggccaattggtttgtttaccattattgctgctaaggctgcaggggctagcaaaatcatcgtttttgatttatcggaagaaaggctggaaaaagcacggcttgtcggcgccacccatacatttaattctggcgcagtcgatcccgttgaaaaagtaaaaagccttgtcccagatggggtcgatgtaagctttgaagtggctggcgtaaatgcaacatttaaccagtctatccaagtagccaagtcacggggagtcgtcgtcgttgtttccatttttgccaaaccgattgagttcaatccaatggatcttacgggcagtggcgttaagattacgtccactttggcttatgaaccggaagtattccaaacgactattgatttaatggcagagggagccttaaatccgaaaggcgttataaccgatcggattgagctagaaaatattgtagagtctgggtttgaagtgttaacaaacgataaacgccaggctaaaattctcgtgaaacttagcggcgagaaataa

SEQ ID NO: 51542 - protein, 349 aa, Bacillus clausii KSM-K16
MRAAVWYKEKDIRVEEREPAKLGARDVKVRVAWAGICGSDLHEYLHGPVIIPKGEPDPITGGESPLTLGHEFAGVIEEVGTEVKSFQKGDRVVINPLFTYGNKPASVDLYDGFSFAGLATDGGFADFAVLPEKNVYKLPDNLTLEEGALVEPMAVAVQAVKEADFKFGQSVAVFGAGPIGLFTIIAAKAAGASKIIVFDLSEERLEKARLVGATHTFNSGAVDPVEKVKSLVPDGVDVSFEVAGVNATFNQSIQVAKSRGVVVVVSIFAKPIEFNPMDLTGSGVKITSTLAYEPEVFQTTIDLMAEGALNPKGVITDRIELENIVESGFEVLTNDKRQAKILVKLSGEK

SEQ ID NO: 51543 - DNA, 1086 bp, Bacillus clausii KSM-K16
  CDS (1)..(1086)
gtggaggctttaaatttatatggtgctggcgacatccgttttgagcaatcgccaaagccaacgatcatgaatgacaatgaagtcatcgtccgtgtagaaacggcagggatttgcggatcagacttatcccgttataaaaaactagggccttatatttcggggacgacgtttggccatgaatgttcaggtacgattgaggaagtaggcagcaatgtcagccatttaaaggagggaatgcgagtcgccgtatgccctgctctcccgtgcggcgactgcacccaatgtcggcaaggggctttttcacggtgcccgtcgctaaccgttatcggagctgtccagccaggggcgtttgcagaatatgtgaagttgcctgctgaaaatgtcctcccattgccgaatgaaattgatgctgatacggcggcgttcattgagccggctgctgttgtggcacacggtttttacaagacggcgattgaaccaggagcagatgtggccattatcggctgtggaagcatcggcttgcttgcgattcaatgggcaaaattgtttggtgccagatatgtatacgcaattgatatcgatgaacaaaaattaaaagtggctaaagaacttggcgccgaccaacgagtgaatccacttgatggcccagtgcatgaacaaattcacgatttaactgctggagaaggggtagatgtggcgattgaagcagcggggactccgattacttctgcccaagcattagcattgccaaagaaaggcggagaagttgtttttcttgggattccatacggggacgtgacaatcgagcgtttttactttgaaaaaattgtacgaaacgaattgcgtgtccatggttcttggaatgggctgtccgccccatttccgggcaaagaatggaaaacggcgattcattctttgcaaacaggagcattgcaagtaaacccactcattacacaccggttgcctttatccgatgggccatttgtttttaaggaaatggccagcggttcccctgggtatataaaaacgttgctttatccagggaaaacagggcaaaaagaacgagccatcaatcatctgaaatag

SEQ ID NO: 51544 - protein, 361 aa, Bacillus clausii KSM-K16
MEALNLYGAGDIRFEQSPKPTIMNDNEVIVRVETAGICGSDLSRYKKLGPYISGTTFGHECSGTIEEVGSNVSHLKEGMRVAVCPALPCGDCTQCRQGAFSRCPSLTVIGAVQPGAFAEYVKLPAENVLPLPNEIDADTAAFIEPAAVVAHGFYKTAIEPGADVAIIGCGSIGLLAIQWAKLFGARYVYAIDIDEQKLKVAKELGADQRVNPLDGPVHEQIHDLTAGEGVDVAIEAAGTPITSAQALALPKKGGEVVFLGIPYGDVTIERFYFEKIVRNELRVHGSWNGLSAPFPGKEWKTAIHSLQTGALQVNPLITHRLPLSDGPFVFKEMASGSPGYIKTLLYPGKTGQKERAINHLK

SEQ ID NO: 51545 - DNA, 1029 bp, Bacillus clausii KSM-K16
  CDS (1)..(1029)
ttgaaagcattagtgaaaacagcacctggatttggacatgttgaactccaaaacaagcccgaacctgctccaggggaaaagcaagtcaaaattaaagtcaaatatgcgggcatttgtgggtccgatatccatacgtatgaaggccattataaagtggccttcccggtaacacttggccatgaatttgcaggagaaattgttgaagtcgggcctggcgttcagtcttttaaagtaggggatcgggtcacctctgaaaccactttctccatttgtgggcaatgtccctattgccaaacgaaagactacaacctttgcagcgagcgcaaagggcttggtacccagcaagatggcgggttcgctgagtatgtacttgcccgggaagagagtttgcatcttttgccagacaatgttgatttccgttcagcagcgatgacagaaccgttagcctgcacgcaccatgcgctagcgaaaacaacaatcaacgcaggcgatttgtgtgttgtcattggtcctggtccgattggcttgctcgctgcccaagccgcgaaaagcaaaggtgcaaaagtcatgataaccggcctcaatcatgacaaggttcgccttgagaaggcgcgtgcccttgggattgattatgttgtcaatggcgaagaaacggatgtcggcgaagtcgtaaatgaactgacaaacggctacggagccgatgtggtgcttgaatgttcaggcgccgtaaaagcagccaatcaagggctaaagttattgcggaaaaaggggcagtatagccaagtcggcatttttgctgcatcagaaattccctttgacctcgaaacaattattcagaaagaaatacacgtcattggcagcagaagccagaagccagctgattgggaaccttctttgatgcttttaaaaacaggcaatgtcaacgctcgtgccctcgtcacccatgaatacgagcttcatcaatgggaggaagcttatcaggcgataaaaagtggagaagcgataaaggttcttttgaaaccagagtaa

SEQ ID NO: 51546 - protein, 342 aa, Bacillus clausii KSM-K16
MKALVKTAPGFGHVELQNKPEPAPGEKQVKIKVKYAGICGSDIHTYEGHYKVAFPVTLGHEFAGEIVEVGPGVQSFKVGDRVTSETTFSICGQCPYCQTKDYNLCSERKGLGTQQDGGFAEYVLAREESLHLLPDNVDFRSAAMTEPLACTHHALAKTTINAGDLCVVIGPGPIGLLAAQAAKSKGAKVMITGLNHDKVRLEKARALGIDYVVNGEETDVGEVVNELTNGYGADVVLECSGAVKAANQGLKLLRKKGQYSQVGIFAASEIPFDLETIIQKEIHVIGSRSQKPADWEPSLMLLKTGNVNARALVTHEYELHQWEEAYQAIKSGEAIKVLLKPE

SEQ ID NO: 51547 - DNA, 1035 bp, Bacillus clausii KSM-K16
  CDS (1)..(1035)
atgaaagctgtttttgtagacgatgcagaaaaaattaacatcaaagaaatcgacataccggtcgtgaaggacaatgacgtgctcattaaagtggccgtggccggtatttgtggatcggacattcatacgtataaaggattgcacccgtttcgaaaaccgcctgtcgtcattggtcatgaagtggctggcgaagttgtgagcgttggccaagcggtaaaacgtgttcaagttggagaccgggtaacggttgaaccgcaaattggcacgggagagagcgaaggcgtaatgacaggccaggcgaacttgtccgataagcgtttggctcctggcatgggcgattggcttgggacaatggctgaatacttcgtctctcctgaggcgcaagtgattaagctgccggatgcggtcagttatgaaaaaggggtgttagttgagccgttggcggttggcgtccatgctgcacgtaaagggggtatccaaccaggggaccgtgtcgcaattttaggtgctggaccgattggcttgttgacgcttatggcggtaaaagcgaaaggtgcttcacacgttgtggtgaccgatgtgttagactactcccttgatgttgccaaacaaatgggggcaacggccgcgattaatataaagggcaagccggattggattgaggaagcaaaaagtaaagtcggccggtcattcgataaagtgctaattaccgctggcgtgccaggcatcattaatgattcattgaacttattaaaaaaagggggacgtgctgtaacggtcgcgatgtttcatggccaacaagattttgatgtggaacaactacagcaaaatgaaaaagaaattgttggctgcatgacatacaatcgtcccgatacggaagaagcgttggatatcatcgccaaaggtgcgcttccagttgaaaaagtgatttctcatcaattgtcttacgaacaggctgacaaagggtttgaaatggtcgataaaaagcaagacaactctgtaaaagtgattgtttcatttgaacaggagggctaa

SEQ ID NO: 51548 - protein, 344 aa, Bacillus clausii KSM-K16
MKAVFVDDAEKINIKEIDIPVVKDNDVLIKVAVAGICGSDIHTYKGLHPFRKPPVVIGHEVAGEVVSVGQAVKRVQVGDRVTVEPQIGTGESEGVMTGQANLSDKRLAPGMGDWLGTMAEYFVSPEAQVIKLPDAVSYEKGVLVEPLAVGVHAARKGGIQPGDRVAILGAGPIGLLTLMAVKAKGASHVVVTDVLDYSLDVAKQMGATAAINIKGKPDWIEEAKSKVGRSFDKVLITAGVPGIINDSLNLLKKGGRAVTVAMFHGQQDFDVEQLQQNEKEIVGCMTYNRPDTEEALDIIAKGALPVEKVISHQLSYEQADKGFEMVDKKQDNSVKVIVSFEQEG

SEQ ID NO: 51549 - DNA, 918 bp, Magnetospirillum magnetotacticum MS-1
  CDS (1)..(918)
atgtcccacaccctgcccgagaccatgcgccagatccgctttcagggcgcgggcggcccggaggtgatcgcggtcgagaccgtgccgctgccgaagccgggtgcgggccaggtgctggtcgaggtggtcgcggcgggggtgaaccggcccgacatcatgcagcgccagggcagctacccgccaccgaagggcgcgaccgagattccgggcctggagatcgccggccgcatcgccgctcttggcgagggcgtgaccggattctccgtcggcgacgaggtctgcgccctcgtgatcagcggcggctatgccgagttcgcggtggccgaaatcgggcaggtgctcaggaagccggaatcgctctcgctggtggaggcggccgggctgcccgagaccgtcttcacggtctattccacggtgatccagcgcgggcgcctgcagaagggcgagaccttcctggtccatggcgggtcgagcggcatcgggaccacggcgatccagatcgccaagcagcacggcgcccgcgttctcaccaccgccggctcggccgagaagtgccggttctgcgaggagctgggggcggatgccgccatcaattaccgcgaggcggatttcgccgaggaggtgaagcgactcaccgacggcaagggcgtcgacgtgatcctcgacatggtgggcgccgcctacctctcgaggaacatcgcctccctggcggtggagggccgcctcgtccagatcgcgttcatgcagggttacaaggcggagagcctcaccctcaccccgatcatgctcaagcgcctgaccatcaccggcgcgaccctgagggcccaggccaaggaggccaaggccgccatcgccgagggcctgaagcgggatgtctggccgctcgtcgaagcgggcaagatccgcccgatcgtgtag

SEQ ID NO: 51550 - protein, 305 aa, Magnetospirillum magnetotacticum MS-1
MSHTLPETMRQIRFQGAGGPEVIAVETVPLPKPGAGQVLVEVVAAGVNRPDIMQRQGSYPPPKGATEIPGLEIAGRIAALGEGVTGFSVGDEVCALVISGGYAEFAVAEIGQVLRKPESLSLVEAAGLPETVFTVYSTVIQRGRLQKGETFLVHGGSSGIGTTAIQIAKQHGARVLTTAGSAEKCRFCEELGADAAINYREADFAEEVKRLTDGKGVDVILDMVGAAYLSRNIASLAVEGRLVQIAFMQGYKAESLTLTPIMLKRLTITGATLRAQAKEAKAAIAEGLKRDVWPLVEAGKIRPIV

SEQ ID NO: 51551 - DNA, 993 bp, Magnetospirillum magnetotacticum MS-1
  CDS (1)..(993)
atgctgcccgagaccatgacctgcgtcgaaatttccacccccggcggtcctgaggtactggtccccatcacccggccattgccccagcccaaaccgggcgaggtgctgatcaaggtggccgcggcgggcatcaaccgtcccgacgtgctgcagcgcgccggggcctatccagccccgcccggagcctcagacctgcccggcctggaagtggcaggcaccatcgtcgccctgggcgaaggcgtcacctcccccgctctgggggccgaggtctgcgccctggcccccggcggcggctatgcccagtactgcaccgtcgatgcgcgtcactgcctgcccattcctaagggctatgacatgatccgtgccgccgccctgcccgagaccttcttcaccgtctggcacaatgtggtcgagcgcggtcagttgaagtcaggcgatcgctttttggtccatggcggcgcgggcggtatcggcaccaccgccattcaactggccaaagccttgggcgccaccgtcttcgccaccgccaatggcgaagcgaaatgcacggcctgccgcgaactcggcgccgatatggccatcgattattccactgccgacttcgtcgaggtgatccgggccgagaccaagggcaaggggatcgacgtcatcctcgacatggtgggcggcgactatatggcccgcaatatcaagagcctggccgccgatggccgtctggtctccatcgctttcttaaggggcagcagcgccgagctgaacatgatgcccgtgatgctcaaacgcctgaccctgaccggatcgacgctgcgtccccaatccaacgacgccaaggcccgcatggcccggggtctggccgagaccatctggccgcttttggataagggggccattgcgcctttgatccacgccgttttccctctggccgaggccgccaaggcccatgccctgatggaaagcaacgcccatatgggcaagatcgtgctgcaggtttga

SEQ ID NO: 51552 - protein, 330 aa, Magnetospirillum magnetotacticum MS-1
MLPETMTCVEISTPGGPEVLVPITRPLPQPKPGEVLIKVAAAGINRPDVLQRAGAYPAPPGASDLPGLEVAGTIVALGEGVTSPALGAEVCALAPGGGYAQYCTVDARHCLPIPKGYDMIRAAALPETFFTVWHNVVERGQLKSGDRFLVHGGAGGIGTTAIQLAKALGATVFATANGEAKCTACRELGADMAIDYSTADFVEVIRAETKGKGIDVILDMVGGDYMARNIKSLAADGRLVSIAFLRGSSAELNMMPVMLKRLTLTGSTLRPQSNDAKARMARGLAETIWPLLDKGAIAPLIHAVFPLAEAAKAHALMESNAHMGKIVLQV

SEQ ID NO: 51553 - DNA, 972 bp, Magnetospirillum magnetotacticum MS-1
  CDS (1)..(972)
atgaaagccgtcatctgccccgctttcggccaggatctggtcgtcaccgacttccccgcgcccgccatgatccctggcggaatccgtatcaaggtacgggcggcgggcgtcaatttcgccgattccctgatcaccgggggcaagtaccaggaaaagatggagccgcccttcgtgcccggcatggaactggcgggcgaggtcatcgaggtggcggagggcgtcaccacctgcaaacccggcgaccgggtcatggccacggtgacgggaggcgctttcgccgaagaggcggtctgcgatcagaccgatgtctatgtcctgcccgattccctcgacttcgtcaccgccgcgggcttcccggtggcctatggcacctcccatctggggctcaaggccaaggctggtctgcgggcgggcgagaccttggtggtgcacggcgcggcgggcggcgtgggcctcaccgccgtcgaggtgggccgcgccctgggcgccacaatcatcggcaccgctggtggaccggacaaggtcaaggtggccctggagcacggcgcccatttcggcatcgactacaaatccgaggatatccgcgagcgcgtcaaggccctgaccgacggtaagggcgccgatgtggtctatgatcccgtgggcgggcaggtcttcgacgcctccttgcgctccatcgccgccgatggccgcatcctgatcatcggcttcgcgggcggcacggtgcagcagattcccgccaatatcctcctggtcaagaatgtcacggtgatcggctattactggggcgcctaccgcaagatcgcgccgcagatggtgcgcgactccatgctggaatgtctggactggtgggcggcggggaaactcagcccccatgtctccaaggtcatggacctgtcccaggcggtcgacgccatcggcctcctgaaaggccgcgccgccacgggaaaaatcgttctgacgacatcctaa

SEQ ID NO: 51554 - protein, 323 aa, Magnetospirillum magnetotacticum MS-1
MKAVICPAFGQDLVVTDFPAPAMIPGGIRIKVRAAGVNFADSLITGGKYQEKMEPPFVPGMELAGEVIEVAEGVTTCKPGDRVMATVTGGAFAEEAVCDQTDVYVLPDSLDFVTAAGFPVAYGTSHLGLKAKAGLRAGETLVVHGAAGGVGLTAVEVGRALGATIIGTAGGPDKVKVALEHGAHFGIDYKSEDIRERVKALTDGKGADVVYDPVGGQVFDASLRSIAADGRILIIGFAGGTVQQIPANILLVKNVTVIGYYWGAYRKIAPQMVRDSMLECLDWWAAGKLSPHVSKVMDLSQAVDAIGLLKGRAATGKIVLTTS

SEQ ID NO: 51555 - DNA, 1500 bp, Leuconostoc mesenteroides subsp. mesenteroides ATCC 8293
  CDS (1)..(1500): n means a or g or c or t/u
atgaaagcagctgtatggcatggcgttaaagatgttcgtgtggaggatgttgaactcaaaccaacaaaatctaatgaggtagtagtgcgtgttgcttatgctgggatttgtggcagcgacttacacgagtaccttgagggtcctgtatttattcccgttgatcaaccagatgaattgactggcggtcaagcaccattaacgatgggacatgagttttctggcgttatcgaaaaagtaggtcccgatgtggctaattttaaagttggggatcacgtttcaattaatccaactgtcacaaagggaatttcttctgatgatttggatgtttacgatggctatagttttattggtttaagcacggatggtggctttacatcatacgtgaatgtaccagaagataacttatatcatttacctgaagaattctcattgaaattagcagctactattgagccaactgcagttgcggtccaagctatcaaagaggctgatcttcgatttggcgaaaaagttgtgatttttggtgctggaccaataggtgtattagttgctgctgctgcgaaggcggcaggggctactaaaatcgtggctgtagatttgtcagaaattcgcttgagaaaagcgcttgaaatgggcgcaacagacgtgattaatccaagtcaagtaccagacactgttgcagctattaaaaacattattcctggtggagcggatgcatcatttgaagttgccggggtacaaccaacctttgaacaagcaatagatgcaacacgtccgcgcggaagtgtcgttattgtttcaatttttgcaaagccaatcagctttaacccaatgcaattgatgaatgcaggtgttaaactgaccacaacaattgcttattcaaaagaaactttccaacaaactgttgctcttgttagcagtgggcaaataaatgtagaaccagttattacggatacaatttcattggacagtattgtttctgatggttttgagtcattaacaagcgataaatcgcaggccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggagcataaagctattattagctggcataatggcttctatcgttgtttcattaccgattgcttttgctggtag

SEQ ID NO: 51556 - protein, 499 aa, Leuconostoc mesenteroides subsp. mesenteroides ATCC 8293
  misc_feature (342)..(475): Xaa can be any amino acid
MKAAVWHGVKDVRVEDVELKPTKSNEVVVRVAYAGICGSDLHEYLEGPVFIPVDQPDELTGGQAPLTMGHEFSGVIEKVGPDVANFKVGDHVSINPTVTKGISSDDLDVYDGYSFIGLSTDGGFTSYVNVPEDNLYHLPEEFSLKLAATIEPTAVAVQAIKEADLRFGEKVVIFGAGPIGVLVAAAAKAAGATKIVAVDLSEIRLRKALEMGATDVINPSQVPDTVAAIKNIIPGGADASFEVAGVQPTFEQAIDATRPRGSVVIVSIFAKPISFNPMQLMNAGVKLTTTIAYSKETFQQTVALVSSGQINVEPVITDTISLDSIVSDGFESLTSDKSQAKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEHKAIISWHNGFYRCFITDCFCW

SEQ ID NO: 51557 - DNA, 1059 bp, Azotobacter vinelandii
  CDS (1)..(1059)
atgcgcgccgccgtctggcacggccgccacgacatccgcgtggaaaacgtgccgctgcccgccaacccgccgcccggctgggtgcagatccgcgtcgactggtgcggcatctgcggctcggacctgcacgaatacgtcgccggcccggtgttcatcccggtcgagaagccccacccgctcaccggtatccagggccagtgcatcctcggccacgaattcagcggcgagatcgtcaagctcggcaccggcgtgagcggcttcgcccccggcgagcggatcgccgccgacgcctgccagcactgcggcacctgctactactgccgcagcggcctgtacaacctctgcgaaaagctggccttcaccgggctgatgaacaacggcgccttcgccgaactggtgaacgtgccggccgaactgctctacaaactgccggccgatttccccgtcgaggccggcgcgctgatcgaaccgctggcggtgggcatgcacgcggtgaagaaggccggcaacctgctcggccggaacgtggtggtggtcggcgccggcaccatcggcctgtgcaccatcatgtgcgccaaggcggccggcgcggcccaggtgatcgccctggaaatgtcctcggcgcgcaaggccaaggcgctggaagtgggcgcgagcctggtgctcgaccccaaggaatgcgacgcgctggcggaaatccgcgcccgcaccaacggcctcggcgccgacgtcagcttcgagtgcatcggcaacaaacacaccgccaagctggccatcgacgtcatccgcaacgccggcaagagcgtgctggtcggcatcttcgaggaacccagctcgttcaacttcttcgaactggtctccaccgagaagcaggtcatcggcgccctcgcctacaacggcgaattcgccgacgtgatcgccttcatcgccgacggccgcctggacgtcgaaccgctgatcaccggccgcatcggcctggaagaaatcgtcggccgcggcttcgaggaactggtcaacaacaaggaacacaacgtcaagattattgtttcgccgcattga

SEQ ID NO: 51558 - protein, 352 aa, Azotobacter vinelandii
MRAAVWHGRHDIRVENVPLPANPPPGWVQIRVDWCGICGSDLHEYVAGPVFIPVEKPHPLTGIQGQCILGHEFSGEIVKLGTGVSGFAPGERIAADACQHCGTCYYCRSGLYNLCEKLAFTGLMNNGAFAELVNVPAELLYKLPADFPVEAGALIEPLAVGMHAVKKAGNLLGRNVVVVGAGTIGLCTIMCAKAAGAAQVIALEMSSARKAKALEVGASLVLDPKECDALAEIRARTNGLGADVSFECIGNKHTAKLAIDVIRNAGKSVLVGIFEEPSSFNFFELVSTEKQVIGALAYNGEFADVIAFIADGRLDVEPLITGRIGLEEIVGRGFEELVNNKEHNVKIIVSPH

SEQ ID NO: 51559 - DNA, 939 bp, Azotobacter vinelandii
  CDS (1)..(939)
atgggcgtgtgcggcagcgacgtgcattactacactcacggccggatcggtcatttcatagtcgaccagccgatggtgctggggcacgaggcggccggcacggtcatcgaagtcggcagcaacgttacccacttggccaaaggggatcgcgtctgcatggagcccggcattcccaatccccgctccaaggcctcacgcctgggactctataacgtcgatccttcggttgtgttctgggccaccccgccggtacatggctgcctgaccccggaagtcgtccatccggcggccttcgcctacaagctccccgaccatgtcagctttgctgaaggagcgctggtggagcctttcgccatcggcatgcaggcagcagtcaaggcacgtatcaagcccggtgatgtcgccgttgtcattggcgccggcacgatcggcatgatgactgccctggccgcgctggccggcggtgcgagccaagtgctggtgtccgacctgatggtggaaaagctggccattgcccaacgctatgaaggtattaccgccgtcaacgtgcgcgagcagtccctgcaggacaaggtggctgaggctaccggcggctggggcgcggacgtggtgttcgaggctagcggtagcgcccgggcctatggcgatgcactggcggcggtctgcccgggcggggcgctggtattggtgggcatgccggtcgagccggtgctcttcgatgtggtggcggcccaggccaaggagattcgcatcgagaccgtgttccgctacgccaatgtctacgagcgggcggtgaacttgatcgccagcggcaaggtcgatctgaagccgctaatctcggcgacctttcccttcgaacggggcgtcgaggcctttgagcgggctgccagtgctcagccgggcgatgtgaaagtgcaaatcacctttggcgatgcttga

SEQ ID NO: 51560 - protein, 312 aa, Azotobacter vinelandii
MGVCGSDVHYYTHGRIGHFIVDQPMVLGHEAAGTVIEVGSNVTHLAKGDRVCMEPGIPNPRSKASRLGLYNVDPSVVFWATPPVHGCLTPEVVHPAAFAYKLPDHVSFAEGALVEPFAIGMQAAVKARIKPGDVAVVIGAGTIGMMTALAALAGGASQVLVSDLMVEKLAIAQRYEGITAVNVREQSLQDKVAEATGGWGADVVFEASGSARAYGDALAAVCPGGALVLVGMPVEPVLFDVVAAQAKEIRIETVFRYANVYERAVNLIASGKVDLKPLISATFPFERGVEAFERAASAQPGDVKVQITFGDA

SEQ ID NO: 51561 - DNA, 1044 bp, Haemophilus somnus 129PT
  CDS (1)..(1044)
atgaaagctattgttttagaatctaaccgtaatatggctatttgtgatattcctaagcctttagtcgaagaccctgatgatgtgttggtaaaagtgcattactccggactatgtggttccgatattccaaggatttttcatcatggtactcacttctatcctattgttttaggtcacgaatttagtgctacagtagaagaagtaggctcagatgtaacggaattggataagggagatttagttagctgtgctcctctccagccctgttttaaatgtgatgaatgtaatagagggttttactctttatgtaaaaactacaattttatcggttcacgccgcttcggtgctaactcagagtatctttgtgtgaaaaagagtaatttggtgaagttacctcaaggaagtgacacattgcaagcatcttttattgagcctatcactgttggattgcatgctattcatcttgcaggaggctgtaaaggtaaaaatgtggttatagttggagcaggtactatcgggttactggcagctcaatctacaaaagcattaggggcaaattcagttagtgtgattgacatcaaccaagaaaaattggtgttggcaaaaacattaggtgcagattacgtatttaattcaatggatttgaaagctgacgaaattctagcctgtttagatggtaatcgatttgatcaactaattttagaaacagcgggggtaccgaaaactgttgaactttccattcaaattgctggacctagagctcaagtcgtattagttggaacactacaccacgacctaaatctcgatcaaaaagaatttggactgattttacgcaaagaacttatcatttttggttcttggatgaattactccaaaccttggccgggagtcgaatggcgagaagcagttaatcttattgcagaaaataaaatctgctttgaaccgcttatctcgtcgattaacactattgaagattatgtggaagaagtgaaatccttagacggtaaaccgatgaatggaaaattggtattaaaattcgactaa

SEQ ID NO: 51562 - protein, 347 aa, Haemophilus somnus 129PT
MKAIVLESNRNMAICDIPKPLVEDPDDVLVKVHYSGLCGSDIPRIFHHGTHFYPIVLGHEFSATVEEVGSDVTELDKGDLVSCAPLQPCFKCDECNRGFYSLCKNYNFIGSRRFGANSEYLCVKKSNLVKLPQGSDTLQASFIEPITVGLHAIHLAGGCKGKNVVIVGAGTIGLLAAQSTKALGANSVSVIDINQEKLVLAKTLGADYVFNSMDLKADEILACLDGNRFDQLILETAGVPKTVELSIQIAGPRAQVVLVGTLHHDLNLDQKEFGLILRKELIIFGSWMNYSKPWPGVEWREAVNLIAENKICFEPLISSINTIEDYVEEVKSLDGKPMNGKLVLKFD

SEQ ID NO: 51563 - DNA, 987 bp, Pseudomonas syringae pv. syringae B728a
  CDS (1)..(987)
atgaaagccctgttatgcaaagccttcggtcctgccagcacactggtactcgaagacgtccccggccctgcgatcaaaaagaacgaaattctgctcgacgtgcacgccgccggggtcaactttcccgacaccttgatcatcgagggtaaataccagttcaaaccacccttcccgttctcaccgggtggcgaggccgcaggcgtgatagccgccgtcggagaaaacgtcagccacctgaaacccggcgaccgcgtcatggcgctcaccggctggggcagctttgccgagcaggtcgccgtgccccactacaacgtgctgccgattccgcagggcatggacttcaccacggcggccgcattcagcatgacctacggcacctccatgcacgccctcacacaacgcgcccgcctgcaacccggcgaaatcctgctggtactcggtgcatccggcggcgtcggccttgccgccgtggaaatcggcaaagccctcggcgcccgcgtcatcgccgccgccagcagcgcagaaaaactcgaagtcgccagaaacgcaggcgccgacgaactgatcaactacagcgaaaccagcctcaaggacgaaatcaaacgcctcacccatggcaacggcgccgacgtgatctacgacccggtcggcggcgacctattcgaccaggccatccgcagcatcgcctggaacggccgcctgctggtcgtcggcttcgccagcggccgcatccccgaactgcccgtcaatctgaccctgctcaagggcgcttcggtggtcggcgtgttctggggctcgtttgcccagcgacaaccgcaggacaatgcggcgaacttcaagcaactgtttgcgtggtttgaagaagggaaattgaagccgctggtgtcgacggtttatccgctggaaagggctggggaggcgattgatttgttggggggacgcagggctgtggggaaggttgtggttttgattggcaagactgcctga

SEQ ID NO: 51564 - protein, 328 aa, Pseudomonas syringae pv. syringae B728a
MKALLCKAFGPASTLVLEDVPGPAIKKNEILLDVHAAGVNFPDTLIIEGKYQFKPPFPFSPGGEAAGVIAAVGENVSHLKPGDRVMALTGWGSFAEQVAVPHYNVLPIPQGMDFTTAAAFSMTYGTSMHALTQRARLQPGEILLVLGASGGVGLAAVEIGKALGARVIAAASSAEKLEVARNAGADELINYSETSLKDEIKRLTHGNGADVIYDPVGGDLFDQAIRSIAWNGRLLVVGFASGRIPELPVNLTLLKGASVVGVFWGSFAQRQPQDNAANFKQLFAWFEEGKLKPLVSTVYPLERAGEAIDLLGGRRAVGKVVVLIGKTA

SEQ ID NO: 51565 - DNA, 1059 bp, Haemophilus somnus 2336
  CDS (1)..(1059)
atgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaagctggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgcaggtgcgattggactgatggccgcattagttgccaaagcttatggtgcgacaccaattttaattgacattttagacaagcgattagattacgcaaaatctattggcattccaaatataattaacccggcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaatgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaa

SEQ ID NO: 51566 - protein, 352 aa, Haemophilus somnus 2336
MSINFVKEGNIMSKYVRSVCLVEPKKVDIKTVLYPKKGECDVLIKVESIGICGSDIGAFRGTNPLVTYPRILGHEIVGTVIEAGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 51567 - DNA, 957 bp, Ralstonia eutropha JMP134
  CDS (1)..(957)
atggtgccgggcccggagggcggcaaggtcgaggtgcaggatattccggttcccgtcgcggggccgggccaggtgctggtcagggttcgtgcatcgggcctgaaccgcggtgagattaaccaggcgaaggagttgcgtaccggcaataccatcaccaccggcgtcgagttcgcgggcgaggtggccgaagtcggtgaaggcgtgcacggctggcgcaagggcgaccgcgtcatggggcacggcaagggctgccaggctgaatatgtcgtttccgatccgatggcgctgatcgccgtgccggacggcatgtcgtggatcgatgccgccgcgtttccgaatgtctttatcacggcacacgacgcgctggtggtgaacggccagctcaagcagggcgagtcggtgctggtcaacggtgcgtcgggcggcgtggcgatggctgccatccagatcgcgtcgctgatgggcgccaaaccggtgattgcccagtcgcgttcggccgccaagctcgacaagctcagccagtacggtgtggacgtctgcatcgattcgtcgaaggacgaccaggtcgaaaaggtgatggaggcgaccggcaacaagggcgtcgacgtcatcatcgacacggtcggcgggccggtgttcgaagccaatatgaagagccttgccgttcaggggcgcctggtgaacatcgcgcggctaggctcggccacggcgcagatcgacctggcccagctatggctcaagcgtctgcacctgatcggcgtgacgttccgtacccgcaccgagcaggagcggctcgaatgcatccaggcgtgcgcgcgcgacatgctgccgttcctgcgtgccggccgcgtgcggctgccgatcgaccgtacctttgccatgaccgatatccacgcggcgcacgcatacatgaagcaggaccagcacgtcggcaagatcgtgctgctggtcgactga

SEQ ID NO: 51568 - protein, 318 aa, Ralstonia eutropha JMP134
MVPGPEGGKVEVQDIPVPVAGPGQVLVRVRASGLNRGEINQAKELRTGNTITTGVEFAGEVAEVGEGVHGWRKGDRVMGHGKGCQAEYVVSDPMALIAVPDGMSWIDAAAFPNVFITAHDALVVNGQLKQGESVLVNGASGGVAMAAIQIASLMGAKPVIAQSRSAAKLDKLSQYGVDVCIDSSKDDQVEKVMEATGNKGVDVIIDTVGGPVFEANMKSLAVQGRLVNIARLGSATAQIDLAQLWLKRLHLIGVTFRTRTEQERLECIQACARDMLPFLRAGRVRLPIDRTFAMTDIHAAHAYMKQDQHVGKIVLLVD

SEQ ID NO: 51569 - DNA, 978 bp, Ralstonia eutropha JMP134
  CDS (1)..(978)
atgatgaaagccgtactgtgcaaggcctgggggccgcccgattccctgaccgtcgaaaccctgccggatccggtgccggatcagggcgaagtggtcatcgaggtaaaggccgccggcgtgaatttcccggatgtgctcatcatccagaacaaataccaggccaagccggaactgccgttcacgccgggctcggaactggcgggcatcgtgactgccgttggcgcgggcgtcacgcacgtcaagcccggcgacaacgtcattgcgtatctcggcaacggcgcattcgcttcgcacgtgaaggcgccggccaacaaggtcgtgcccatgccgcccggcgtggattacgaaaccgcggcagcattcacccttacctacggcacctcgcaccacgccgtcgtcgaccgtggcgaactcaaggccggacagaccatgctggtgctcggcgcagctggcggcgtggggcttgccgcgattgaaatcggcaaggccatcggcgcgcgcgtcatcgcggcggcgtcgaccgatgaaaagctcgcagtttgcaaggaacacggcgccgatgcgctgatcaactacagcaccgaagacctgcgcgaacgcgtcaaggcgctgaccgatggcaacggtccggacgtgatctacgaccctgtgggtggcgtctatgccgaaccggcgttccgctcgatcgcatggcggggccgctatctggtggtgggcttcgccaatggcgagatcccgaagattccgctgaacctggcgctgctcaagggggcttcgctcgtgggcgtgttctggggcgatttcgtgcggcgcgaaccgcgtgcgaaccaggccaatatggcgcaaatgcttggctggatgaaggaaggcaagctgcgcccgcacatctccgcgcgctacccgctggagcaggctccgcaggcgctcaaggacatggaagcgcgcaaggtgaccggcaaggtggtgatcgttccctga

SEQ ID NO: 51570 - protein, 325 aa, Ralstonia eutropha JMP134
MMKAVLCKAWGPPDSLTVETLPDPVPDQGEVVIEVKAAGVNFPDVLIIQNKYQAKPELPFTPGSELAGIVTAVGAGVTHVKPGDNVIAYLGNGAFASHVKAPANKVVPMPPGVDYETAAAFTLTYGTSHHAVVDRGELKAGQTMLVLGAAGGVGLAAIEIGKAIGARVIAAASTDEKLAVCKEHGADALINYSTEDLRERVKALTDGNGPDVIYDPVGGVYAEPAFRSIAWRGRYLVVGFANGEIPKIPLNLALLKGASLVGVFWGDFVRREPRANQANMAQMLGWMKEGKLRPHISARYPLEQAPQALKDMEARKVTGKVVIVP

SEQ ID NO: 51571 - DNA, 987 bp, Ralstonia eutropha JMP134
  CDS (1)..(987)
atgaaagccatcgacttcgaggacttcggcgaggccgacgttctgcaactgcgtgatctgcccgtgccagaaatgcgcccgcaggatctgctggtgcgcacccacgccgccggcgtgaaccgcgccgacatcatccaccgccgcggcggctatgggcgcgcaagctttggcgattccacggtgatgggcctggagatcgccggcgaggtgatcgctgccggcgcagcggtggccggctttgcgactggcgaccgcgtaatgggcatcgtgggcggcggcgcctatgccgaggtggcgcgcatcgactaccggcaggccatgcgcatccccgacgggcttgactacgtgcacgccgccgcgattccagaggtgtttgtcacggcgcacgaggcgctgctgcaccttggtcgtctgcaggctggcgacaaggttctgatccacgcgggcgcgagcggcgtgggctcggccgctgtgcaattagcgcgtgcggcgggcgcgcgggtcttcgcaacggccaatagcggcaagctgccgcgcgttcgcggcttcggcgcggacgtgctgatcgactacaaggccgaggatttcggcgaggtggtaaagcgcgaaaccggtggcaaaggcgtggatgtgatcgttgatttcatcggcggttcctacctggaacgaaacgtcctgtcgctggccaatggcggccggctggtgcaggtcggcctgcttggcggcgcagaaggtgccaatctgccactggagcggctgctttacggccatctgcagatcatcggcacggtgatgaaatcgcgtacgccggaggtcaagcggcagatggtcgcgcgcttcgcgcagcgctggctgccgggctttaccgagagcggactggtgccggtggtggacagcgtgtacccgctggctcaggccgccgaagcgcaccggcgcatggagtcgaaccaaagcgtgggtaagataatcctgtcgaccggtgcatag

SEQ ID NO: 51572 - protein, 328 aa, Ralstonia eutropha JMP134
MKAIDFEDFGEADVLQLRDLPVPEMRPQDLLVRTHAAGVNRADIIHRRGGYGRASFGDSTVMGLEIAGEVIAAGAAVAGFATGDRVMGIVGGGAYAEVARIDYRQAMRIPDGLDYVHAAAIPEVFVTAHEALLHLGRLQAGDKVLIHAGASGVGSAAVQLARAAGARVFATANSGKLPRVRGFGADVLIDYKAEDFGEVVKRETGGKGVDVIVDFIGGSYLERNVLSLANGGRLVQVGLLGGAEGANLPLERLLYGHLQIIGTVMKSRTPEVKRQMVARFAQRWLPGFTESGLVPVVDSVYPLAQAAEAHRRMESNQSVGKIILSTGA

SEQ ID NO: 51573 - DNA, 1074 bp, Rubrobacter xylanophilus DSM 9941
  CDS (1)..(1074)
atgccggagaagaagatgatgagggcggccgtgtaccgcgggccacgagagctgcgcgtcgagcccgtccccgttccggagatcgggccctccgacgtgctcgtgagggttcacagctgcggtatatgcggctcggatctgcacagctacaaggcggggatgtacatccggcccggccagatcatgggacacgagttcatgggcaccgtcgccgccgccggtgaggacgtggaaggtgtggaggagggcgaccgggtcaccggcttcagcatcggggtgtgcggtagctgctactggtgctcccgccagcagtacatcctgtgcccggaactcttccggaactccaccgggtatggccttccgggcgggttcgcagagtacgtcccgatccggaacgcggtggtcggtcagagcatacacccggtccccagcgagctcgacgacgagacggcggccaccacggagcccgtctccgtaggggtgggggccatcgaagcggccggggtgcgtccgggggacagggtggtcgtgctgggggcgggcatgatcggcaacgcctgcatgcaggcggccagggcggccggagcggggcaggttgcggtgatagacgtctctccggtccggctcgaggcggccaggagcctcggcgccgacgccgtcttcgacgcgaggaccggagacgccctgtcgtgggtgaaggagctgtggggggtcgggcgctaccacttcaacgagggcggcatggcggacgtcgtcgtcgaggccgccggcgcgcccgtgacggtccagcaggccttcgagatggtgcgcagcgggggggcgatcgtcttcgtgggcctgcccgaggagccggcgcccatcgacgtaaccaagatcgtgcacaagcagccgcgcatcgtgggttcgctgggcggggactttgccagggccatcgagctgatggccagcgggagcatccggacaaaggagcttatcacccacaggttcccgctcgaggacgccgccgaagccttcgagacccagctgcggacgggcgaggcgatgaaggtcatgatacaaccgcgggaggggtag

SEQ ID NO: 51574 - protein, 357 aa, Rubrobacter xylanophilus DSM 9941
MPEKKMMRAAVYRGPRELRVEPVPVPEIGPSDVLVRVHSCGICGSDLHSYKAGMYIRPGQIMGHEFMGTVAAAGEDVEGVEEGDRVTGFSIGVCGSCYWCSRQQYILCPELFRNSTGYGLPGGFAEYVPIRNAVVGQSIHPVPSELDDETAATTEPVSVGVGAIEAAGVRPGDRVVVLGAGMIGNACMQAARAAGAGQVAVIDVSPVRLEAARSLGADAVFDARTGDALSWVKELWGVGRYHFNEGGMADVVVEAAGAPVTVQQAFEMVRSGGAIVFVGLPEEPAPIDVTKIVHKQPRIVGSLGGDFARAIELMASGSIRTKELITHRFPLEDAAEAFETQLRTGEAMKVMIQPREG

SEQ ID NO: 51575 - DNA, 1044 bp, Rubrobacter xylanophilus DSM 9941
  CDS (1)..(1044)
atgaaggcgctcgtctaccacgggccgggggagaagagctgggagtcgaaggaggacccgcgtatcgagagacccaccgacgcggtggtccggatagacaccacgaccatctgcgggacggatttgcacatcctcaagggcgacgtccccgaggttgccgaggggcgcaccttggggcacgaggcggtcggcacggtcgtggatgccggaccgggcgtggagaacttcgaggagggggaccgggtgctcgtctcgtgcatctccgcctgcgggcgctgcgcgtactgccggcgggggatgtacgggcagtgcctgcaggggggcggttggatcctgggtcacctcgtggacgggacccaggccgagttcgcccgcataccgtttgcggacaacagcctctacgaggtgccggaggggctctccgacgagcaggtcgtcttcatctcggacatcctgcccaccggctacgaggtcggggtcctgaacgggaaggtcgaaccgggcgatacggtcgcgatcgtgggcgcaggccccatagggctcgcctcgatgctgaccgcgaggctctacgggccgagcaggatcatcgccatagacctcgccgactcccggctcgagcaggcccgccgcttcggcgcggacacgacgatcaacaactccgcgcaggacgcggtcgagatggtcatggagctcaccggcggactcggggcggacgtggtgatggaggcggtgggcgtcccggcgaccttcgagctgtgcaccgggctcgtcaggcccggcgggcacgtcgccaacatcggcgtccacggcgcccccgcgacgctgcacctggagaggctctgggccagagacgtgaccatcaccaccggcctcgtggacacctactcgacgccgaccctgctccggctggtggcggaggggaggctggaccccaccccgttcgccacccaccgcttcgcgctcggggagatcctggacgcctacgagaccttcgccgacgcggcccgcacgcaggccctcaaagtagtcctgtcggcggagtga

SEQ ID NO: 51576 - protein, 347 aa, Rubrobacter xylanophilus DSM 9941
MKALVYHGPGEKSWESKEDPRIERPTDAVVRIDTTTICGTDLHILKGDVPEVAEGRTLGHEAVGTVVDAGPGVENFEEGDRVLVSCISACGRCAYCRRGMYGQCLQGGGWILGHLVDGTQAEFARIPFADNSLYEVPEGLSDEQVVFISDILPTGYEVGVLNGKVEPGDTVAIVGAGPIGLASMLTARLYGPSRIIAIDLADSRLEQARRFGADTTINNSAQDAVEMVMELTGGLGADVVMEAVGVPATFELCTGLVRPGGHVANIGVHGAPATLHLERLWARDVTITTGLVDTYSTPTLLRLVAEGRLDPTPFATHRFALGEILDAYETFADAARTQALKVVLSAE

SEQ ID NO: 51577 - DNA, 1008 bp, Mesorhizobium sp. BNC1
  CDS (1)..(1008)
atgaaagcggtcgtcagccacgaattcgcaccgttcaggcacgttctagtcgagcagatgcccgaccctgtgccagggactggcgagcttgtgatcgacatcgaagcctccgatgtaaattttcccgatatccttcagatcgaaggaatgtatcaggtgcgcgctccgcgtccgttcattccgggccttggcgcgattggccgcgtatccgctgtcggaccggaagtggcagatttcgtcttgggccaaagagtgctcgctctgcccgatggcgcccatgcgggaacccatgcagagaaagcgcgcgtgcctgctcgcttttgcttcattgcaccagaagacgtgcccagcgacatcggggccgcactcggccttgcctatcagacggctcatgcggcgctgacgcggcgcgcgttgctgcaacccggtgagagcgttctggtgctaggggcgaccggtggaatcggaatggccgctatccaacttgcccgcgccttgggcgcaagctgtgtgattgctgcgacgcgaggcaaggaaggcacggaaatagccagggagatgggtgccgatcatgtgatcgacacaaggcaaggagaactcaaagaggtcctgcgccacggcgtaagatcggtgacgggcggagccggtgttgatgtggtgatcgatccggtcggcggaagtgtgggcgaagcagcgttacgcacgcttgcatggcacggccggctcgtggtggtgggctttgcttcgggcgacatcccttcattcaagggcaattatctgttgatcaagggcatcagcgtctgcggcatgcagtggaccgattaccaggctcgcgatccgcagggcattcgcgacgcacaggcaaagatcttcgatctgtggcgcagcggccggctttcgccgcgaatttcgcgccggttgccgctatcgcgcgctgccgaggcgtttgaggcagtcgcgatgggcgatgcacgtggaaagataattctactgccggaaactcattga

SEQ ID NO: 51578 - protein, 335 aa, Mesorhizobium sp. BNC1
MKAVVSHEFAPFRHVLVEQMPDPVPGTGELVIDIEASDVNFPDILQIEGMYQVRAPRPFIPGLGAIGRVSAVGPEVADFVLGQRVLALPDGAHAGTHAEKARVPARFCFIAPEDVPSDIGAALGLAYQTAHAALTRRALLQPGESVLVLGATGGIGMAAIQLARALGASCVIAATRGKEGTEIAREMGADHVIDTRQGELKEVLRHGVRSVTGGAGVDVVIDPVGGSVGEAALRTLAWHGRLVVVGFASGDIPSFKGNYLLIKGISVCGMQWTDYQARDPQGIRDAQAKIFDLWRSGRLSPRISRRLPLSRAAEAFEAVAMGDARGKIILLPETH

SEQ ID NO: 51579 - DNA, 1092 bp, Exiguobacterium sp. 255-15
  CDS (1)..(1092)
atgatgacaaaactagtgacagctgtagaagatacgacaaaagtaaaaacgatgcgcgcactcgtcaaggaagaacggggatttggcgctgtcttgaaagaagtcgcagttccttcaccaaaacgtggtgaagtcttgattcgcgtggaagcgacttccatctgcgggacggatgtccacatttacgaatgggacgcgtgggcagcatcacgcgtgaatccgccgtatgttttcggacatgagttttccggtgaagtcgtggaactgggagaagggacgaaacgtctgaaactcggggaccgtgtctcagcggaaacacatatcgtctgtcatcaatgcaaacagtgtctgcgggggcagtatcacatttgtaaaaacacaaaaatcatcggcgtcgatacacaaggctgtttcgccgagtacgtcgtcatgccggaagaaaatctctgggtcaatccggaggatatgccagccgccatcgcatcgattcaagagccgatgggcaatgccgttcacacggttcttgcgagtgacgtcagcgctaaaacggtcgccatcgtcggttgcggtccaatcggtctgatggctgtctcggtcgcaaaagcggcaggagctgcggaagtcattgcgattgatgtcaatccgtaccggttggagcttgcgaaaacgatgggcgcagatgtcgtcatcgattcacgccacgaggatgttctcgaacgggtccggatgatgacggacggggacgggattgatgtcgtctgtgaaatgagcggtcatccggttgcgattcgtcaagcatttgagatggtgacagccggcggagacgtcaacattctcagtctgccggtcaaaccggtcgagattgatctgacgaatcacgttgtttttaaaggtgttcgcgttcaaggcatcaccggacggaaaatgtatgagacatggagtcaagtatccgcattcctgtcgagcggaaaagtcgatgtcaaaccgttgattacacacacattgccactcgaacggtttgaagaaggattcgaattgatgcgacaagggaaatgtggaaaggtcgtactacaaccaagggggacgaattaa

SEQ ID NO: 51580 - protein, 363 aa, Exiguobacterium sp. 255-15
MMTKLVTAVEDTTKVKTMRALVKEERGFGAVLKEVAVPSPKRGEVLIRVEATSICGTDVHIYEWDAWAASRVNPPYVFGHEFSGEVVELGEGTKRLKLGDRVSAETHIVCHQCKQCLRGQYHICKNTKIIGVDTQGCFAEYVVMPEENLWVNPEDMPAAIASIQEPMGNAVHTVLASDVSAKTVAIVGCGPIGLMAVSVAKAAGAAEVIAIDVNPYRLELAKTMGADVVIDSRHEDVLERVRMMTDGDGIDVVCEMSGHPVAIRQAFEMVTAGGDVNILSLPVKPVEIDLTNHVVFKGVRVQGITGRKMYETWSQVSAFLSSGKVDVKPLITHTLPLERFEEGFELMRQGKCGKVVLQPRGTN

SEQ ID NO: 51581 - DNA, 981 bp, Burkholderia cepacia R18194
  CDS (1)..(981)
atgaaagccctgttgtgtaccgcattcggcccgatcaacagcttgcgcatcgaggacgtggcgattcccgaaccggccgcgggccaggtgcgggtgcaggtgaaggccgcatcgctcaatttccccgacgcgctgatcgtccaggggttgtaccaggtgaagccggcgctgcccttttcgccgggcgcggaatttgccggcgtgatcgacgcggtgggcgagggcgtgaccgcgtggcggccgggggattcggtggtcgcgttcaccgggcacggcggcttcgcgcagcagtgtgtggccgacgtgcaccagattgccgcgctgccgccgggcatgacgttcgagcagggcgcggcgctcgtgctcgcgtacggcacgtcgctgcacgcattgcagcagcgcgcgcggctgcaagaaggcgagacgttgctcgtactgggcgcggcgggcggcgttggcctcgcggcgatcgaaatcgcaaaggcgctcggcgcgcgcgtgatcgcggcggcatcgagtgcggacaagctggcgctgtgtcgtgaagcgggtgccgacgagacgatcgactatgcgaccgaagacctgcgccgccgggtggacgagttgaccggcgggcgcggtgccgacgtcgtctacgatccggtgggcggcgcctacagcgaggcggcgctgcgcgcgaccgcctggcatggccggttcctcgtggtcggtttcgcggccggcgagattccgaagatcgcgctgaacctggcgctgctcaaggagcgcgacattctgggcgtgttctggggcgatgccgtgcgccgcgacccgaagcagcatgtcgcgaacatgcgcctgcttgccgagtggttcgcggccggcaaggtgcgacccgcgatcaccgagcgcgtgtcgctggccggcgcggccgacgcgatcgcgcggatggcgaaccggcaggtgaagggcaaggtggtgatcctgccggacgcgtga

SEQ ID NO: 51582 - protein, 326 aa, Burkholderia cepacia R18194
MKALLCTAFGPINSLRIEDVAIPEPAAGQVRVQVKAASLNFPDALIVQGLYQVKPALPFSPGAEFAGVIDAVGEGVTAWRPGDSVVAFTGHGGFAQQCVADVHQIAALPPGMTFEQGAALVLAYGTSLHALQQRARLQEGETLLVLGAAGGVGLAAIEIAKALGARVIAAASSADKLALCREAGADETIDYATEDLRRRVDELTGGRGADVVYDPVGGAYSEAALRATAWHGRFLVVGFAAGEIPKIALNLALLKERDILGVFWGDAVRRDPKQHVANMRLLAEWFAAGKVRPAITERVSLAGAADAIARMANRQVKGKVVILPDA

SEQ ID NO: 51583 - DNA, 1080 bp, Burkholderia cepacia R18194
  CDS (1)..(1080)
atggaaatcgacacgccgcgcgtcggcccaggcgacgtgcgcatcgcggtcgcgtattgcgggatctgcggcagcgacctgcacgaatatgcggacggcccgcacgcgatcccggtcgacacgccgcatccgctgtctcgccgtaccgcgccgctgacgctcggccacgagttctgcggcaccgtcgtcgaagtcggcgaaggcgtgacggcgctgcgcgcgggcgatcgcgtcgcggtcgagcccgagtatcgctgcagccagtgcgcgtactgccgctcggggtcgtacaacctgtgcgtgtcgatgggcttcgccgggctgatgggcgacggcggcatggccgacttcgcggtcgtgccggcgtacatgctgcatcgcttgcccgacggcgtgagtctcgaacaggccgcggtgatggagccggcggccgtcgcgctgcacgcgttgcggcgtggcgagctgcggctcggcgaaacctgtgcggtgttcggcctcgggccgatcggcctgttgctgatcatgctcgcgaagctgcagggcgcgaccacgatcgtggctgtcgatgtctcgcccgaacggctcgcggcggccacgcgcttcggcgcaacgcatacgttcgatgcacgcgcactcggtgcatccgcactgcaggacgcgatccgcgcggccacgggcgggctcggcgtcgatgcgagtttcgaagcggccgggctgcagacaacgttcgaatcggcgatgcacgcgctgcgcaagggtggacgcatcgtgatggtcggcctgatgccgcatgcgggcttcgacgcgttccgcgcggtcaacgacgagctgaccttcacggcgagcgtcggctaccggcatgcgtacgaagacctgctgcgcatcgtcgcgtcgggtgcgctcgacctcacgtcgatcgtcacgcgcaccgtgtcgctcgaagacgccgtcgccgacggcttcgacgcgctgctcgccgaccgcgcgcagatcaagatcctcgtttcacccgcgcaacggcctccccgtcgcgcgcacaccatcgggagcatcgagcatgagtcgtcagtgggcgtttga

SEQ ID NO: 51584 - protein, 359 aa, Burkholderia cepacia R18194
MEIDTPRVGPGDVRIAVAYCGICGSDLHEYADGPHAIPVDTPHPLSRRTAPLTLGHEFCGTVVEVGEGVTALRAGDRVAVEPEYRCSQCAYCRSGSYNLCVSMGFAGLMGDGGMADFAVVPAYMLHRLPDGVSLEQAAVMEPAAVALHALRRGELRLGETCAVFGLGPIGLLLIMLAKLQGATTIVAVDVSPERLAAATRFGATHTFDARALGASALQDAIRAATGGLGVDASFEAAGLQTTFESAMHALRKGGRIVMVGLMPHAGFDAFRAVNDELTFTASVGYRHAYEDLLRIVASGALDLTSIVTRTVSLEDAVADGFDALLADRAQIKILVSPAQRPPRRAHTIGSIEHESSVGV

SEQ ID NO: 51585 - DNA, 1065 bp, Burkholderia cepacia R1808
  CDS (1)..(1065)
atgaaggccgccgtctggcacggccgcaacgacatccgcgtcgaggaggttcccgtccccggacacccgccggccggctgggtccagatccgcgtgcactggtgcgggatctgcggctccgacctgcacgaatacgtcgccgggccggtgttcatccccgtcgatgcgccgcacccgctcacgggcctgaaaggccagtgcatcctcggccacgaattcagcggcgaaatcgcggcgctcggcgcgggcgtcacgggcttcgcgctcggcgagcgcgtgacggccgacgcgtgccagcattgcggcacctgctggtattgccggcacgggatgtacaacatctgcgagaacctggcgttcaccgggctgatgaacaacggtgcgttcgcggagtacgtgaacgtgccggccgaactgctgtacaagctgcccgacaactttccgaccgaggccggggcgctgatcgagccgctcgcggtcgggatgtacgcggtgaagaaggccggcaacatcgtcgggcagaccgtcgtcgtggtcggcgccggcacgatcggcctgtgcacgatcatgtgcgcgaaggccgcgggcgccggacgcgtgatcgcgctggaaatgtcggccgcgcgcaagcagaaggcgctcgaagtgggcgcgacggtcgtgatcgacccgaaggcgtccgacgcgatcgccgaggtcaaggcgctgacgggcggctacggcgccgacgtgtcgttcgaatgcatcggccacacggccaccgcgaagctcgcgatcgacgtgatccgcaaggccggcaagtcggtgatggtcggcatcttcgaggagccgacgtcgttcaacttcttcgacatcgtgtcgaccgagaaggaagtgatcggctcgctcgcgtacaacggcgaattcgcggacgtgatccgcttcatcgccgacggccgcatcgacgtgcagccgctcatcaccggacgcatcgcgctcggcgacatcgtcgcgcgcggcttcgaggagctggtcaaccacaaggaccgcaacgtgaaaatcattgtccagcccgtggcagcctga

SEQ ID NO: 51586 - protein, 354 aa, Burkholderia cepacia R1808
MKAAVWHGRNDIRVEEVPVPGHPPAGWVQIRVHWCGICGSDLHEYVAGPVFIPVDAPHPLTGLKGQCILGHEFSGEIAALGAGVTGFALGERVTADACQHCGTCWYCRHGMYNICENLAFTGLMNNGAFAEYVNVPAELLYKLPDNFPTEAGALIEPLAVGMYAVKKAGNIVGQTVVVVGAGTIGLCTIMCAKAAGAGRVIALEMSAARKQKALEVGATVVIDPKASDAIAEVKALTGGYGADVSFECIGHTATAKLAIDVIRKAGKSVMVGIFEEPTSFNFFDIVSTEKEVIGSLAYNGEFADVIRFIADGRIDVQPLITGRIALGDIVARGFEELVNHKDRNVKIIVQPVAA

SEQ ID NO: 51587 - DNA, 978 bp, Rubrivivax gelatinosus PM1
  CDS (1)..(978)
atgcacgcctggctctgcgacaacccgatcggccccgaggcgctgaagtggaccgaattgcccacgcccgaaccgcaggccggcgaagtgcgcgtggcggtgcgctgcgccagcctgaacttccccgacctgctgatcgtgcagaacaagtaccagctgaagcccccgctgcccttcgtgccgggagcagagttctccggcgtgatcgaggcagtcggtcccggcgtgacgcagttgcacgtcggcatggccgtcgcctcgttcggcggcatcggcgggttcggcagccatgtgtgcgtcgacgcccggcaggtgatgccgctgccgtcgggcttcgcgttcgacgacgctgccgccttcctgtgcacctacggcaccagccatcacgcgctggtcgaccgcgcacagttgaaggccggcgagaccgtgctggtactgggtgcggcgggcggcgtcggcaccgccgcgatccagatcgccaaggcggtgggtgcgcgcgtgatcgccgccgcctcgagcgacgagaagtgcgcgctgtgccgcacgctcggggccgacgcgtcgatcaactacacgagcgccgacctgcgcgagcagatcaaggccgccaccgagggcaaggggccggatgtggtctacgaccccgtcggcggcgcgatggccgagccggtgttccgctcgatcgcctggcgcggccgctacctcgtgatcggcttcgccgccggcgccatcccggcgctgccgctgaacctggccctgctcaagggcgcctcgctggtcggcgtgttctggggcgagttcgccaagcgagaaccgcagcagaacgcgcgggccctgaacgaactggcgagctggtacgcccagggccgcatcaagccggtgatcgagcaccgctacgcgctgcgcgacctgccaagcgccttcgagctgatggcgtcacggcaggtgcgcggcaagatcgtgctcagcgtcgactga

SEQ ID NO: 51588 - protein, 325 aa, Rubrivivax gelatinosus PM1
MHAWLCDNPIGPEALKWTELPTPEPQAGEVRVAVRCASLNFPDLLIVQNKYQLKPPLPFVPGAEFSGVIEAVGPGVTQLHVGMAVASFGGIGGFGSHVCVDARQVMPLPSGFAFDDAAAFLCTYGTSHHALVDRAQLKAGETVLVLGAAGGVGTAAIQIAKAVGARVIAAASSDEKCALCRTLGADASINYTSADLREQIKAATEGKGPDVVYDPVGGAMAEPVFRSIAWRGRYLVIGFAAGAIPALPLNLALLKGASLVGVFWGEFAKREPQQNARALNELASWYAQGRIKPVIEHRYALRDLPSAFELMASRQVRGKIVLSVD

SEQ ID NO: 51589 - DNA, 978 bp, Rhodospirillum rubrum
  CDS (1)..(978)
atgcgcgccatggtctgcgatgctttcggaccgcccgacgtcttgcgggtggcggatctgcccgatccgccgctgccgcccgatggcgtgcgcatccgggttcgcgccgccgggatcaatttcgccgatgggcttttcatcgccggacagtatcagatccgtccccgtccgccgttcattcccgggttcgaggtcgccggggatatcctggaggtcggccccgaggtgcttgacctgcggccgggacaacgggtgatggccatccttgatcagggcggctatgccgatcaggtggtggcgccggcccgcgacgtccacgccttgaccgaccgcatggaccttttggccgccggcggctttcccatcgcctatggcacctcgcatttcggtctgaccgaccgctgccggctgcggccgggcgaaatcgtcctgatccacggcgcggccggcggcgttgggctgacggcggtggaatgcgccaaggctttgggggcgacggtgatcgccaccgccggcggcgccgatcgcctggagatcgcccgccagcacggcgccgattacggcatcgatcatcggaacgagaacatcaaggcccgggtgcgcgaactgaccggtgggcgcggcgtcgatgtcgtctatgatccggtgggcggcgatgtcttcgacgcctcgctgcgctgcacggcgcccgacggtcgcatcctggtggtcggtttcgccagcggcgccattccgacgcccccggccaatctgttgctggtcaagaacatcacggtcatcggcttcaattggggcggctatcgccagatcgccgagcagcgggttcgcgaatcgatggaagacgtggtgtcgtggtgggatcgcgggctggtcaccccccatgtcggggcgcgcttcgcgctgtcccaggccgccgaggccctggccgccctccgggagcgcaagatcatcggcaaggccgtgctgatccccgattga

SEQ ID NO: 51590 - protein, 325 aa, Rhodospirillum rubrum
MRAMVCDAFGPPDVLRVADLPDPPLPPDGVRIRVRAAGINFADGLFIAGQYQIRPRPPFIPGFEVAGDILEVGPEVLDLRPGQRVMAILDQGGYADQVVAPARDVHALTDRMDLLAAGGFPIAYGTSHFGLTDRCRLRPGEIVLIHGAAGGVGLTAVECAKALGATVIATAGGADRLEIARQHGADYGIDHRNENIKARVRELTGGRGVDVVYDPVGGDVFDASLRCTAPDGRILVVGFASGAIPTPPANLLLVKNITVIGFNWGGYRQIAEQRVRESMEDVVSWWDRGLVTPHVGARFALSQAAEALAALRERKIIGKAVLIPD

SEQ ID NO: 51591 - DNA, 1011 bp, Ralstonia metallidurans CH34
  CDS (1)..(1011)
atgaaggcgctcgtatgcaagcagttcggcggcgtcgaggatgtggaactcgcgaccgtgtccgaacccgccctggccgacccccatgcggtcacgatcgaagtggagttcgccagcgtcagccatgccaccggcctgatgatcgctggccagtatcagcgccgcccgccgctgccattcgtgcccggcacggaagcggtgggacgcgtggtggcctgcggcaaggccgtcacacggctgcgcccaggtgaccgggtcgtagccattgccgactggggctgctacgcggagcgattcacggtacctgagtacaccgtctaccctgtccccgactcgctgccgccgaaggtcgcgctgccgatcccgctctcgtacggcaccgcctattgcggcctggtctggcgttgcgcgctgacgccgcaggacaccctgctggtgctcggcgctggcgctggcgtcggactcgcggcggtggagatcgggcggcaacttggggcgaccgtggttgcctgcgccagcaccgaggcaaaacgcgccgacgcgctgcgccgcggggccacgcacgcggttgcgccccaggacctcgccgctcaagtcaaggcacttaccggtggccgtggcgcggatgtggtggtggacccggtcggcggcgacctgttcggccaggcgctgcgcgccgcagcgccgaacgcgcgcattcttagcatcggctttgccagcgggtccatcccgcaggcgccggtcaatctgctactggtcaagaacctgacgctgcacggcttcttcttcggccgatacatcggctggacgccgtccgacgagcgcgccgagcacgccccggcgttgcagcaggtcatgtccaccctgtttcagtgggctgcggaagggaagctggagccgaccgtgtccgctgtctatccgatcaccggcctgggggatgccctcgccgcgctggaatcccgcaaggttgttggcaaggtggcaataaaaatcaaggagacagagacatga

SEQ ID NO: 51592 - protein, 336 aa, Ralstonia metallidurans CH34
MKALVCKQFGGVEDVELATVSEPALADPHAVTIEVEFASVSHATGLMIAGQYQRRPPLPFVPGTEAVGRVVACGKAVTRLRPGDRVVAIADWGCYAERFTVPEYTVYPVPDSLPPKVALPIPLSYGTAYCGLVWRCALTPQDTLLVLGAGAGVGLAAVEIGRQLGATVVACASTEAKRADALRRGATHAVAPQDLAAQVKALTGGRGADVVVDPVGGDLFGQALRAAAPNARILSIGFASGSIPQAPVNLLLVKNLTLHGFFFGRYIGWTPSDERAEHAPALQQVMSTLFQWAAEGKLEPTVSAVYPITGLGDALAALESRKVVGKVAIKIKETET

SEQ ID NO: 51593 - DNA, 1068 bp, Enterococcus faecium
  CDS (1)..(1068)
atgaaaaaattagttgcattagaaccaagaatagccggattcaaagattacgaagaccgtgagatcgaaaagaacgaagtacgtatccgagtaattttcgctactccaaaaccaggaacagaaattgtcgactttagaggattaagtccatttatcgatgaagaattttcagaagaatggcgcctattcttgccaagagaagaaggaagccaacgcggtgtggtatttggcgaatttcaattaggaaatatgattgtcggtacgatcgaagaaacgggcagtttggtgacagagtatcaaaaaggagagttagtctgcacttatggacccattcgtgaaacgctgattacaaacggtgttgataattataaactacgtaaacttgatcggttggatcaatggaaaaatgcagtatgttacgatcctgctcaattcgctttaggtggtatccgggaagcacatgttcgagcaggtgatgctgtagcaatcttcggtttaggcgctatcgggcaaattgcgattcaattagctaaaaaagcaggtgctactaccatcgttgggatcgatcccatagcgcagcgtagagaattagcagaaaaatacggtgccgattacacgctagatcctatgaaagcagatgtcggttttcgtctaaaggaattgacagataaacgtggagtagattcagttattgaaacgagtggcagtgctgccgcattacaagcttctttaagagggatcggctatggcgggatcatttcttatgttgcctttgctaaaccttttccagctgggtttaatcttggtcgcgaagcacatttcaataatgcaaaaatcgtctttgctcgagcatctagtgaaccaaacccagattacccaagatggaaccgtaaacgaatcgaggacacatgttgggaattattgatgaacggttacttggattgtgaagaaatcattgatccagttgtgccatttgcagaaagcgcagaagcttacatgcgttatgtagaccagcacccagaagaaagtatcaaaatgggcgttcaagtccgaggaggagaacaatga

SEQ ID NO: 51594 - protein, 355 aa, Enterococcus faecium
MKKLVALEPRIAGFKDYEDREIEKNEVRIRVIFATPKPGTEIVDFRGLSPFIDEEFSEEWRLFLPREEGSQRGVVFGEFQLGNMIVGTIEETGSLVTEYQKGELVCTYGPIRETLITNGVDNYKLRKLDRLDQWKNAVCYDPAQFALGGIREAHVRAGDAVAIFGLGAIGQIAIQLAKKAGATTIVGIDPIAQRRELAEKYGADYTLDPMKADVGFRLKELTDKRGVDSVIETSGSAAALQASLRGIGYGGIISYVAFAKPFPAGFNLGREAHFNNAKIVFARASSEPNPDYPRWNRKRIEDTCWELLMNGYLDCEEIIDPVVPFAESAEAYMRYVDQHPEESIKMGVQVRGGEQ

SEQ ID NO: 51595 - DNA, 996 bp, Thermobifida fusca
  CDS (1)..(996)
atgaaagcgctgcgggtgcacaacctgggagagcccaaagacgttctcaagctcgaagaagtccctgtccccgagcctgccccggggcagatcgtggtccgcgtactcgccacagcggtcaacttccccgacgcgctgatgtgccgcgggctctaccaggagaagccgcccctgccgttcacccccggcgtggaactgtgcggcgaagtcgtggccctgggcgagggcgtcaccacagtcaccgaaggcgaccgcgtcatcggctccccggtcctgccctacggatcgttcgcggaatacgcgcccatggacatcagccgtgtcttccctgcgcccccctccctcagcgacacagaagcggcggccctgttcatcggctaccagaccggatggttcgccctgcaccgccgggccgggctgcaagccggggagaccgtcctcgtccacgccgcggccggcggggtcggcagcgccgcagtccagttggccaaagcagcgggcgctcgcgtgatcggtgtcgtcgggggcgcggccaaagccgaatacgcccgcaaactgggcgccgacatcgtcgtcgaccggtatgtcgacgacttcgtgtccgtggtcaaggaagccaccgacgggcgcggtgccgacgtcatctacgacccggtgggcggcgagtcctacacgcgctccaccaagtgcatcgccttcgaaggacgcatcctcatcatcggcttcgccagcgggacgatccccacccctggcctcaaccacgcccttgtcaagaactactcgctgctcggcctgcactggggcctctacaacaagcggaaccccgcactcgtggcccactgccacgaagaactcaccgccctcgcggagcgcggtgcgatcaaacccgccgtcagcgaggtgctcagcctggaagagctgccggacggggtgcagcgcctcgcagacggcaccaccgtgggacgcctggtggccaccccgcacggagcccagtaa

SEQ ID NO: 51596 - protein, 331 aa, Thermobifida fusca
MKALRVHNLGEPKDVLKLEEVPVPEPAPGQIVVRVLATAVNFPDALMCRGLYQEKPPLPFTPGVELCGEVVALGEGVTTVTEGDRVIGSPVLPYGSFAEYAPMDISRVFPAPPSLSDTEAAALFIGYQTGWFALHRRAGLQAGETVLVHAAAGGVGSAAVQLAKAAGARVIGVVGGAAKAEYARKLGADIVVDRYVDDFVSVVKEATDGRGADVIYDPVGGESYTRSTKCIAFEGRILIIGFASGTIPTPGLNHALVKNYSLLGLHWGLYNKRNPALVAHCHEELTALAERGAIKPAVSEVLSLEELPDGVQRLADGTTVGRLVATPHGAQ

SEQ ID NO: 51597 - DNA, 1083 bp, Thermobifida fusca
  CDS (1)..(1083)
atgagagcggtccgctacgacggcacaggtctctacctgagcgacatccccgcccccgtggccggccccggacaggtcgtcctcgaagtcaccgccgccggcctgtgccactccgacctggcggtcatgagccgaccgcccgaagccctgccctacaagctgccgatcaccctgggacatgaagcggtcggcgtggtcgtcgacgtcggcgcgggcatctccggcctggccgaaggcgacacggtcgcggtgtacggtccgcacggctgcggcgcttgccgcacctgccggagcggggcagaaaaccactgtccacacgcccgggcggcaggcatcctgccgcccgggctgggcgcggacggcgcacttgccgactaccttcttgtcccccattcccgccacctggtccccctgcgcggtctcgacccggtccgcgctgccccgctcaccgacgcggggctcacctcctaccacgcggtccggtccgcgctgccccggctgccgcccgacggcaccgccctcctcatcggtatcggcgggctcggacacctcgcggtccagatcctgcgtgccctcagcagcgcgcagatcatcgcggtagacatggccgccgacaagcgggaactggcgctccgctgcggggcggacacggccctgccctccacggacacggtccccgaccaggtgcgggacctcaccgaaggggtaggcgctgacgtggtcttcgacttcgtcgccagtgacgccaccctgcgcatggctgcacgcagtctccgccccggcggggagatcagcatcgtgggggtgggggaggggcggctgcccgtggccgtaaacctggtgcctctcggagcggtcgtccgcaccccctactggggcacccagtccgaccttgtcgacgtgctcgcgctcgcccgcgagggacggatcaccgtggaggttgaagagtacgcgctggaggagacgcccctggcgtacgaacggctggcacgcggcaacgtccggggccgcgccgtggtgaatcccgcgcgcgctccgggaaacgcccccgggcaggcatgcgcggaagaacagcgggggtga

SEQ ID NO: 51598 - protein, 360 aa, Thermobifida fusca
MRAVRYDGTGLYLSDIPAPVAGPGQVVLEVTAAGLCHSDLAVMSRPPEALPYKLPITLGHEAVGVVVDVGAGISGLAEGDTVAVYGPHGCGACRTCRSGAENHCPHARAAGILPPGLGADGALADYLLVPHSRHLVPLRGLDPVRAAPLTDAGLTSYHAVRSALPRLPPDGTALLIGIGGLGHLAVQILRALSSAQIIAVDMAADKRELALRCGADTALPSTDTVPDQVRDLTEGVGADVVFDFVASDATLRMAARSLRPGGEISIVGVGEGRLPVAVNLVPLGAVVRTPYWGTQSDLVDVLALAREGRITVEVEEYALEETPLAYERLARGNVRGRAVVNPARAPGNAPGQACAEEQRG

SEQ ID NO: 51599 - DNA, 1014 bp, Novosphingobium aromaticivorans DSM 12444
  CDS (1)..(1014)
atgcgttgcgccgatttcaccggccccggacagatcgtcttccgccccgccgcgaccccgcccacccccggccccggtgaagtgctcgtcgcggtaagaacctgtggcatctgcggctcggacctccacatgttccgcgacaattcctaccgcgacaagctcgtgcgcgagacggtggagggttacgcggtgccgggacacgaattcgcaggcaccatcgccgctctgggcgatggcgttgcaggctggtcgatcggggaccgggtcgtcggagtgacgggcatgggcggcggaatggccgatctcgtggcggttccggccaacccatggcaactcgtgaaggtgccggacggactttcctgggaacttgccgccacgaccgagccgctggccgatggcctccagatggtgcgcaagggggcgccgaccgacggcgagaacgtcgtcgtcatcggagtgggaatcatcgggctgggcgtgatccaggccatccttgcacgcggcatctctcccgcgcgcatcatcgcggtcgatgtccatcagacccggttggacacagcgcttcaggtgggtgctacacacgccgtaaacgcccgcgacggcgatgttttcgaagccattggtgccatctgcgggatcggtgagacatacgccgggcaatcggccaacatctcggtcatcttcgattgcgccggctacatccggcacatgaaaggccccccgccgttggagacggccctgcgccttgtcgtccccggcggccgcatcgtctgcttcggcggtttcgaggggcgaatggagatcgacatgagcccgctgatcgagaagcaaccgacgatcttcggctccaacggctatgcaccggaggaactggtcgaggcgctcgatcttatgagcggcggcaaggtggaccgcgcctgcctgatttcgcacgaatttccgctcgaacaggtagccgaggcatttgaccgacagctccagcctgatgctgtgaaggtcatgcttcgcatctga

SEQ ID NO: 51600 - protein, 337 aa, Novosphingobium aromaticivorans DSM 12444
MRCADFTGPGQIVFRPAATPPTPGPGEVLVAVRTCGICGSDLHMFRDNSYRDKLVRETVEGYAVPGHEFAGTIAALGDGVAGWSIGDRVVGVTGMGGGMADLVAVPANPWQLVKVPDGLSWELAATTEPLADGLQMVRKGAPTDGENVVVIGVGIIGLGVIQAILARGISPARIIAVDVHQTRLDTALQVGATHAVNARDGDVFEAIGAICGIGETYAGQSANISVIFDCAGYIRHMKGPPPLETALRLVVPGGRIVCFGGFEGRMEIDMSPLIEKQPTIFGSNGYAPEELVEALDLMSGGKVDRACLISHEFPLEQVAEAFDRQLQPDAVKVMLRI

SEQ ID NO: 51601 - DNA, 1041 bp, Novosphingobium aromaticivorans DSM 12444
  CDS (1)..(1041)
atgaaggccctgcgctactacggtgcccgcgacatccgccatgaatcgatggatgatccgacgccgcaatcggaccgcgacgcaatcgtgaaggtcgatgcctgctcgatctgcggctccgaccttcacatctaccacggccacggcttttccgaggatatcggcttctgcgtgggccatgaagcggtgggcgaagtggtcgaggtcgggcgcggcgtccaccggctcaaggtcgggcaaaaggtgatgatccccgccgcggtcggctgcggggcctgccgctcgtgcctcgcaggggtggtcaacacctgcgaaaacaatggctcgggctgctacggcctgtccgcgaagctacagggatcgcaggcagaggcggtgcgcgttcccgctgcggatgccaatgcggtcgccattcccgaaggcgtcagcaccgaacaggcgctgatgatgaccgacgcgctcgccacggcatggttcggtgcacgccaggccgatatccgccccggcagttcggtcggcatcatcggcctcgggccgatcggcctcatggcggcggagagcgcattcgtgatgggcgcacatgttgtctatgcgatcgatcccgtgccggaacgccgcgccatcgcggaaagcctcggggccattgccttgcatccggacgaggcttccgcgcggatcaaggaggacacgcacggcaggcgcctcgattgcgtggtggaagtcgtcggatcggatgccaccgtcgacatggccctgcggctcgtgcgcgtgcgcggcacggtctcggtgatcggcgtccagcaatcgcgccgctttcccttcccgctcgagcgggccttcgccggcggactcaccttccgcgtgggcacctgctcggtcccggaggaactgccagctctgttcccgcttgtcgcttcgggccgcctgcgccccgaacgctacatcagccaccgcctgcccctgtcgcagggcgccgaagcctaccgcatgttcgaggcgcgcgaggcaggcgcgctcaagatggtgcttgtgccggactga

SEQ ID NO: 51602 - protein, 346 aa, Novosphingobium aromaticivorans DSM 12444
MKALRYYGARDIRHESMDDPTPQSDRDAIVKVDACSICGSDLHIYHGHGFSEDIGFCVGHEAVGEVVEVGRGVHRLKVGQKVMIPAAVGCGACRSCLAGVVNTCENNGSGCYGLSAKLQGSQAEAVRVPAADANAVAIPEGVSTEQALMMTDALATAWFGARQADIRPGSSVGIIGLGPIGLMAAESAFVMGAHVVYAIDPVPERRAIAESLGAIALHPDEASARIKEDTHGRRLDCVVEVVGSDATVDMALRLVRVRGTVSVIGVQQSRRFPFPLERAFAGGLTFRVGTCSVPEELPALFPLVASGRLRPERYISHRLPLSQGAEAYRMFEAREAGALKMVLVPD

SEQ ID NO: 51603 - DNA, 1002 bp, Novosphingobium aromaticivorans DSM 12444
  CDS (1)..(1002)
atgaaggctctgcgcacccacgcggcaggcggccccgaaaccctcgtgctcgacgatctgcccgatccggtgccgggcaagggcgaagtgctggtgcgggtccatgcctgctcgataaacttccccgacaccctgatgatccgcgacctctaccagttccggcccgagcgcccctatgcgccgggcagcgaactggcgggcgagatcgaggcgctgggcgagggcgtcaccggctggaaggttggcgaccgcgtaatcgcgatgatcggcagcggcggccttgccgaaaaggtcattgccccggtcgcgcgcctgtttccgctgcccgacggcgtcgactacgccaccggcgcctcactgctgatgacctacggcacgacgatccacggcctcaaggatcgcggccatatcaaggccggcgacacggtgctcgtcctcggcgcggctggcggcgtcgggctttcggccgtcgaactcgccaaggccttcggcgcccgcgtcatcgccgccgtgtcgagcgaggagaaggcgcaggtcgtgcgcgaggccggcgctgacgacgtcgtcatctacggccggccgcctttcgacaaggcccagtccaaggcgctggccgaccagttcaaggccgcctgcggcccgaacggcgcggacatcgtctacgatatcgtcggcggcgactattccgagcccgccctgcgtgccatcgcatgggagggccgtttcctcgtggtcggcttcccggcgggcatcgccaagctcccgctcaacctcacgttgctcaagtcctgcgacgtctgcggcgtgttctggggggcgtggaccgcgcgcgaacccgccgccttcaaggccgaggtcgaggaactgttcgccctgctcaaggccggcaagatcaacccacgcgtctcgcagcgcttctcgctcgaacagggccgcgaagccatcgccacgctggaaaaccggcaggccatgggcaaggtcgtcgttgaaatgatcggctga

SEQ ID NO: 51604 - protein, 333 aa, Novosphingobium aromaticivorans DSM 12444
MKALRTHAAGGPETLVLDDLPDPVPGKGEVLVRVHACSINFPDTLMIRDLYQFRPERPYAPGSELAGEIEALGEGVTGWKVGDRVIAMIGSGGLAEKVIAPVARLFPLPDGVDYATGASLLMTYGTTIHGLKDRGHIKAGDTVLVLGAAGGVGLSAVELAKAFGARVIAAVSSEEKAQVVREAGADDVVIYGRPPFDKAQSKALADQFKAACGPNGADIVYDIVGGDYSEPALRAIAWEGRFLVVGFPAGIAKLPLNLTLLKSCDVCGVFWGAWTAREPAAFKAEVEELFALLKAGKINPRVSQRFSLEQGREAIATLENRQAMGKVVVEMIG

SEQ ID NO: 51605 - DNA, 1020 bp, Clostridium thermocellum ATCC 27405
  CDS (1)..(1020)
atggtatctcctggaaagattgagttccatgaggtggaaaaaccggaactaaaacctggacaagtactaataaagattatgagaattggcatatgtggttcggatattcatgtaaatcatggaaaacatcctttcacaaagtatccggtaactcaaggacatgaagtaagtggaaaaatcgtcgaagttgcagaagatgtggagcatctgaaagttggccagaaagtgactatagagcctcaggttgtatgtggtaaatgtcatccgtgccgtacaggaaaatataacctctgtgaggaactaaaagttatgggattccagaccgttggcgcaggcagcgaatattttgctgttgatgcgaagaatgtaacgactgtccctgaccatctttcttatgacgaggccgcgatgattgagcctttggctgttaccgttcatgcggcaaacagagtcggtgatgtgaaggataaggacattgtagtaataggtgcgggtcctataggaattttgctggttcagaccctgaaagcaaaaggtgcccgcaaggtaatggttacggatgtaagcgattatcgtttggaattggcgctcaagtgtggtgctgattttgcagtcaataccaaaaaagaagatttcggagaagcgatgcttcgctgttttggacctgataaagcagatgttatatatgattgtgcgggcaacaatacaacaatggaacaagccataaaacattcccgcaagggaagcataattgttctggttgcagtatttgaaggtatggcaacagtcgatcttgcaactcttaacgataaggaactggatttgaatacgacaatgatgtatcggcatgaggactatgtggaagccattgagcttgttgaagcgggtaaagtaaaattaacccctctgatgagcaagcattttgcttttagagattgggaaaaagcctatgagtatattgacaataatcgtgaaattactatgaaagtcctcattgatgttaataacgatgatgattaa

SEQ ID NO: 51606 - protein, 339 aa, Clostridium thermocellum ATCC 27405
MVSPGKIEFHEVEKPELKPGQVLIKIMRIGICGSDIHVNHGKHPFTKYPVTQGHEVSGKIVEVAEDVEHLKVGQKVTIEPQVVCGKCHPCRTGKYNLCEELKVMGFQTVGAGSEYFAVDAKNVTTVPDHLSYDEAAMIEPLAVTVHAANRVGDVKDKDIVVIGAGPIGILLVQTLKAKGARKVMVTDVSDYRLELALKCGADFAVNTKKEDFGEAMLRCFGPDKADVIYDCAGNNTTMEQAIKHSRKGSIIVLVAVFEGMATVDLATLNDKELDLNTTMMYRHEDYVEAIELVEAGKVKLTPLMSKHFAFRDWEKAYEYIDNNREITMKVLIDVNNDDD

SEQ ID NO: 51607 - DNA, 1017 bp, Microbulbifer degradans 2-40
  CDS (1)..(1017)
atgaaagctgcacaatatgcgggaaataaaagttttaacgttgtagatggcgctaaagtgccccccgcagaaggcgaggtgtgtctacaggttggttacactggtatatgcggtaccgatatgcatatttaccacggggttatggatcagcgtgtttctattccacaaattatcggccatgaaatgtcgggtacggtagtggaagtaggcgcaggggtgaccgactatacagtaggcgaccgcgtagttgttcggcctttagattactgtggcgattgcccagcgtgtaatgcagggcattctcatgtgtgccataacctaaagtttatgggcatagatagcccaggggccttccaaagctactggacagttaaagcgcgcacgcttcacgcattgccagacaatgtgagcttaaagcaaggtgcactaatcgagccgctgtctgttgcctgtcacgatgtagcgcgcacgcgtttgcaagcgggtgaaaaagcattagttattggtggtggcccaatcggtcaactcgtagccttagtagcaaaaagtgttggcgcagaggtaatgatttctgaggtgagcgaagcgcgcctaaagtttgccgcagagcgcggtattaaaaccgttaaccccgtaaccgacgatattgaagcggtagtaaaagagtggactggtggtaaaggcgcggacgcagtatttgaagtatctggcgtggctgcagcagtagaaaccatgaccaaagttgccgcagtgcgtggtcgtatttgtatggtggcaatccattcgcaaaagccacaggtagacctgtttcagttcttctggaaagagctagaactgctgggcgcgcgagtatacgaatcggcggacttcgagcacgctattgagcttgtggccagcggcaaaattgatgtggattcatttattagctcggtaaccagtttgaacgatataggtaccgcatttgccagcatggataacaacccagccggaatgaaagcgttagtggagtgtaattaa

SEQ ID NO: 51608 - protein, 338 aa, Microbulbifer degradans 2-40
MKAAQYAGNKSFNVVDGAKVPPAEGEVCLQVGYTGICGTDMHIYHGVMDQRVSIPQIIGHEMSGTVVEVGAGVTDYTVGDRVVVRPLDYCGDCPACNAGHSHVCHNLKFMGIDSPGAFQSYWTVKARTLHALPDNVSLKQGALIEPLSVACHDVARTRLQAGEKALVIGGGPIGQLVALVAKSVGAEVMISEVSEARLKFAAERGIKTVNPVTDDIEAVVKEWTGGKGADAVFEVSGVAAAVETMTKVAAVRGRICMVAIHSQKPQVDLFQFFWKELELLGARVYESADFEHAIELVASGKIDVDSFISSVTSLNDIGTAFASMDNNPAGMKALVECN

SEQ ID NO: 51609 - DNA, 1020 bp, Oenococcus oeni PSU-1
  CDS (1)..(1020)
atgaaacaagttcaagttactgctgtcggagaaaattcgtttgttgatgtcgaccaaccacaagtgggtcgacaggatgttttaattaaaattaaggctaatggaatttgtgggtctgataccttctacacttcaattggtggaattccaccacgccaaggccatactccattgggacatgaagcagctggtattgtggccgatatcggttcggatgtagatgacgtttccatcggagatcacgtggtgatcaatccgatgtcggctgaagatggcattattggtaatggtggcgcacagggtgctttatcagactatgtcaatttaattaatgccaaagctaaccggaatttccgaattattccaaaaaatattccttgggaagttgctgctttaaatgagccgatggcggttgcgcagcatgctgtgaatcgttccaaagcgaaagctgatagtaaagttgctgtttttggggcaggaccaattggcctgggagcaattattagtttaaaggctttaggagttaagaacgtcgtcgcgatcgatattattcctgaaagattacaaaaggctttggatgttggtgccgattcaatcattgattccggcaaagaagacgtattggaacaattaattaagtttcatggtcaagggctggaaaaagttccaagcggaaataaacgttcggctaccgatatttatatcgatgcagccggagcttcgattgttccgaaaacagtttttaaaattgcccaataccgtgctgtttatacaattgttgctgtgcacaaaaaagaagttcctgtgaatttcggcgatctactcgatagagagttggacatcagactttcagtcggctatccaactgaaatttttcaggtaactgataatataatcaagtacccggaactatacgctaaaattatcagcaatgttttcccgttttcggatgccttaaaggctttgaaaaccgctgcaacgcccggcgcagcggacaaagttgttgtttcttttgactga

SEQ ID NO: 51610 - protein, 339 aa, Oenococcus oeni PSU-1
MKQVQVTAVGENSFVDVDQPQVGRQDVLIKIKANGICGSDTFYTSIGGIPPRQGHTPLGHEAAGIVADIGSDVDDVSIGDHVVINPMSAEDGIIGNGGAQGALSDYVNLINAKANRNFRIIPKNIPWEVAALNEPMAVAQHAVNRSKAKADSKVAVFGAGPIGLGAIISLKALGVKNVVAIDIIPERLQKALDVGADSIIDSGKEDVLEQLIKFHGQGLEKVPSGNKRSATDIYIDAAGASIVPKTVFKIAQYRAVYTIVAVHKKEVPVNFGDLLDRELDIRLSVGYPTEIFQVTDNIIKYPELYAKIISNVFPFSDALKALKTAATPGAADKVVVSFD

SEQ ID NO: 51611 - DNA, 981 bp, Trichodesmium erythraeum IMS101
  CDS (1)..(981)
atgaaagcattagttttagaaaaaccgggaattcctgatagtttatatattacagaaatacctttaccacaaccggcagcaggggaaatacgggtacaagttcatgctgtcggactaaaccctgttgactacaaacttgctgctgggggtttttcaacatggagttatccatttattttggggttagatgtggcaggggttgtggatgctgtcggtactgatgtgactgaatggcaggttggagagcaggtttattatcatggaaatttatctaaaccaggagcttatgcagaatatactaatgctaacgctttagcagttgctccacttccagagggtatttcttttacaaaagctgctgctattccttgtgctggtttcactgcttaccatgctttgcatcaccgtttgcatattcaatcaaaacaaactattttaattcatggtggtgctggtggagttggtagttttgccctccagttagcatctttggcaggtttggaggtgattacaacttgttctcagagtaattttgattatgtgcaaaagttgggagcaaagcatttaattgattataaaaatcaggatgtagttataagagtcaaggaaattactaacgaccgtggtgttgatgctattttagatacggttggttcggaaactgcaacaacaggtttgaaaatgttggcatttaatggtggaattgcttgtattgctgctttgcctgattttagtaatttcaaatcttttagtcttgctgcttctatccatcaaattgctttaggaggtgcttatttatctggggataaaaaagcgattcaagatttaggaaaaatggggagagaaatgggagaattagtaagagaaaagaaagttagtccgatgttaactgaagtaattagtttggaggaaataccgaaagcattaaatcgtttgaaaggtcgtcatgtaagaggaaaaatagttgctgaaattcgataa

SEQ ID NO: 51612 - protein, 326 aa, Trichodesmium erythraeum IMS101
MKALVLEKPGIPDSLYITEIPLPQPAAGEIRVQVHAVGLNPVDYKLAAGGFSTWSYPFILGLDVAGVVDAVGTDVTEWQVGEQVYYHGNLSKPGAYAEYTNANALAVAPLPEGISFTKAAAIPCAGFTAYHALHHRLHIQSKQTILIHGGAGGVGSFALQLASLAGLEVITTCSQSNFDYVQKLGAKHLIDYKNQDVVIRVKEITNDRGVDAILDTVGSETATTGLKMLAFNGGIACIAALPDFSNFKSFSLAASIHQIALGGAYLSGDKKAIQDLGKMGREMGELVREKKVSPMLTEVISLEEIPKALNRLKGRHVRGKIVAEIR

SEQ ID NO: 51613 - DNA, 1044 bp, Azotobacter vinelandii
  CDS (1)..(1044)
atgaaagctctggtcctggaaaagcagcacgacctgaagatccgcgacatcgacctgcccacgccgccagtggggccggacgacgtgcgcatccgcatccataccgtcggcgtgtgcggcagcgacgtgcactactacacccacgggcgcatcggtcatttcatcgtcgaccggccgctggtgctgggacacgaggcggccggcacggtcgtcgaggtcggcagcggcgtcacccgcctggccgtgggcgaccgcgtctgcatggagcccggcattcccgatcccaagtcgaaggcctcgcgcctgggcctctacaacgtcgatccttcggtcgtgttctgggccaccccgccggtgcacggctgcctgaccccggaagtcgtccatccggcggctttcgtctataaactccccgacaacgtcggcttcgccgagggggcgctggtggagcccttcgcgatcggcatgcaggcggccgtcaaggcccgcatcaagcccggcgacgtcgccgtggtcatcggcgccggcaccatcggcatgatgaccgccctggccgcgctggccggcggcgcgagccgggtgctggtgtccgacctgatggtggagaagctggccatcgcccagcgctatgaaggcatcaccgccgtcaacgtgcgcgagcgctccctgcgcgacgcggtggccgaggtcaccgacggctggggcgcggatgtggtgttcgaggccagcggtagcgcccgggcctatggcgatgcactggcggcggtctgcccgggcggggcgctggtattggtgggcatgccggtcgagccggtgcccttcgacgtggtggcggcccaggccaaggagatccgcatcgagaccgtgttccgctacgccaatgtctacgagcgggcggtgaacctgatcgccagcggcaaggtcgatctgaagccgctggtctcggcgacctaccccttcgaacggggtgtcgaggccttcgagcgggccgccagcgcccggccgggcgatgtgaaggtgcagatcaccttcggcgacggctga

SEQ ID NO: 51614 - protein, 347 aa, Azotobacter vinelandii
MKALVLEKQHDLKIRDIDLPTPPVGPDDVRIRIHTVGVCGSDVHYYTHGRIGHFIVDRPLVLGHEAAGTVVEVGSGVTRLAVGDRVCMEPGIPDPKSKASRLGLYNVDPSVVFWATPPVHGCLTPEVVHPAAFVYKLPDNVGFAEGALVEPFAIGMQAAVKARIKPGDVAVVIGAGTIGMMTALAALAGGASRVLVSDLMVEKLAIAQRYEGITAVNVRERSLRDAVAEVTDGWGADVVFEASGSARAYGDALAAVCPGGALVLVGMPVEPVPFDVVAAQAKEIRIETVFRYANVYERAVNLIASGKVDLKPLVSATYPFERGVEAFERAASARPGDVKVQITFGDG

SEQ ID NO: 51615 - DNA, 981 bp, Desulfitobacterium hafniense DCB-2
  CDS (1)..(981)
atggcgcgacggcagcacgaagtcgccgacgtccccgcccccgcgctgcgccgcgggcaactgctgatccgcagccacgtcaccctggtttcggccggcaccgaacgcatgctggtcgagttcggcaaggccaacctgttgcagaaggcacgccagcaaccggacaaggtgcgcatggtgctggagaaggtctgcaccgacggcctggccaccaccctcgacgcggtgcgcagcaagctcgatcagccgctggcgctgggctattgcaacgtcggcacggtgatcggcgtcggcccgggcgtgaccgggttcgagatcggcgaccgcgtcgccagcaacggcaagcacgccgaagtggtcgcggtgccggtcaacctgtgcgccaagattcccgacgacgtcggcgacgaggccgccgccttcaccgtgctgtcggccatcggcctgcagggcatccgcctggtccagcccacgctcggcgaaaccgtggtggtcaccggcctgggcctgatcggcctgatcaccgtgcagttgctgcgcgcgcacggctgccgcgtgctcggcatcgacttcgacccggccaagctggcgctggcgcgcggctatggcgccgaaaccgtcgacctgtcgcgcggcgaagacccggtcgccgccgcgcacagcttctcgcgcgggcgcggcgtcgacgcggtgatcatcaccgcgtccagcaagagcaacgagccggtgtcgcaggccgcacacatgtgccgcaaacgcggccgcatcgtcctggtcggcgtcaccgggctggagctgtcgcgcgccgacttctacgagaaggagctgtcgttccaggtctcgtgttcctacggcccgggccgctacgacccgtcctacgaggaacgcggcaacgattacccggtcggcttcgtgcgctggaccgagcagcgcaatttcgaagcggtgctggacatgatggcggccggcgcgctgcagtag

SEQ ID NO: 51616 - protein, 326 aa, Desulfitobacterium hafniense DCB-2
MARRQHEVADVPAPALRRGQLLIRSHVTLVSAGTERMLVEFGKANLLQKARQQPDKVRMVLEKVCTDGLATTLDAVRSKLDQPLALGYCNVGTVIGVGPGVTGFEIGDRVASNGKHAEVVAVPVNLCAKIPDDVGDEAAAFTVLSAIGLQGIRLVQPTLGETVVVTGLGLIGLITVQLLRAHGCRVLGIDFDPAKLALARGYGAETVDLSRGEDPVAAAHSFSRGRGVDAVIITASSKSNEPVSQAAHMCRKRGRIVLVGVTGLELSRADFYEKELSFQVSCSYGPGRYDPSYEERGNDYPVGFVRWTEQRNFEAVLDMMAAGALQ

SEQ ID NO: 51617 - DNA, 1074 bp, Methylobacillus flagellatus KT
  CDS (1)..(1074)
atggctaccatgaaagctgctgtattcgtctcccccggcaaaatagcgttgcgcgacaagcccgtccctgaaatcggcccgctggatgccttgatccgcatcaccaccacgaccatctgcggcacagatgtgcatatcctcaagggtgaatacccagttgcggcaggactgacagtcggacacgagcccgtcggcatcattgaaaagctggggtcagaggtacacggcttcaaggtaggccagcgcgtcatcgcaggtgcgatcacgcccagcgggcactccaacgcctgcctgtgcggcatcggcgcccaggatggcccggacagcccgcacggtttcaaggtggcaggtggctggaaatttggcaacaccatagacggcagccaagcggaattcctgcgcgtgccggatgccatggctaacctgagcccgatcccagaccacctcagcgacgagcaagtactgatgtgtccggacatcatgtcgaccggcttctctggcgcagagcggggcaacatcaagattggcgatacagtggtgatatttgcgctgggccccatcggcctctctgccgtcgcaggcgccaaactgctgggagccaccaagatcatcggcgtggattccattcctgacaggctcaacatcgcccgcgcgctaggcgcagaccatgtcatcaacttcaagactcatgacccggtgcaggaaattctcaagctgacagacggacgcggcgtggatgtcgcaatcgaggcactgggcgtgcaacagacattcgagtccagcctgcgcgtgctgcgtccgggcggcaccttgtccagcctgggcgtctattcctccgacctcaggctgccactagatgccttcggggccggactgggggacttcacgatcgtgtccaccctctgtcccggaggcaaggagcgcatgcgcagactgatggaggcagtcggctcgggccgcgctgacctgagcaatctggtgacccatcgcttcaagctcagcgagatcgaggaggcttacgacttgttcgccaatcagcgtgacggcgtcatcaaggtagccatcacaccctag

SEQ ID NO: 51618 - protein, 357 aa, Methylobacillus flagellatus KT
MATMKAAVFVSPGKIALRDKPVPEIGPLDALIRITTTTICGTDVHILKGEYPVAAGLTVGHEPVGIIEKLGSEVHGFKVGQRVIAGAITPSGHSNACLCGIGAQDGPDSPHGFKVAGGWKFGNTIDGSQAEFLRVPDAMANLSPIPDHLSDEQVLMCPDIMSTGFSGAERGNIKIGDTVVIFALGPIGLSAVAGAKLLGATKIIGVDSIPDRLNIARALGADHVINFKTHDPVQEILKLTDGRGVDVAIEALGVQQTFESSLRVLRPGGTLSSLGVYSSDLRLPLDAFGAGLGDFTIVSTLCPGGKERMRRLMEAVGSGRADLSNLVTHRFKLSEIEEAYDLFANQRDGVIKVAITP

SEQ ID NO: 51619 - DNA, 1044 bp, Rubrobacter xylanophilus DSM 9941
  CDS (1)..(1044)
atgaaggccgcgcgcctgtacgagtacgaccccgagctcgaggggcaggagttcctgaaggtggaggaggttcccgagcccgaaatcgaggcgcccgatgacgtgatagtgcgggtcggcggggcgggggtgtgcaggacggacttgcacatcatcgaggggctctgggacgaggcgctggtcgtcgagcctccctacactctggggcacgagaacgccgggtgggtggaggaggccggatcctccgtgagccggttcgcgccgggggacgcggtcgtgatccagcccgccctctccgacgggacgtgcctctcctgcctcagggggcgcaacaacctgtgcgagagcctggtctggatcggcatccagcagaacggcgggttcgccgagtacgtgcgggtcaaggagcgcaacctcgtgaagctgcccgagaatgtcgagcccagggacgccgccccctacgccgacgcgggcctcaccgcttaccacgccaccaagaaggcggcccgggtcctcgacgcgggcgacgtggccgtggtcatcgggatcgggggtctgggacacatcggcgtccaggtgctcaaggccctgagcccggcccgcgtcgttgccctggacaggtccgagggagccctccggctggccgaggaggtcggcgcggatcacgtcgtgaacagcgccggggacgcggtggacagggtgctggagctcacgggcggcaggggggcgcaggcggtcgtcgacttcgtgggggaggccgacgtgccggcacgggcgctggcgatgacccggacgggagggtactacttcgtcgtcgggtacggcggggagatccgggtccccaccatggagatgatcgccaccgagaagagtatcgtgggcaacatcggcggtaccacgagcgagctgcacgagctcatcgccctggccggcgagggcaaggttcgcatgaacgtgcgccactacccgctggaggaggcgaaccgggcgctcctcgacctgcacgagggcaggatccacgggcggggcgtgctggtcccctga

SEQ ID NO: 51620 - protein, 347 aa, Rubrobacter xylanophilus DSM 9941
MKAARLYEYDPELEGQEFLKVEEVPEPEIEAPDDVIVRVGGAGVCRTDLHIIEGLWDEALVVEPPYTLGHENAGWVEEAGSSVSRFAPGDAVVIQPALSDGTCLSCLRGRNNLCESLVWIGIQQNGGFAEYVRVKERNLVKLPENVEPRDAAPYADAGLTAYHATKKAARVLDAGDVAVVIGIGGLGHIGVQVLKALSPARVVALDRSEGALRLAEEVGADHVVNSAGDAVDRVLELTGGRGAQAVVDFVGEADVPARALAMTRTGGYYFVVGYGGEIRVPTMEMIATEKSIVGNIGGTTSELHELIALAGEGKVRMNVRHYPLEEANRALLDLHEGRIHGRGVLVP

SEQ ID NO: 51621 - DNA, 1023 bp, Chloroflexus aurantiacus
  CDS (1)..(1023)
atgaaacccttacccgcgcaagccatctggtttaccgccccccacacggtgagcatccgtgaggagattgctccaccaccggcttacggtgacgtgcggatcgcagctattgcatcgttgatcagtcacggcaccgaacgcctggtctatcgcggtgaggtcgatccaaccctggccctcgatctcccaacgctgcaaggaagttttgcctttcccatcaaatacggttacgccatcgccggcagagtcatcgacattggcccaggggttgagcagtttcagattggtgatccggtcgcggccctccatccgcaccagactatcttcaccctaccggcgcatctggtcaaacggctaccggacacccttgatccggcattgggtgggttctacgccaatgtcgaaacagcgctgacgatttgccacgatgcagcaccaaggctgggagaaactgtcgttgtgctgggacagggtgtggttggcttgctggtcacacagctcttgcaacgaaccggtgcgcaggtgattgcggtcgaacccgatgcgcatcgtcgggcgctggccacccaattcggtgccacgacccttgcccaggctgatccggcaaccattgccgaacttaccgatggacggggggccgatatagtggttgaggtgagcgggtcaccggctgcgttacaacaggcgattgaactaacagcgacagaggggctggtggtggttgcatcgtggtacgggcaaaaaccggcaccactgatcctgggagggcattttcaccgtggtcgggtacgcctgcgctcatcgcaggttggtcggctggctccagaaacgctgccacgctgggattacgcacggcggagcgccaccgtgatgaacctcttaccgcgcctatgcctgaacgagttgatcagccaccgcattcctttcgtgcaagccgcagcagcgtatgatctgcttgatcaggcaccgccagggctggtacaggtgatgttgacgtatgctgattacgcaccacaaacgtga

SEQ ID NO: 51622 - protein, 340 aa, Chloroflexus aurantiacus
MKPLPAQAIWFTAPHTVSIREEIAPPPAYGDVRIAAIASLISHGTERLVYRGEVDPTLALDLPTLQGSFAFPIKYGYAIAGRVIDIGPGVEQFQIGDPVAALHPHQTIFTLPAHLVKRLPDTLDPALGGFYANVETALTICHDAAPRLGETVVVLGQGVVGLLVTQLLQRTGAQVIAVEPDAHRRALATQFGATTLAQADPATIAELTDGRGADIVVEVSGSPAALQQAIELTATEGLVVVASWYGQKPAPLILGGHFHRGRVRLRSSQVGRLAPETLPRWDYARRSATVMNLLPRLCLNELISHRIPFVQAAAAYDLLDQAPPGLVQVMLTYADYAPQT

SEQ ID NO: 51623 - DNA, 1041 bp, Polaromonas sp. JS666
  CDS (1)..(1041)
atgaaagccgccgttctgcgcgcccccaaggtactgcaactcagcgacatcgccacaccggaagccgcacccggcgagctggtgctgcgtgtgcgggctgcgatggtctgcgggacggatctgcgaattttgactggccgaaagaccaagggggtacgttttccctcggtcatcggacacgagtttgcgggcgaagtggttcaggtcggcgacggcgtgactcagttcaagacgggagaccgtgtctgcatggatcccgtcatcccctgccgggcctgcgcctattgcaagaccgggcacgaaaatgtctgccttcatcggcaggccatgggctatgaattcgacggcgcttttgccgagtacatccgtattccggcgatcgcgctcacggcgggaaatgtgttcatgatgcccgcgcagatgagctttgaatccgccgcactcgccgagcccctggcctgctgcatcaacggccagcgcaatgccggtgtccaggtcggagataccgtggtggtcctcggagccggccccatcggcctgatgcacgccgcgctggcgcgtctctcgggagccaggcaggtgattgtcagcgagcccaatgcggcgcggcgccaggctgccgtcgaccggggcgttgaacatatgtgcgaccccagcaccgagtctgtcatggagtttgtcaaggcccgcaccgacggactcggcgcggatgttgtgattctcgccattggcgtcccgcagcttgccaatgaatcgctcaatctggtccgcaaggggggacacgtcaacctctttgcgggtttctcggccggtgagacctcgaacatcgatgtcaacctgatccactacaacgaaatcgtggtcacgggcgccagtgccctgaggcgacgcgactacgaacttgcgctgaacatgctgtcagccggtcagatcgacgccaattcgctgatcacccatcgctacgaggtcgcggattcgctggcagcctttgacgaagccggcagcggccgggccctgaaggtggcgattcacaatgtctga

SEQ ID NO: 51624 - protein, 346 aa, Polaromonas sp. JS666
MKAAVLRAPKVLQLSDIATPEAAPGELVLRVRAAMVCGTDLRILTGRKTKGVRFPSVIGHEFAGEVVQVGDGVTQFKTGDRVCMDPVIPCRACAYCKTGHENVCLHRQAMGYEFDGAFAEYIRIPAIALTAGNVFMMPAQMSFESAALAEPLACCINGQRNAGVQVGDTVVVLGAGPIGLMHAALARLSGARQVIVSEPNAARRQAAVDRGVEHMCDPSTESVMEFVKARTDGLGADVVILAIGVPQLANESLNLVRKGGHVNLFAGFSAGETSNIDVNLIHYNEIVVTGASALRRRDYELALNMLSAGQIDANSLITHRYEVADSLAAFDEAGSGRALKVAIHNV

SEQ ID NO: 51625 - DNA, 975 bp, Polaromonas sp. JS666
  CDS (1)..(975)
atgcaagcctggctttgtgaaaatcccactggcgtagacgccctgacctggaaagagctgccgacgccgcagcccaaagaaggtgaggtactgattgagatcaaggccgccagcctcaacttccccgacctgctgatcgtgcagaacaagtaccagatcaagccgcccctgccctttgtgccgggctccgagtacgccggcgtggtgcaggccgtgggcgaaggcgtgaagcacctgcaggtgggccagaatgtcgcctgcctgtctggaaccggtggtttcggcacacacaccattgcgccggcagccctgtgcatgcccctgcccgccgggttctcgcacgtggatgcagccgccttcatcatgatttacgccacctcctggcatgccctgatggaccgcgcgcaattgaaggccggcgaaaccgtgctggtgctcggcgctgcgggcggagtcggcaccgccgccatccagatcgccaaggcggcaggcgcccgcgtgattgccgccgcctcgaccgatgagaaatgcgcgttttgcagcgccctcggcgcagacgccacgattaactacacgagcaaaaatctgcgcgatgaaatcaagacgctgaccggcggcaacggcccggatgtgatttatgacccggtgggcggcgactttgctgagccggctttccgctcgattgcctggcgcggccgctacctggtggttggttttgcatcaggccccatcccttcgctgccactgaacctggcgctgctcaagggtgcctccatcgttggcgtgttctggggtgactttgccaggcgtgaacccaaggccaacgcggccatgatggccgagctggcccgctggtacaccgagggcaagatcaaaccagccatcgaccgcaccatgcccatggctgaactcaaggcagcttatgcctacatgggttcccgtggggtcaaaggcaaactggtgatgattaattga

SEQ ID NO: 51626 - protein, 324 aa, Polaromonas sp. JS666
MQAWLCENPTGVDALTWKELPTPQPKEGEVLIEIKAASLNFPDLLIVQNKYQIKPPLPFVPGSEYAGVVQAVGEGVKHLQVGQNVACLSGTGGFGTHTIAPAALCMPLPAGFSHVDAAAFIMIYATSWHALMDRAQLKAGETVLVLGAAGGVGTAAIQIAKAAGARVIAAASTDEKCAFCSALGADATINYTSKNLRDEIKTLTGGNGPDVIYDPVGGDFAEPAFRSIAWRGRYLVVGFASGPIPSLPLNLALLKGASIVGVFWGDFARREPKANAAMMAELARWYTEGKIKPAIDRTMPMAELKAAYAYMGSRGVKGKLVMIN

SEQ ID NO: 51627 - DNA, 1170 bp, Halobacterium volcanii
  CDS (1)..(1170)
gtgcccacgcggtcggctcgcttccccgtggacgagcgggacggccgcccggccgcagttaaatggactattcatatagcatcgcatctatgcccgcaaggtccgtacctcacagcgtacgtgaaatcagcagtctatcgcggtccgggcgacgttcgcatcgaggaaaaaccagaaccggagcttcaacaaccgaccgacgcggtcatccgcgtcactcacaccgccatctgcgggtccgacctctggttctaccgcggtcacgaggaacacgaggagggctccggggtcggccacgagccgatgggtatcgtcgaggaagtcggtgaggacgtcacgagcgtccaaccgggcgaccgcgtgctcgtcccgttcgcgtacagctgcggggagtgcgagttctgtcgcaaaggcatccacaccgcgtgtgtagacggcgggttcttcggtccgcacggcgacgagaccggcggcgcacaggccgagaaggtccgcgtcctccacgccgacggcacggtcgttcgggtccccgagcggtacgccgacgacgaagagacgctcaaatcgctcctcccgctcacggacgtgatgtcgaccggccaccacgccgccgtcttggcggacctcgaagccggcgacaccgcggtcgtcatcggcgacggcgcggtcggactgtgcggcgtcctcgcggcgaagcgcatcggcgcagagcgaatcatcgcggtcggccaccacgaggaccgcttggaagtcgcccgcgaactcggcgcgaccgacaccgtctcgtcccgcggccaagaggccgtcgaggaagtcctcgaactcacccacggcggcgcgaaccacgtcctcgaatgcgtcggcgcggcgtcggcgctcgaaaccgccgcgcaggtcgcccgtcccggcggctccatcggcgccgtgggcgtcccgcacgtcgagtccgccgacttcctccagccgatattctacaagaacctctcgttctccgccggcggcgcacccgtccggaactacatcgaggaactcatggacgacgtgctgcagggcaccctcgacccgtcgcccatcctgacgaagaccgtcgacctcgacggcgtcccggaaggctatcaggcgatggacgaccgcgaggcaatcaaggtcatggtgaaagtcgacgagtaa

SEQ ID NO: 51628 - protein, 389 aa, Halobacterium volcanii
MPTRSARFPVDERDGRPAAVKWTIHIASHLCPQGPYLTAYVKSAVYRGPGDVRIEEKPEPELQQPTDAVIRVTHTAICGSDLWFYRGHEEHEEGSGVGHEPMGIVEEVGEDVTSVQPGDRVLVPFAYSCGECEFCRKGIHTACVDGGFFGPHGDETGGAQAEKVRVLHADGTVVRVPERYADDEETLKSLLPLTDVMSTGHHAAVLADLEAGDTAVVIGDGAVGLCGVLAAKRIGAERIIAVGHHEDRLEVARELGATDTVSSRGQEAVEEVLELTHGGANHVLECVGAASALETAAQVARPGGSIGAVGVPHVESADFLQPIFYKNLSFSAGGAPVRNYIEELMDDVLQGTLDPSPILTKTVDLDGVPEGYQAMDDREAIKVMVKVDE

SEQ ID NO: 51629 - DNA, 1062 bp, Candida sp
  CDS (1)..(1062)
atgtctactcctgaaaacttatcttttgttttacaaaagccttttgacgtcaagttcgaggatagacccatccccaagttgtctgatccttactctgtcaagatccaagtcaagaagactggtatctgtggtagtgatgttcattacttcacccatggagctattggtgactttgtcgtcaaggccccaatggtccttggtcacgaatccagtggtgttgtcttggaagtcggtagcgaggtcaagtcactcaaggttggtgacagagtcgctatggagcctggtgttcccagcagacactctgatgaatacaagtccggtagatacaacttgtgtcctcacatggcatttgctgctactcctccttatgatggtactctttgtaaatactatattcttcctgaagacttctgtgtcaagttacctgagcacgtttctttggaagagggtgctttagttgaacctttaagtgttgcggttcactcctctaagttgggtaacattaagcccggtagccatgttgccatttacggtgcaggacctgttggtttgttagttgccgcagtcgccagtgcttttggtgctgaatctgttactattattgatcttgttgaatctagacttaaccttgccaaggagttaggtgctactgccactgttcaagttgatttcaaggatactcctaaggagtctgctgctaaggttgttgccgctaacaacggaattgcccctgatgttgtcattgatgcttctggtgctgaggcttccattaatagtgctatcaatgccatcagacctggtggcacttacgttcaagtcggtatgggtaagcctgatgtctctttccccattgctactttaattggtaaggagcttactgttaagggatctttcagatatggttacggtgactaccctcttgctgtcagcttgcttgctagtggaaaagtcaatgttaaaaagttgattacccatgaagtcaagtttgaggatgctgctgaagctttccaattggttagagatggaaaggctatcaagtgcatcattaacggccctgagtaa

SEQ ID NO: 51630 - protein, 353 aa, Candida sp
MSTPENLSFVLQKPFDVKFEDRPIPKLSDPYSVKIQVKKTGICGSDVHYFTHGAIGDFVVKAPMVLGHESSGVVLEVGSEVKSLKVGDRVAMEPGVPSRHSDEYKSGRYNLCPHMAFAATPPYDGTLCKYYILPEDFCVKLPEHVSLEEGALVEPLSVAVHSSKLGNIKPGSHVAIYGAGPVGLLVAAVASAFGAESVTIIDLVESRLNLAKELGATATVQVDFKDTPKESAAKVVAANNGIAPDVVIDASGAEASINSAINAIRPGGTYVQVGMGKPDVSFPIATLIGKELTVKGSFRYGYGDYPLAVSLLASGKVNVKKLITHEVKFEDAAEAFQLVRDGKAIKCIINGPE

SEQ ID NO: 51631 - DNA, 1059 bp, Thermoanaerobacter ethanolicus
  CDS (1)..(1059)
atgaaaggttttgcaatgctcagtatcggtaaagttggctggattgagaaggaaaagcctgctcctggcccatttgatgctattgtaagacctctagctgtggccccttgcacttcggacattcataccgtttttgaaggagccattggcgaaagacataacatgatactcggtcacgaagctgtaggtgaagtagttgaagtaggtagtgaggtaaaagattttaaacctggtgatcgcgttgttgtgccagctattacccctgattggtggacctctgaagtacaaagaggatatcaccagcactccggtggaatgctggcaggctggaaattttcgaatgtaaaagatggtgtttttggtgaattttttcatgtgaatgatgctgatatgaatttagcacatctgcctaaagaaattccattggaagctgcagttatgattcccgatatgatgaccactggttttcacggagctgaactggcagatatagaattaggtgcgacggtagcagttttgggtattggcccagtaggtcttatggcagtcgctggtgccaaattgcgtggagccggaagaattattgccgtaggcagtagaccagtttgtgtagatgctgcaaaatactatggagctactgatattgtaaactataaagatggtcctatcgaaagtcagattatgaatctaactgaaggcaaaggtgtcgatgctgccatcatcgctggaggaaatgctgacattatggctacagcagttaagattgttaaacctggtggcaccatcgctaatgtaaattattttggcgaaggagaggttttgcctgttcctcgtcttgaatggggttgcggcatggctcataaaactataaaaggcgggctatgccccggtggacgtctaagaatggaaagactgattgaccttgttttttataagcctgtcgatccttctaagctcgtcactcacgttttccagggatttgacaatattgaaaaagcctttatgttgatgaaagacaaaccaaaagacctaatcaaacctgttgtaatattagcataa

SEQ ID NO: 51632 - protein, 352 aa, Thermoanaerobacter ethanolicus
MKGFAMLSIGKVGWIEKEKPAPGPFDAIVRPLAVAPCTSDIHTVFEGAIGERHNMILGHEAVGEVVEVGSEVKDFKPGDRVVVPAITPDWWTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLPVPRLEWGCGMAHKTIKGGLCPGGRLRMERLIDLVFYKPVDPSKLVTHVFQGFDNIEKAFMLMKDKPKDLIKPVVILA

SEQ ID NO: 51633 - DNA, 1089 bp, Pseudomonas putida
  CDS (1)..(1089)
atgaatgacctgagccacacccacatgcgcgccgccgtctggcatggccgtaatgatattcgcgtcgaacaggtccccctgccagccgacccggcacccggctgggtgcagatcaaggtggactggtgcggcatctgcggctccgacctgcacgaatacgtcgccggcccggtgttcatcccggtggaggcaccacacccgctgaccggcatccagggccagtgcatcctcggccacgaattttgcggccagatcgccaagcttggcgaaggcgtggagggctttgcggtaggtgacccggtggcggcggacgcctgccagcattgtggtacttgctattactgcacccacggcctgtacaacatctgcgagcgcctggcgttcaccggcctgatgaacaatggcgcctttgccgagttggtcaacgtacccgccaacctgctgtaccgcttgccgcaaggtttcccgccagaggccggggcactgatcgaaccgctggcggtgggtatgcacgcggtgaaaaaggccggcagcctgcttgggcagaccgttgtggtggtgggtgccggcaccatcggtctgtgcaccatcatgtgcgccaaggctgcgggcgcggcgcaagtgattgcgctggaaatgtcctcggcgcgcaaggccaaggccaaagaggtaggcgccaccgtggtgctggaccccagccagtgcgacgcgctggcgcaaatccgcgcactgacctttgggttgggggccgatgtgagctttgagtgcatcggcaacaagcacacggccaagctggccatcgacaccatccgcaaggcgggtaagtgcgtgctggtaggtatttttgaagagcctagcgagttcaacttcttcgaattggtatccaccgagaagcaggtactgggagcgttggcgtacaacggcgagtttgccgatgtgattgccttcatcgctgacggcaggctggatattcgcccgctggtgaccggccggatcgggttggagcagattgtcgaactgggcttcgaggaactggtgaacaacaaagaggagaacgtgaagatcatcgtttccccgggtgtgcgctga

SEQ ID NO: 51634 - protein, 362 aa, Pseudomonas putida
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPPEAGALIEPLAVGMHAVKKAGSLLGQTVVVVGAGTIGLCTIMCAKAAGAAQVIALEMSSARKAKAKEVGATVVLDPSQCDALAQIRALTFGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 51635 - DNA, 1047 bp, Rhodococcus sp
  CDS (1)..(1047)
atgaaggcgatccagtacacgagaatcggcgcggaacccgaactcacggagattcccaaacccgagcccggtccaggtgaagtgctcctggaagtcaccgctgctggcgtctgccactcggacgacttcatcatgagcctgcccgaagagcagtacacctacggccttccgctcacgctcggccacgaaggcgcaggcaaggtcgccgccgtcggcgagggtgtcgaaggtctcgacatcggaaccaatgtcgtcgtctacgggccttggggttgcggcaactgttggcactgctcacaaggactcgagaactattgctctcgcgcccaagaactcggaatcaatcctcccggtctcggtgcacccggcgcgttggccgagttcatgatcgtcgattctcctcgccaccttgtcccgatcggtgacctcgacccggtcaagacggtgccgctgaccgacgccggtctgacgccgtatcacgcgatcaagcgttctctgccgaaacttcgcggaggctcgtacgcggttgtcattggtaccggcggtctcggccacgtcgctattcagctcctccgccacctctcggcggcaacggtcatcgctttggacgtgagcgcggacaagctcgaactggcaaccaaggtaggcgctcacgaagtggttctgtccgacaaggacgcggccgagaacgtccgcaagatcactggaagtcaaggcgccgcattggttctcgacttcgtcggctaccagcccaccatcgacaccgcgatggctgtcgccggcgtcggatcagacgtcacgatcgtcgggatcggggacggccaggcccacgccaaagtcgggttcttccaaagtccttacgaggcttcggtgacagtcccgtattggggtgcccgcaacgagttgatcgaattgatcgacctcgcccacgccggcatcttcgacatctcggtggagaccttcagtctcgacaacggtgccgaagcgtatcgacgactggctgccggaacgctcagcggccgtgcggttgtggtccctggtctgtag

SEQ ID NO: 51636 - protein, 348 aa, Rhodococcus sp
MKAIQYTRIGAEPELTEIPKPEPGPGEVLLEVTAAGVCHSDDFIMSLPEEQYTYGLPLTLGHEGAGKVAAVGEGVEGLDIGTNVVVYGPWGCGNCWHCSQGLENYCSRAQELGINPPGLGAPGALAEFMIVDSPRHLVPIGDLDPVKTVPLTDAGLTPYHAIKRSLPKLRGGSYAVVIGTGGLGHVAIQLLRHLSAATVIALDVSADKLELATKVGAHEVVLSDKDAAENVRKITGSQGAALVLDFVGYQPTIDTAMAVAGVGSDVTIVGIGDGQAHAKVGFFQSPYEASVTVPYWGARNELIELIDLAHAGIFDISVETFSLDNGAEAYRRLAAGTLSGRAVVVPGL

SEQ ID NO: 51637 - DNA, 1107 bp, Arxula adeninivorans
  CDS (1)..(1107)
atggctgcacaagtcgaggaacaggtgcttaatctccgagctcaagcggatcacaatccctcgtttgttctcaaaaagcccttggaattggggtttgaagagcgcccagtgcctgtgattactgaccctcgagatgttaaaatccaggtcaagaagacgggaatctgcggatctgatgttcacttttggcaacatggtcgtattggtgactacgtagtggaaaagccaatggtcctaggccatgagtccagtggagtggtggttgaagttggttctgaggtcacctccctcaaggtgggagaccgagtagctatggaacctggagtgccggacaggcgctcaaaggaatataagatgggacgatatcatttgtgccctcatgtgcgctttgcagcctgccctcccactgacggaacgctctgcaagtattacacacttcccgaggacttctgcgttaaactgcctgaaaacgtagattttgaggaaggagcattggtggagccattgagtgtagcagtccacaccgctaggcttcttggtatctaccctggctccaaggtggtcgtgttcggagcaggaccaattggccagctgtgcattggagtgtgcaaggcatttggtgccagtataattggcgcggtggatttgtttgagcaaaagctagagaccgcaaaggagtttggtgcatctcacacgtatgtccctcagaaaggggactcacatgacgagactgcccacaaaattctcgagctcctgcccaacaagcaggccccagatgtggtcattgatgccagtggagctgagcaatctatcaacgcaggaattgagcttctagagagaggtggaacctttggacaggtggccatgggccgaactgactacattcagtttgccgtttctcgtatggccatgaaggagattcgattccagggagtcttccgatatacctatggagattatgagctcgcaacccagttgattggtgatggaaagatccctgtaaagaaattggtcacccataggcggccatttgaaaaggccgaggaggcatatgaattggtcaagagcggtgttgcagtaaagtgcattattgatggacctgagtaa

SEQ ID NO: 51638 - protein, 368 aa, Arxula adeninivorans
MAAQVEEQVLNLRAQADHNPSFVLKKPLELGFEERPVPVITDPRDVKIQVKKTGICGSDVHFWQHGRIGDYVVEKPMVLGHESSGVVVEVGSEVTSLKVGDRVAMEPGVPDRRSKEYKMGRYHLCPHVRFAACPPTDGTLCKYYTLPEDFCVKLPENVDFEEGALVEPLSVAVHTARLLGIYPGSKVVVFGAGPIGQLCIGVCKAFGASIIGAVDLFEQKLETAKEFGASHTYVPQKGDSHDETAHKILELLPNKQAPDVVIDASGAEQSINAGIELLERGGTFGQVAMGRTDYIQFAVSRMAMKEIRFQGVFRYTYGDYELATQLIGDGKIPVKKLVTHRRPFEKAEEAYELVKSGVAVKCIIDGPE

SEQ ID NO: 51639 - DNA, 1047 bp, Rhodococcus erythropolis
  CDS (1)..(1047)
atgaaggcaatccagtacacgagaatcggcgcggaacccgaactcacggagattcccaaacccgagcccggtccaggtgaagtgctcctggaagtcaccgctgccggcgtctgccactcggacgacttcatcatgagcctgcccgaagagcagtacacctacggccttccgctcacgctcggccacgaaggcgcaggcaaggtcgccgccgtcggcgagggtgtcgaaggtctcgacatcggaaccaatgtcgtcgtctacgggccttggggttgtggcaactgttggcactgctcacaaggactcgagaactattgctctcgcgcccaagaactcggaatcaatcctcccggtctcggtgcacccggcgcgttggccgagttcatgatcgtcgattctcctcgccaccttgtcccgatcggtgacctcgacccggtcaagacggtgccgctgaccgacgccggtctgacgccgtatcacgcgatcaagcgttctctgccgaaacttcgcggaggctcgtacgcggttgtcattggtaccggcgggctcggccacgtcgccattcagctcctccgtcacctctcggcggcaacggtcatcgctttggacgtgagcgcggacaagctcgaactggcaaccaaggtaggcgctcacgaagtggttctgtccgacaaggacgcggccgagaacgtccgcaagatcactggaagtcaaggcgccgcactggttctcgacttcgtcggctaccagcccaccatcgacaccgcgatggctgtcgccggcgtcggatcagacgtcacgatcgtcgggatcggggacggccaggcccacgccaaagtcgggttcttccaaagtccttacgaggcttcggtgacagttccgtattggggtgcccgcaacgagttgatcgaattgatcgacctcgcccacgccggcatcttcgacatcgcggtggagaccttcagtctcgacaacggtgccgaagcgtatcgacgactggctgccggaacgctaagcggccgtgcggttgtggtccctggtctgtag

SEQ ID NO: 51640 - protein, 348 aa, Rhodococcus erythropolis
MKAIQYTRIGAEPELTEIPKPEPGPGEVLLEVTAAGVCHSDDFIMSLPEEQYTYGLPLTLGHEGAGKVAAVGEGVEGLDIGTNVVVYGPWGCGNCWHCSQGLENYCSRAQELGINPPGLGAPGALAEFMIVDSPRHLVPIGDLDPVKTVPLTDAGLTPYHAIKRSLPKLRGGSYAVVIGTGGLGHVAIQLLRHLSAATVIALDVSADKLELATKVGAHEVVLSDKDAAENVRKITGSQGAALVLDFVGYQPTIDTAMAVAGVGSDVTIVGIGDGQAHAKVGFFQSPYEASVTVPYWGARNELIELIDLAHAGIFDIAVETFSLDNGAEAYRRLAAGTLSGRAVVVPGL

SEQ ID NO: 51641 - DNA, 1023 bp, Micromonospora echinospora
  CDS (1)..(1023)
gtggggggacgaatgcgggcgctacagttccacggaggacacaaggctcagatcatcgacactccccgcccggaggcacctcccggatgggctgtcgtcaaggtgcactactgctgcctctgcggtagcgacctctggctctaccggggcaagtggcacggcaaccggtacccgatcgtgccgggccacgagtgggccggtgtggtggactccgccccggagggttacgagtcctgggtcggccgtccggtcaccggcgatctgatcgtcggctgtcagggctgtgggccctgccgggacgggttgccggtgatgtgcgagaacctgatcgagatcggcttcaccgtggacggtggctgcgccggctacgtggcggtgccgatcaccaacctctacctgcttcccgaggggatggacctcgccgcggcgagccagaccgagccgctcgccgtcgcgctgcacgcggtggaccggatcaacctccggcccgcggagcgggtcgccgtgctgggcgccggcggcatcggccagctcatcctccagtcggcccgggcgaccggggccacggtcacgctcgccaccgacctggtcgccgagcgccgcaagatcgccgaggagagcggcgccgccgctgccgtgcaccccagcgagctgcccgagctcaccagttacgcggacaaggtggacgtcgtgttcgaggcgtccggcgacccggagtcggtcgtccgcgcgctcgacctggtccgccccggtggacgggtctgcctggtcggctaccaggtgggcgccgagcacgcgctggagaccgcccggctgccgctgtcgtacgccagcctggtcggtgtgatgggtcccggtggcaagtaccgggaagccgtggacctgctcgcgaacggggcgatcgacacccagcccatcctcaccgacatcgtcacgctggacgactacgcccccgccatcgaccgtgccatcaaccgcacggacggcaccgtccgggtcgtcttcgacctgcggaacgagtag

SEQ ID NO: 51642 - protein, 340 aa, Micromonospora echinospora
MGGRMRALQFHGGHKAQIIDTPRPEAPPGWAVVKVHYCCLCGSDLWLYRGKWHGNRYPIVPGHEWAGVVDSAPEGYESWVGRPVTGDLIVGCQGCGPCRDGLPVMCENLIEIGFTVDGGCAGYVAVPITNLYLLPEGMDLAAASQTEPLAVALHAVDRINLRPAERVAVLGAGGIGQLILQSARATGATVTLATDLVAERRKIAEESGAAAAVHPSELPELTSYADKVDVVFEASGDPESVVRALDLVRPGGRVCLVGYQVGAEHALETARLPLSYASLVGVMGPGGKYREAVDLLANGAIDTQPILTDIVTLDDYAPAIDRAINRTDGTVRVVFDLRNE

SEQ ID NO: 51643 - DNA, 1026 bp, Mycobacterium sp
  CDS (1)..(1026)
atggaagcgatcgttctcaacggcaccaacgacgtcggtctgacgtcggtgccagacccggcgccgcaggacggtgaggtcatcatcgaagtggcggcgacaggactgtgtggaactgacctccacgagtatgtcgcggggcccaccttctcgcagccgccggtggtgctcggtcacgaggtctcgggccggatcgtggaggtcggagcgggcgtcgaccaatcccgcatcggggagggcgccgcggtgatcccgatggatttctgcgggagctgccactactgccaccggtcgctctaccacctgtgccagcgcccaggatggatcggcttcacccgaaacggaggcctcgcgaactacgtcgcagtgccctctcggctcgcagtccgagtgccggacgtggtggacctcgaggaggcggcgctgaccgagccgacggcggtggcgttccacgcggtgcggcgagcggaactgctcctcggcgaaacggtgatggtcctcggggccggggcactcgggctcaccgtgatccagtgtgcacgcgcggccggagctgcgcgaatcttcgtcacggaaccaagcggcgtgcgggccagcctggcgcgcgacctcggcgccacgttggtgctcgatccgcatgaccccgggaccaccgcgtgcatcctggaggagacccgcggcgtaggggtggacgtggtcttccatgtggcgggcagcgcggaggcgttcacacagggcctggactgcctccgcaaacagggccgtttcatggagatgtcgtcgtgggccggcgcggcctcgctcgatgtcaaccgccatctgctcaaggagattcagctccggatggttttcggttacgacatgttcgacgatttcccggccgttctcgccctgatcgccgacggaaaactcgcgctcgcgccgcaaatcaccgctcgagtcccgctggaccgcgccgtcaaggagggattgggcgggctattggagggccgggagggtctggtcaaggtgctggtgaagccgtga

SEQ ID NO: 51644 - protein, 341 aa, Mycobacterium sp
MEAIVLNGTNDVGLTSVPDPAPQDGEVIIEVAATGLCGTDLHEYVAGPTFSQPPVVLGHEVSGRIVEVGAGVDQSRIGEGAAVIPMDFCGSCHYCHRSLYHLCQRPGWIGFTRNGGLANYVAVPSRLAVRVPDVVDLEEAALTEPTAVAFHAVRRAELLLGETVMVLGAGALGLTVIQCARAAGAARIFVTEPSGVRASLARDLGATLVLDPHDPGTTACILEETRGVGVDVVFHVAGSAEAFTQGLDCLRKQGRFMEMSSWAGAASLDVNRHLLKEIQLRMVFGYDMFDDFPAVLALIADGKLALAPQITARVPLDRAVKEGLGGLLEGREGLVKVLVKP

SEQ ID NO: 51645 - DNA, 1056 bp, Gordonia sp
  CDS (1)..(1056)
atgaaggcactcgttttccacggtcccggccagaaggcctgggaggacgtccccgacccgaagctcagcgaacccaccgacgtcatcgtcaagatggatacgacgacgatctgcggcaccgacctgcacatcctcaagggtgacgttcccgcggtcactcccggccgcattctcggacacgagggcgtcggtacgatcaccgaggtcggcgacgccgtgaccacgctggccgtcggcgaccaggtgatcctgtcctgcatctcctcatgcgggaaatgctcgttctgcaaacagggcgtctactcgcactgcctcggtagcgagggcacgtcgggtatcggctggatcttcggccatctcatcgacggcacccaggccgagtacgtgcgggtgccctacgccgagaactcggtccacaaactgccgtcggcggtcagccccgagcagggcacgttactctccgacatcctgcccaccggccacgagatcggcgtccgccacggggcggtgaaacccggtgatgtggtcgcggtgatcgggaccggcccggtcgggctcgccgccatcgccaccgccggcctctacgggcccagccgggtcatcgccgtcgacatcgacgccaaccgggtcgagcaggcccgccggttcggggcgaccgacggggtcgtgtcgacctcgtcgggttggcgcgaggagatcctggcgatgaccgacggactcggcgtcgacgtcgcgatcgaggccgtcggcattcccgacacgttccagatgtgcctcgacatcgtccgccccgcaggccatgtcgccaatgtcggtgtgcacggcaaacccgtcgagttgcccatccaggacctctggatctccaacatcgtgatgtcgatgggcctggtgaacaccaatacccttggcacacttctgaagttggtggcacagcgccgtatcgacccggagccgttcatcagccaccgattcgggctcggcgagatcatcgacgcctacgacgtgttctcccgtgcggcagaaaccaaggcgctcaaggtgatcatgagcgcctga

SEQ ID NO: 51646 - protein, 351 aa, Gordonia sp
MKALVFHGPGQKAWEDVPDPKLSEPTDVIVKMDTTTICGTDLHILKGDVPAVTPGRILGHEGVGTITEVGDAVTTLAVGDQVILSCISSCGKCSFCKQGVYSHCLGSEGTSGIGWIFGHLIDGTQAEYVRVPYAENSVHKLPSAVSPEQGTLLSDILPTGHEIGVRHGAVKPGDVVAVIGTGPVGLAAIATAGLYGPSRVIAVDIDANRVEQARRFGATDGVVSTSSGWREEILAMTDGLGVDVAIEAVGIPDTFQMCLDIVRPAGHVANVGVHGKPVELPIQDLWISNIVMSMGLVNTNTLGTLLKLVAQRRIDPEPFISHRFGLGEIIDAYDVFSRAAETKALKVIMSA

SEQ ID NO: 51647 - DNA, 1020 bp, Streptomyces sp
  CDS (1)..(1020)
atgccatgcgcgctgtccgaatccatgagtacggcggcccggatggtgcgcaccgaagaggtgccgataccggagccagggcccggccaggtgctgatcgaggccgaggcgatctccgtgttcgcccagacccagatgcggcggaacgtcttccccgcccccatgtggcgccccgagttccccatcacgctcggcggggacgtcgtcggcgaggtcgtcgccgtgggccccggcgtcaccggcaacgcgcccgcgaccgggtcggcgccttcaccctggcacggcgcctacgccgagtacgtcgtcgtcgacgcggacaccgtcctcccggtccccgccgccctcgacgcggcccaggcgacggcgctccccgcccccggacccatcgccatgggcacgatgggcacggcctccctcgcccccggggagagcgtcctcgtgcaacgcccctcgggcggcatcggacacctcgccgtccagctcgcccggctcgccggggcggggacggtgatcgccaccgccggcacgcccgagaagtgcgcctacgcccgctccctcggcgcggacgtcgccgtcgactacagccgcgcggactggccggacgccgtgcgcgaggccaccggcggccggggcgtcgacgtgatcctcgacagcgtcggcggtgacgtgctccggcagggcgtgggcctcctcgccccgttcggccggctcgtcttctacggttcggccggcggcggcctcggcatccccgccgtctcgccgatggagctcatcgggatgcggttcctcaccggattcgccctctcggcctggcggaacgcacggcccgagcggtaccgcgccgaccacgacgcgctcaccgcccacctgctcgccggcaccgtccgccagaccgtgcacgcgaccctgcccctggaggacgtcggcaaggcgcacgagatcgtcgagagccgggcccagctggggcgcatcgtgctcctcaccggccgcggcacccggaccgcggggggtggggcatga

SEQ ID NO: 51648 - protein, 339 aa, Streptomyces sp
MPCALSESMSTAARMVRTEEVPIPEPGPGQVLIEAEAISVFAQTQMRRNVFPAPMWRPEFPITLGGDVVGEVVAVGPGVTGNAPATGSAPSPWHGAYAEYVVVDADTVLPVPAALDAAQATALPAPGPIAMGTMGTASLAPGESVLVQRPSGGIGHLAVQLARLAGAGTVIATAGTPEKCAYARSLGADVAVDYSRADWPDAVREATGGRGVDVILDSVGGDVLRQGVGLLAPFGRLVFYGSAGGGLGIPAVSPMELIGMRFLTGFALSAWRNARPERYRADHDALTAHLLAGTVRQTVHATLPLEDVGKAHEIVESRAQLGRIVLLTGRGTRTAGGGA

SEQ ID NO: 51649 - DNA, 1059 bp, Enterococcus avium
  CDS (1)..(1059)
atgagtaaaacaatgaagggtgtttccaagcaggcacccggttatgaccaaatggcatttatcgatttatctgttccagaagcaacagatgacaaggtcttgattaaagtcgcttatacaggtatttgcggatcagatatccatacgtttaaaggtgaatacaaaaatcccactactcccgtcgtcctaggacatgaattttctgggcaggtagttgaagtcggagccaatgtaccaaaggtcaaggttggtgatcgggtaaccagtgagacgaccttttatgtctgcggcgaatgcgattattgcaaggaaaagcagtataatttgtgtccccatcgaaaaggaatcggcacgcagcaaaatggctccatggcgaactatgtgttggctcgagaagaaagcattcatttactgccggatcatttaagctatgaaggtgcggcgatgagcgaaccattagcgtgctgtgtccacgcgatgtatcaaaagagtcacttggaattaaaagacacgatcattatcatgggccctggaccaatcggactgtatcttttgcagattgccaaggaaattggagccttcgtcattatgacggggatcacaaaagatgctcatcgcttagcattagcaaaaaaactaggcgcggatgtgatcgttgatacgatgaaggaagatctagcgaaagtcgtcaatgagatcacggatggctacggtgtcgataaagtgtatgatgcctcaggagcagttcctgctgttaatgctagtctgccattgattcgcaagcaggggcaatttattcaagtaggcttgttcgctaataaaatggtggatttagacactgaatcgatcattcaacgagagatcgaatacatcggcagtcgttcacagaacccttatgactggccgattgcgatccacttattagcgaaaggtgcgatcaatatcgatgagatgattacgaaaaaatacccgttgactgaatggcgggaagcctttgataaagtgatggaaggcaatgaaatcaaggtaatgatcgaatccaatccagaagaattttaa

SEQ ID NO: 51650 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 51651 - DNA, 1050 bp, Bacillus circulans
  CDS (1)..(1050)
atggaaattttaacgtacacgggtccaagccgattaatcgtggaaacggcggaagaattgccgttaaagagcggcgaatgccggatacagtccctctattccgggatcagtcacggaacggaaatgggggcttacagaggtatcgctccctatttcacaagagatatggattccgaaacccggttgttcgaggatctggccgaagaacataaagttaaatatccgatccggagctgcgaggacgatgcctggtttatcgggtattcgaacgtagggaaaattattgaagttggagcggaggtcgaaggatttacggtcggagatatcgtgttttcccacggcaggcatcaaacgatcgtgtgcaagcatcacaaaaagatctttaaacttccccaaaagctggagcctgagctcggcattttctacacaaacctgatgacggcttataacgctgtattggacacgagaattaaaatcggggacgttgtcgtcgtgtcgggactcggcgtagtcgggcagttaatcgctcaattagccaaactgtccggcgccacagtcgtcggagtcgacccgcttgagaacagactgaacatcgccagggaagttgaaatcgactatgtgtttaatccgaatcggacggatgtcgccaaggaaatcagagagattacgaataaccggggtgccgatgccgtcttcgaagtatccggtcattcaacggctttgaatcaagcgattcgcatagcggcgccggacacggtaattacagccgtaggctggtatcagggcgggcaatcggtgctgaatctttccgaagaatttcaccagaaccggattacgatccgcgcttcgcaaactctcgggatcgatccttccatcagccatatgtatgacgatgcgagaagaaggaatatcgggaaagatctgctgcttaagcttaaactccgcaacctgatcagccaccggattccgttcggcgatgcgccgaaagcctacgaaatgatcgataaacacccgcatgaagttctgcaggtcgttctgacctactcttaa

SEQ ID NO: 51652 - protein, 349 aa, Bacillus circulans
MEILTYTGPSRLIVETAEELPLKSGECRIQSLYSGISHGTEMGAYRGIAPYFTRDMDSETRLFEDLAEEHKVKYPIRSCEDDAWFIGYSNVGKIIEVGAEVEGFTVGDIVFSHGRHQTIVCKHHKKIFKLPQKLEPELGIFYTNLMTAYNAVLDTRIKIGDVVVVSGLGVVGQLIAQLAKLSGATVVGVDPLENRLNIAREVEIDYVFNPNRTDVAKEIREITNNRGADAVFEVSGHSTALNQAIRIAAPDTVITAVGWYQGGQSVLNLSEEFHQNRITIRASQTLGIDPSISHMYDDARRRNIGKDLLLKLKLRNLISHRIPFGDAPKAYEMIDKHPHEVLQVVLTYS

SEQ ID NO: 51653 - DNA, 1152 bp, Arabidopsis thaliana
  CDS (1)..(1152)
atgggtgggtatcacgtgagccccggcggattcatgcgtggagccgtgtatcgcgagcccaataagcctctaaccatcgaagaatttcatattccccgccccaaatccaatgaaattctcatcaaaaccaaagcttgtggagtttgccactctgatcttcatgtgatgaaaggagagataccgttcgctagtccttgtgttattggtcatgagattactggtgaagttgttgaacatggtccacttactgatcacaagatcattaatagatttccaatcgggtctcgtgtagttggagctttcattatgccttgtggaacctgttcttattgtgctaagggccatgatgatctatgtgaagacttctttgcttacaacagagccaagggaactctttacgatggcgaaactcgtctctttttgcgacatgatgattcaccagtgtatatgtatagtatgggagggatggctgagtactgtgttacaccagctcatggtttagctcctctaccagagtctttgccctactctgaatctgccattctgggatgtgctgtttttacagcatatggtgctatggctcatgctgctgagatccgtcctggagattctattgcagttattggaattggtggtgtgggctccagttgtttgcagatcgcaagggcttttggagcctcggatatcattgctgtggatgttcaggatgataaattacagaaggccaagacacttggtgctactcatattgtcaatgctgctaaagaagatgctgttgaaaggataagagaaataaccggtgggatgggtgttgatgttgctgttgaagccttgggaaagcctcaaactttcatgcagtgcacactaagtgtgaaagatggtggaaaagctgtgatgattggactctcacaagctggttccgttggagaaattgacataaatcgacttgttcgtagaaagataaaagttataggatcttatggaggaagagcaagacaggatcttcctaaagtagtgaaattggcagagtcagggattttcaatctcacaaacgcagtctcaagtaaatacaagtttgaagatgcaggaaaagcatttcaagatctcaacgaaggcaaaatcgtgagccgaggtgttgttgagatactataa

SEQ ID NO: 51654 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 51655 - DNA, 981 bp, Rhodocyclus gelatinosus
  CDS (1)..(981)
atgaaggcctggctctgcgaatcgctggacggcgtcgccggcatgcactggcgcgagctgccgacgcccgagccggcgcccggcgaggtgcgtgtggcgatccgcgccgcgagcctgaacttccccgacctgctgatcgtcgagggcaagtaccaggcgcgcccgccgctgcccttcgtgcccggcgccgagttcgccggcgtcgtcgaggcgctgggcgaaggcgtgacgacgctggccgtcggccagccggtggcggtcatcggcacccacggcggcttcgccacccacgcctgcgtcgatgccggccgcgcgatcgcgttgccgccgggcttcgcgctcgaggacgcggcggccttcgccttcacctacggcacctcgcagcatgcgctgctcgaccgcggcgcgctgcgccccggcgagacggtgctggtgctgggcgccgcgggcggcgtcggcaccgcggcgctgcagatcgccaaggcggtcggagcgcatgtcatcgccgcggcctccggcgccgagaagtgcgcgctgtgccgcgagctgggcgccgatgccgtcatcgactattcggtggagaacctgcgcgatgcgctgaaggccttgaccggcggccgcgggcccgacctcgtctacgaccccgtcggcggcgagctggccgagccggcgctgcgctcgatcgcctggcgcgggcgctacctggtcgtcggcttcgccagcggggcgatcccggccctgccctggaacctggcgctgctcaagggcgcgtccatcgtcggcgtcttctggggcgagttcgtgcgccgcgagccgcaggccagcgctgcggccatcggccagctcgcgcgctggtacgccgaaggccgcatcaagcccgtcgtcggcgcccgtttcgcgctcgaagacttgccccaggcttacgagcgcatggcctcgcgccgcgccctgggcaagctgatcgtcgtttgtggcaactga

SEQ ID NO: 51656 - protein, 326 aa, Rhodocyclus gelatinosus
MKAWLCESLDGVAGMHWRELPTPEPAPGEVRVAIRAASLNFPDLLIVEGKYQARPPLPFVPGAEFAGVVEALGEGVTTLAVGQPVAVIGTHGGFATHACVDAGRAIALPPGFALEDAAAFAFTYGTSQHALLDRGALRPGETVLVLGAAGGVGTAALQIAKAVGAHVIAAASGAEKCALCRELGADAVIDYSVENLRDALKALTGGRGPDLVYDPVGGELAEPALRSIAWRGRYLVVGFASGAIPALPWNLALLKGASIVGVFWGEFVRREPQASAAAIGQLARWYAEGRIKPVVGARFALEDLPQAYERMASRRALGKLIVVCGN

SEQ ID NO: 51657 - DNA, 1083 bp, Entamoeba histolytica
  CDS (1)..(1083)
atgaaaggacttgctatgcttggaattggaagaattggatggattgaaaagaaaatcccagaatgtggaccacttgatgcattagttagaccattagcacttgcaccatgtacatcagatacacataccgtttgggcaggagctattggagatagacatgatatgattcttggacatgaagcggttggacaaattgttaaagttggatcattagttaagagattaaaagttggagataaagttattgtaccagctattacaccagattggggagaagaagaatcgcaaagaggatatccaatgcattcaggaggaatgcttggaggatggaaattctcaaatttcaaggatggagttttttcagaagttttccatgttaatgaagcagatgccaatcttgcacttcttccaagagatattaaaccagaagatgcagttatgttatcagatatggtaactactggattccatggagcagaattagctaatattaaacttggagatactgtttgtgttattggtattggaccagttggattaatgtcagttgcaggagcaaaccatcttggagcaggaagaatctttgcagtaggatcaagaaaacattgttgtgatattgcattggaatatggagcaacagatattattaattataaaaatggagatattgtagaacaaattcttaaagctacagacggcaaaggagttgataaagtcgttattgcaggaggtgatgttcatacatttgcacaagcagtcaaaatgattaaaccaggatcagatattggaaatgttaattatcttggagaaggagataatattgatattccaagaagtgaatggggagttggaatgggtcataaacacattcatggaggtttaaccccaggtggaagagtcagaatggaaaaattagcatcacttatttcaactggtaaattagatacttctaaacttattacacatagatttgaaggattagaaaaagttgaagatgcattaatgttaatgaagaataaaccagcagaccttatcaaaccagttgtcagaattcattatgatgatgaagatactcttcattaa

SEQ ID NO: 51658 - protein, 360 aa, Entamoeba histolytica
MKGLAMLGIGRIGWIEKKIPECGPLDALVRPLALAPCTSDTHTVWAGAIGDRHDMILGHEAVGQIVKVGSLVKRLKVGDKVIVPAITPDWGEEESQRGYPMHSGGMLGGWKFSNFKDGVFSEVFHVNEADANLALLPRDIKPEDAVMLSDMVTTGFHGAELANIKLGDTVCVIGIGPVGLMSVAGANHLGAGRIFAVGSRKHCCDIALEYGATDIINYKNGDIVEQILKATDGKGVDKVVIAGGDVHTFAQAVKMIKPGSDIGNVNYLGEGDNIDIPRSEWGVGMGHKHIHGGLTPGGRVRMEKLASLISTGKLDTSKLITHRFEGLEKVEDALMLMKNKPADLIKPVVRIHYDDEDTLH

SEQ ID NO: 51659 - DNA, 1044 bp, Sulfolobus solfataricus
  CDS (1)..(1044)
atgagagcagttagattagtagaaataggaaaaccccttagcttacaagagataggtgtgcctaaacccaaaggacctcaagtcttaataaaagtagaggcagcgggagtttgtcattctgatgtgcacatgagacaaggaaggtttgggaatttaagaatagtggaggatttgggtgtaaaattgcccgtaactttaggtcatgagattgcaggaaaaatagaggaagttggagatgaagtagttggatattctaagggggatctagttgcagttaatccttggcagggagaaggaaattgctactattgtagaataggagaggagcatctgtgtgactctcctagatggttggggattaattttgatggagcttatgcagagtatgtaatagttcctcattataaatatatgtataagctgagaagacttaacgctgtagaagcagcaccgttaacttgttctggaataactacatatagggcagtaagaaaggcatctttagatccaactaagacactactagtagtgggtgctggaggaggcttaggcacaatggcagtgcagatagccaaagctgttagtggtgcaacgataataggtgtggatgtgagggaagaggcagtggaggctgctaagagagctggagctgactacgtaataaacgcatcaatgcaagaccccttagcggagataagaaggataactgaaagtaagggagtggatgccgtaatagacctgaataactctgagaaaacgctttcagtttaccctaaagctttggcaaaacaaggtaaatacgtaatggtgggattgtttggtgcagatttgcattatcatgcacctctaataactttatcagaaatacaatttgtaggcagtttagttgggaatcaatcagacttcttggggataatgagattagcagaggctggtaaagtcaaacctatgataactaaaactatgaaactagaagaggcaaatgaggctattgataatttagagaattttaaggctattggaagacaagtactcataccataa

SEQ ID NO: 51660 - protein, 347 aa, Sulfolobus solfataricus
MRAVRLVEIGKPLSLQEIGVPKPKGPQVLIKVEAAGVCHSDVHMRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYMYKLRRLNAVEAAPLTCSGITTYRAVRKASLDPTKTLLVVGAGGGLGTMAVQIAKAVSGATIIGVDVREEAVEAAKRAGADYVINASMQDPLAEIRRITESKGVDAVIDLNNSEKTLSVYPKALAKQGKYVMVGLFGADLHYHAPLITLSEIQFVGSLVGNQSDFLGIMRLAEAGKVKPMITKTMKLEEANEAIDNLENFKAIGRQVLIP

SEQ ID NO: 51661 - DNA, 1044 bp, Sulfolobus sp
  CDS (1)..(1044)
atgagagcagttagattagtagaaataggaaaacctctcgttttaaaagatatagatatacctaaacctaagggagcacaagttttgataaaggtagaggctgcgggagtttgtcattctgatgttcacatgagacaagggagatttgggaatttaagaatagtagaagatttgggtgtgaaattgccggtaactttaggtcacgagatcgcaggaaaaatagaggaaatgggagatgaagttgttggatactctaagggtgatctagttgcagttaacccttggcagggagaaggaaattgctattattgtagaataggggaagagcatttgtgcgattctcctagatggttaggaattaactttgatggagcttacgcagaatatgtgttaaatcctcattataaatatatgtacaagctgagaagacttaatgccgtagaagcatcacctttaacttgttctggaataactacatatagggcagttagaaaagcatcattagacccaactaagacattagtagtagtgggggctggtggcggtctaggaacaatggcggtacagatagctaaagctgtcggtggtgcaacgataataggtgtagatgtgagagaggaggcagtagagactgctaagagagctggagccgattacgtaataaatgcgtcagttcaagatcccttagcggaaataaggagaataaccgaaggtaagggagtcgacgctgtaatagacctaaataactctgagaaaacgctttcagtttatccaaaagctttggcaaaacaaggtaagtacataatggtgggattattcggagcggatttgcattttcacgcaccattaataactttgtcagaaatacaattcgtaggcagtttagttggaaaccaatcagactttttggggataatgagattagcagaggctggtaaagttaaaccaatgataactaagaccatgaaactagaagaggcaaatgaggcgattgataatctagagaattttaaagctgtcggaagacaagtacttataccataa

SEQ ID NO: 51662 - protein, 347 aa, Sulfolobus sp
MRAVRLVEIGKPLVLKDIDIPKPKGAQVLIKVEAAGVCHSDVHMRQGRFGNLRIVEDLGVKLPVTLGHEIAGKIEEMGDEVVGYSKGDLVAVNPWQGEGNCYYCRIGEEHLCDSPRWLGINFDGAYAEYVLNPHYKYMYKLRRLNAVEASPLTCSGITTYRAVRKASLDPTKTLVVVGAGGGLGTMAVQIAKAVGGATIIGVDVREEAVETAKRAGADYVINASVQDPLAEIRRITEGKGVDAVIDLNNSEKTLSVYPKALAKQGKYIMVGLFGADLHFHAPLITLSEIQFVGSLVGNQSDFLGIMRLAEAGKVKPMITKTMKLEEANEAIDNLENFKAVGRQVLIP

SEQ ID NO: 51663 - DNA, 1059 bp, Thermoanaerobacter brockii
  CDS (1)..(1059)
atgaaaggttttgcaatgctcagtatcggtaaagttggctggattgagaaggaaaagcctgctcctggcccatttgatgctattgtaagacctctagctgtggccccttgcacttcggacattcataccgtttttgaaggcgccattggcgaaagacataacatgatactcggtcacgaagctgtaggtgaagtagttgaagtaggtagtgaggtaaaagattttaaacctggtgatcgcgttgttgtgccagctattacccctgattggcggacctctgaagtacaaagaggatatcaccagcactccggtggaatgctggcaggctggaaattttcgaatgtaaaagatggtgtttttggtgaattttttcatgtgaatgatgctgatatgaatttagcacatctgcctaaagaaattccattggaagctgcagttatgattcccgatatgatgaccactggttttcacggagctgaactggcagatatagaattaggtgcgacggtagcagttttgggtattggcccagtaggtcttatggcagtcgctggtgccaaattgcgtggagccggaagaattattgccgtaggcagtagaccagtttgtgtagatgctgcaaaatactatggagctactgatattgtaaactataaagatggtcctatcgaaagtcagattatgaatctaactgaaggcaaaggtgtcgatgctgccatcatcgctggaggaaatgctgacattatggctacagcagttaagattgttaaacctggtggcaccatcgctaatgtaaattattttggcgaaggagaggttttgcctgttcctcgtcttgaatggggttgcggcatggctcataaaactataaaaggcgggctatgccccggtggacgtctaagaatggaaagactgattgaccttgttttttataagcgtgtcgatccttctaagctcgtcactcacgttttccggggatttgacaatattgaaaaagcctttatgttgatgaaagacaaaccaaaagacctaatcaaacctgttgtaatattagcataa

SEQ ID NO: 51664 - protein, 352 aa, Thermoanaerobacter brockii
MKGFAMLSIGKVGWIEKEKPAPGPFDAIVRPLAVAPCTSDIHTVFEGAIGERHNMILGHEAVGEVVEVGSEVKDFKPGDRVVVPAITPDWRTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLPVPRLEWGCGMAHKTIKGGLCPGGRLRMERLIDLVFYKRVDPSKLVTHVFRGFDNIEKAFMLMKDKPKDLIKPVVILA

SEQ ID NO: 51665 - DNA, 1074 bp, Saccharomyces cerevisiae
  CDS (1)..(1074)
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggaggtataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 51666 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGRYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 51667 - DNA, 1074 bp, Saccharomyces cerevisiae
  CDS (1)..(1074)
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggagctataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 51668 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGSYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 51669 - DNA, 1032 bp, Bacillus halodurans
  CDS (1)..(1032)
atgaaagcattagtaaaaacacaacatggcacgggccattttgccgtgcaagagaaacccgaaccaactccagggaaacatcaagtaaaaatcaaagtaaagtacacaggcgtttgtggttcagatattcatacctatgagggccattatcctgtagccgctccagtcacacttggtcatgaattttcaggtgagatcgttgaactcggtgaaggtgtaacaggctttaacgttggcgaccgagtaacatcagaaacgacctactcgatttgcggtaaatgctcatattgcacctcgggtgactataatctttgctctcaccggaaaggacttgggaatcagcaggatggcagttttgctaaatacgtaatcgcgcgacaagagagtttgcaccatctccctgctggtgtggatgatcgctcagcagccatgacagagcccctcgcatgtacacatcatgcgattgcaaaaaccagcatcaacaaaggggacttagttgtcgttactggtcctggtccgattggtttgttagcagctcaagttgcaaaaagtcacggtggaacagtgattattacaggtctatccaatgatcaagtccgattaaaaaaagcaaaggaagtcgggatcgattacgccatcgatacacaggaagtggacataaaagagcttgtctccgagcttacagacggctatggtgcagatgtcgttttagaatgttctggcgctgtgccagccgcaaaacaagggattgatcttttacgcaagaaaggacaatatgcccaagtcggcttatttgcccagcccgagatccaatttaattttgagaaaattattcaaaaagagatttccgtcgttgggagtagaagtcaaaaacctgcggattgggagcctgccctctcacttcttaatgaaaaaaaagtaaatgccaaaacactcgtcacccatgaatacacaatttctgaatgggataaggcctatcacgcgattaaaagtggtgaggctatcaaagtattattgacacctattgattag

SEQ ID NO: 51670 - protein, 343 aa, Bacillus halodurans
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 51671 - DNA, 1026 bp, Escherichia coli
  CDS (1)..(1026)
atgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagatcggcgatcgcgtttctggcgaaggccatatcacctgtggtcattgccgcaactgtcgtggtggtcgtacccatttgtgccgcaacacgataggcgttggtgttaatcgcccgggctgctttgccgaatatctggtgatcccggcattcaacgccttcaaaatccccgacaatatttccgatgacttagccgcaatttttgatcccttcggtaacgccgtgcataccgcgctgtcgtttgatctggtgggcgaagatgtgctggtttctggtgcaggcccgattggtattatggcagcggcggtggcgaaacacgttggtgcacgcaatgtggtgatcactgatgttaacgaataccgccttgagctggcgcgtaaaatgggtatcacccgtgcggttaacgtcgccaaagaaaatctcaatgacgtgatggcggagttaggcatgaccgaaggttttgatgtcggtctggaaatgtccggtgcgccgccagcgtttcgtaccatgcttgacaccatgaatcacggcggccgtattgcgatgctgggtattccgccgtctgatatgtctatcgactggaccaaagtgatctttaaaggcttgttcattaaaggtatttacggtcgtgagatgtttgaaacctggtacaagatggcggcgctgattcagtctggcctcgatctttcgccgatcattacccatcgtttctctatcgatgatttccagaagggctttgacgctatgcgttcgggccagtccgggaaagttattctgagctgggattaa

SEQ ID NO: 51672 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 51673 - DNA, 1047 bp, Pyrococcus abyssi
  CDS (1)..(1047)
atgtccgagaagatggtagctatcatgaagacgaaaccggcttacggcgctgagctcgtcgaggttgatgttccaaagccaggacctggggaggttctaataaaagttatagcgactagcatttgtggaacagacctacacatctatgagtggaacgagtgggcccaatcaaggataaagcccccacagataatgggtcatgaggttgccggtgaagtagttgaggtgggcccgggagttgagggaattgaggttggagattacgtaagcgttgaaacccacatagtttgtgggaaatgctacgcgtgtagaaggggacagtaccatgtttgtcaaaacacgaagatattcggtgtagacaccgatggtgtatttgctgagtacgcggtggttccagctcaaaacgtttggaagaatccaaagtcaattcctccggagtacgcaacccttcaagaaccacttggaaatgcagttgatactgttctggccgggccaatctctggaaagagcgttttgataactggagctggcccccttggcttacttggaattgcggtggcgaaggcctccggggcttatccggtgatagtttccgagccgagcgatttcaggagagagctagctaagaaggtcggtgcagattacgtgataaatccattcgaggaagacgtcgttaaggaagtcatggacataacggatggaaatggagttgacgtgttccttgagttcagcggagctcctaaggctttagaacagggacttcaggctgttacaccagctggaagagtatccctcctgggcctttacccagggaaggttagcatagacttcaacaatctgataatcttcaaggctctaactgtttatggaatcacaggtaggcacctctgggagacatggtacacagtttctaggctactccagagcggaaagcttaacttggacccaataataacccacaagtacaagggattcgacaagtacgaggaagccttcgagctaatgagggctggaaagacgggtaaggtagtcttcatgctcaagtga

SEQ ID NO: 51674 - protein, 348 aa, Pyrococcus abyssi
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 51675 - DNA, 1047 bp, Pyrococcus furiosus
  CDS (1)..(1047)
atgtccgagaagatggttgctatcatgaagacaaaaccagagtacggtgcagagttagttgaagtagatgtaccaaaacctgggccaggggaagtcctaataaaaattcttgcaacaagcatatgtggaactgacctgcacatttatgaatggaatgaatgggctcagacaagaattaggccacctcagataatggggcatgaggttgcaggagaggttgtggaagttggtccaggtgtagagggaattgaagttggtgattacgtttctgttgagactcacatagtctgtggaaagtgttacgcatgtaaaagagggcaatatcacgtatgtcaaaacacaaagatatttggagtagatactgacggtgtttttgccgaatatgcagtagttccagcacaaaacgtctggaagaatccaaagaacatacctcccgaatatgctactctacaagagccattgggaaatgctgtggatacagtacttgctggcccaattgccggaaagagcgttctcattactggagcaggtcccctgggacttcttggaatagcagtggcaaaggcatccggagcctatcctgtgatagtttctgagccaagtgaatttagaagaaacttggcaaagaaggtgggtgcagactacgtaataaatccatttgaagaagatgttgtaaaggaggtaatggacataaccgacggaaacggagttgatgtgttcttggagttcagcggtgctccaaaggctcttgagcaaggactccaggcagtaactccagctggaagggtttctcttctcggactattcccaggaaaagtgagcatagactttaacaaccttataatattcaaggcattgacagtttacggaatcactgggagacacctttgggaaacttggtatacagtctctagactgctccaaagtggaaaattaaatatagacccaataataactcacaagtacaagggatttgacaagtatgaagaagcctttgagctaatgagggctggcaaaactggcaaagttgttttcatgcttaaatga

SEQ ID NO: 51676 - protein, 348 aa, Pyrococcus furiosus
MSEKMVAIMKTKPEYGAELVEVDVPKPGPGEVLIKILATSICGTDLHIYEWNEWAQTRIRPPQIMGHEVAGEVVEVGPGVEGIEVGDYVSVETHIVCGKCYACKRGQYHVCQNTKIFGVDTDGVFAEYAVVPAQNVWKNPKNIPPEYATLQEPLGNAVDTVLAGPIAGKSVLITGAGPLGLLGIAVAKASGAYPVIVSEPSEFRRNLAKKVGADYVINPFEEDVVKEVMDITDGNGVDVFLEFSGAPKALEQGLQAVTPAGRVSLLGLFPGKVSIDFNNLIIFKALTVYGITGRHLWETWYTVSRLLQSGKLNIDPIITHKYKGFDKYEEAFELMRAGKTGKVVFMLK

SEQ ID NO: 51677 - DNA, 1035 bp, Rhizobium meliloti
  CDS (1)..(1035)
atgaccaacatgatgaaggcactggtcaagacgaagccggaggtagggctctggatggagcgcgtgccggtgccggaaatcgggccgaacgacgtcctgatccgcgtcaggaaatcggcgatctgcggcaccgacgtccacatctggaactgggatcaatgggcggagaagacgatcccagtgccgatggtcgtcggacacgaattcatgggcgaggtcgtcgaggtcgggccggccgtcagcaagcatcatgtcggcgagcgggtttccggagaaggtcacatcgtctgcggcaaatgccgcaattgccgcgcgggcagggggcatctctgccgcaacacgctcggcgtcggcgtcaaccgccccggatccttcgccgagttcgtctgccttcccgaatataatgtcgtgtcgatccccgacgacgtgccggacgagatcgccgcaatcttcgatcccttcggcaacgccgtgcatacggcgctctccttcgatctcgtcggcgaggacgttctggtcaccggtgccgggccgatcggcatcatgggggcgatggtggccaagcgttgcggtgcccgcaaggtggtgatcaccgacatcaatcccgttcgtctcgatctcgcgcgcaagctcggcatcgaccacgtcgtcgacgcgtcgaaggaaaaacttgccgacgtcatgcgggtgatcggcatgaccgagggcttcgatgtggggctggaaatgtcgggcgcggcgcccgctttccgcgacatgatcgacaagatgaacaatggcggcaagattgcgatcctcggcattgcgccggcgggcttcgagatcgactggaacaaggtcatcttcaagatgctcaacctcaagggcatctacggtcgcgaaatgttcgagacctggtacaagatgatcgccttcgtccagggcgggctcgacctctcgccgataatcacccaccgtatcggcatcgacgattttcgcgacggcttcgaggcgatgcgctcgggcaattccggcaaggtggtgatggactggtag

SEQ ID NO: 51678 - protein, 344 aa, Rhizobium meliloti
MTNMMKALVKTKPEVGLWMERVPVPEIGPNDVLIRVRKSAICGTDVHIWNWDQWAEKTIPVPMVVGHEFMGEVVEVGPAVSKHHVGERVSGEGHIVCGKCRNCRAGRGHLCRNTLGVGVNRPGSFAEFVCLPEYNVVSIPDDVPDEIAAIFDPFGNAVHTALSFDLVGEDVLVTGAGPIGIMGAMVAKRCGARKVVITDINPVRLDLARKLGIDHVVDASKEKLADVMRVIGMTEGFDVGLEMSGAAPAFRDMIDKMNNGGKIAILGIAPAGFEIDWNKVIFKMLNLKGIYGREMFETWYKMIAFVQGGLDLSPIITHRIGIDDFRDGFEAMRSGNSGKVVMDW

SEQ ID NO: 51679 - DNA, 1026 bp, Salmonella typhimurium
  CDS (1)..(1026)
atgaaagcgttatccaaactgaaagcggaagagggcatctggatgaccgacgttccggaaccggaagtcggccataacgatttgctgattaaaatccgtaaaacagccatctgcggtactgacgttcacatctataactgggatgactggtcgcaaaaaaccatcccggttccgatggtcgtggggcatgaatatgtcggcgaagtggtcggcatcggtcaggaagtgaaaggctttaaaatcggcgatcgcgtctccggcgaaggtcacatcacctgcggtcattgccgcaactgccgcggcggtcgcactcacctgtgtcgcaacaccaccggcgtgggcgtcaaccgtcccggctgctttgcggaatacctggtcatcccggcgttcaatgcgtttaaaatcccggataacatttctgatgatttagcctctattttcgacccgtttggtaatgcggtgcatacggcgctgtctttcgatctggtcggcgaagatgtactggtatcgggggcggggccaatcggcgtaatggccgccgcggtggcgaaacatgtcggcgcgcgtcatgtggtgattactgacgtcaatgaataccgtctggagctggcgcgtaaaatgggcgtcacccgcgcggtcaacgtcgcgaaagagagcctgaacgacgttatggcggagctgggaatgaccgaagggttcgatgtgggtctggagatgtccggcgcgccgccggcgtttcgtaccatgctggacaccatgaatcacggcggtcgtattgcgatgctggggattccgccatcagatatgtctatcgactggacaaaagttatctttaagggcttgttcattaaaggtatttatggtcgtgagatgttcgaaacgtggtacaaaatggcggcgctgatccagtccggtctggatctgtcaccgattatcacccatcgtttctctattgatgatttccagaaaggttttgatgccatgcgttcaggccagtcaggaaaagttattctgagctgggattaa

SEQ ID NO: 51680 - protein, 341 aa, Salmonella typhimurium
MKALSKLKAEEGIWMTDVPEPEVGHNDLLIKIRKTAICGTDVHIYNWDDWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 51681 - DNA, 1026 bp, Shewanella oneidensis
  CDS (1)..(1026)
atgaaagcactaagcaagttaaaagccgaaaaaggcatttggttagtcgatgcgcctaagcctgaaatgggccataacgatctactgatcaagattaaaaagaccgccatttgcggcaccgacatgcacatctacaactgggacgaatggtcacaaaaaaccattcctgtgcctatggtggtaggtcacgagtatgtgggagaagtggttgatatcgggcaagaagttcgcggctttaacattggtgaccgtgtttctggcgaaggccatatcacctgcggccactgccgtaactgccgcgcgggtcgcacccacttatgccgtaacacctcaggtgtgggtgtaaaccgcgaaggttcatttgccgaatacttagtgatcccagcgtttaacgccttcaaaatccccgatgatatcagcgacgatttagcctctatctttgatccattcggtaacgcagtacacacggcactgtcattcgacttagtgggcgaagatgtgttgattactggcgcgggtcctatcggtattatggctgcggccgtatgtcgccacgttggtgcgcgccatgtagtgatcaccgacgttaacgaataccgtttagaactggcccgtaaaatgggtgccacacgtgccgtaaacgttgctcaagaaaacctcaaagacgtgatgaaagaactcggcatgaccgaagggtttgacgtcggcttagaaatgtctggcgtaccttctgccttccgtgccatgttagataccatgaaccacggtggcaaaatcgcgatgctcggtattccgggtggcgaaatggccattgattggagcaaagtgatcttcaaaggtttggtcattaaaggcatttacggtcgtgaaatgttcgaaacctggtacaagatggcaagccttatccaatctggcttagatatttcgcccatcattacccatcactacaaaattgatgatttccaaaaaggcttcgacgctatgggctcgggccaatcgggtaaagtcatcctcagctgggattaa

SEQ ID NO: 51682 - protein, 341 aa, Shewanella oneidensis
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 51683 - DNA, 1032 bp, Vibrio parahaemolyticus
  CDS (1)..(1032)
atgaaaattaaagcactatcaaagctaaagcctgaacaaggcatttggatgaccgaagtagacaaacctgaggttggccataacgacattctgatcaaaattaagaaaactgcgatttgtggtacagacgtacacatttacaactgggacgaatggtcacaaaaaaccattccagtacctatggttgtcggtcacgaatacgtgggtgaagtggtcgcgattggtcaggaagttcgtggctttgaaatcggtgaccgcgtatctggcgaaggtcacatcacgtgtggtcactgtcgtaactgtcgtggcggtcgtactcacttatgccgtaacactatcggtgtgggtgtaaaccgtgaaggcgcatttgcagaatacttggttatcccagcgttcaacgcgttcaagatcccagacgagatctctgacgatctagcgtctatctttgacccgtttggtaacgcagtacacaccgcactttctttcgaccttgtgggtgaagacgtgctgatcacaggtgctggcccaatcggcatcatggcggcagcggttgctaaacacgttggtgctcgtcatgtggttatcacagacgtaaacgaataccgtctagagcttgctcgtaaaatgggcgtaacacgtgcagtaaacgtggctgaagagaagcttgaagatgtaatggctgaactaggcatgacagaaggcttcgacgtaggtcttgaaatgtcgggtaacccagcggcattcaactcaatgctaacaacaatgaatcatggtggtcgtattgctctgttgggtattccgccatcagacatgggtatcgactggaaccaagtgatcttcaaaggtttggttatcaaaggcatttacggccgtgaaatgttcgaaacgtggtacaagatggcttcactgattcaatctggtttggatctatcgccaatcatcacgcaccactacaagattgatgatttccaagaaggctttgacgttatgcgctctggcatgtcgggcaaagttattcttgattgggaatag

SEQ ID NO: 51684 - protein, 343 aa, Vibrio parahaemolyticus
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 51685 - DNA, 1026 bp, Yersinia pestis
  CDS (1)..(1026)
atgaaagcactttctaaactgaaagcagaagaaggcatttggatgaccgatgtgccacagccagagctgggtcacaacgatatcatgatcaaaattcgcaaaacggctatctgtggtactgacgtacatatttataattgggatgaatggtcacaaaaaaccatccccgtacccatggtcgttggccatgaatatgtcggtgaagtggtggccattgggcaggaagttaaagggtttaatattggtgaccgggtgtctggtgaaggccatattacctgtggtcactgccgtaactgccgtggtggtcgtacccacctttgtcgtaatacggtgggtgttggcgtgaatcgccctggttcgtttgccgaatatttggtgatccctgcttttaacgcgttcaagatcccagacaatatttctgatgagcttgcggctatttttgaccccttcggcaatgcagttcataccgcgttatcttttgatttagtcggcgaggatgtgttggtctccggggctggcccaattggtattatggccgccgcagtctgtaagcatgtgggtgctcgtcatgttgtcatcgctgatgtgaatgaatatcgcctggatctggcccgtaaaatgggcgtgacccgtgccgttaacgtcagcaaagagaacctaaatgacgttatgacggaattgggcatgaccgaagggtttgatgtgggcttggagatgtcaggtgctcccccggctttccgttcattacttaattcaatgaatcatggtggtcgtatagcgatgctgggaataccgccgtctgatatgtcgatcgactggaatcaggttatctttaaggggctgtttataaaggggatttatggccgtgagatgttcgaaacctggtacaaaatggccgcgttgattcaatctggtttggacttaactccgatcattacccaccgtttccctattgatgaattccagcaagggtttgacgccatgcgttcgggtaaatcaggcaaagtggtattaagctgggattag

SEQ ID NO: 51686 - protein, 341 aa, Yersinia pestis
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVIADVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 51687 - DNA, 1053 bp, Agrobacterium tumefaciens
  CDS (1)..(1053)
atgaaggcactggtgctggaagaaaaaggcaaactctcgctcagggattttgacattcccggaggcgccgggtccggtgaactcggaccgaaggatgtgcgcattcgcacccatacggtcggcatctgcggctcggacgttcattattatacccatggcaagatcggccacttcgtcgtcaacgcacccatggtgctcggccatgaagcctccggtacggtgatcgaaaccggttccgacgtcacccatctgaagatcggtgaccgcgtctgcatggagcctggtatccccgatcccacatcgcgggcctcgaaactcggcatctataatgtcgatcccgctgtccgcttctgggcaacaccgccgatccatggctgcctgacgcctgaggtcatccaccccgcggccttcacctacaagctgccggataacgtctcctttgccgaaggggcgatggtcgaacccttcgccatcggcatgcaggcggcactgcgggcgcgcatccagcccggcgatatcgccgtcgtcaccggtgccggtcctatcggcatgatggtggcgcttgccgcattggcgggcggttgcgccaaggtcatcgttgccgatctcgctcagccgaagcttgatatcatcgccgcttatgacggcatcgagaccatcaatatccgcgagcgcaaccttgccgaagcggtttcggccgccacggatggctggggttgcgatatcgtcttcgaatgctcaggtgcggcacccgccatactcggcatggcgaaactggcgcgaccgggcggtgccatcgtgctcgttggcatgccggttgacccggttccggtcgatatcgtcggccttcaggccaaagagctgcgggtggaaacggtattccgttacgccaacgtctatgaccgcgcggtggccctcatcgcctccggcaaggttgatctcaagccattgatttcggccaccattcccttcgaagacagtatcgccggtttcgaccgtgcggtggaagcgcgggaaacggatgtgaagttgcagatcgtcatgccgcaataa

SEQ ID NO: 51688 - protein, 350 aa, Agrobacterium tumefaciens
MKALVLEEKGKLSLRDFDIPGGAGSGELGPKDVRIRTHTVGICGSDVHYYTHGKIGHFVVNAPMVLGHEASGTVIETGSDVTHLKIGDRVCMEPGIPDPTSRASKLGIYNVDPAVRFWATPPIHGCLTPEVIHPAAFTYKLPDNVSFAEGAMVEPFAIGMQAALRARIQPGDIAVVTGAGPIGMMVALAALAGGCAKVIVADLAQPKLDIIAAYDGIETINIRERNLAEAVSAATDGWGCDIVFECSGAAPAILGMAKLARPGGAIVLVGMPVDPVPVDIVGLQAKELRVETVFRYANVYDRAVALIASGKVDLKPLISATIPFEDSIAGFDRAVEARETDVKLQIVMPQ

SEQ ID NO: 51689 - DNA, 1017 bp, Morganella morganii
  CDS (1)..(1017)
atgatcatgaaggcattagtattagagaaagcagggaaaatcgccattcaggattggcagagtaatgaagtgctgggcgacgacgatgttgaaattaaaatccacaccgtcggtatctgcggcagcgacgttcactattatcagcatggccgtatcgggccgttcgtggttgacgagccgatggtgctgggtcacgaagcgtccggtgtgatcacggcagccggtaaaaatgtgaaacacctgaaagtcggcgatcgcgtgtgcatggagccgggtattccggatctgcagtccccgcaatcccgagccggtatctataaccttgatcctgccgttcgtttctgggcaaccccgccaatcgacggctgcctgcgtgaaagcgtaatccaccctgccgccttcacctttaaactgcctgataacgtttcctttgcccagggcgcgatggttgagccgctggcaatcggtatgcagtccgccaccaaagccgggatcaaaccgggcgacatcggtctggttatcggtgccgggacaatcggtatcattacgcagagcgcactggccggcggctgttccgatgtcatcatctgtgatgtgttcgatgaaaaactgaaagtggctgagaaatatcagggtctgcacgcagtaaacagcaaagaccagcaggcactggcagataaagtccgtgaactgaccggcggcgaaggcgtgaacgtcctgtttgagtgcagcggcgcgaaaccggttattgcctccatctctgatcatatcgcccccggcggtaccgcagttctcgtcggcatgcctatcgacccggcaccgctggatatcgtggcggcacaggcgaaagaagtgaccttcaaaactattttgcgctacgccaatatgtatcctcgcaccatccgtctgctgagctccggcaaactgaatgtggcaccgctgctgtccgcaacctacaagttcaaagacagtgtcgaagcctatgagcgtgcagccgaaccggtgcgactgatgtga

SEQ ID NO: 51690 - protein, 338 aa, Morganella morganii
MIMKALVLEKAGKIAIQDWQSNEVLGDDDVEIKIHTVGICGSDVHYYQHGRIGPFVVDEPMVLGHEASGVITAAGKNVKHLKVGDRVCMEPGIPDLQSPQSRAGIYNLDPAVRFWATPPIDGCLRESVIHPAAFTFKLPDNVSFAQGAMVEPLAIGMQSATKAGIKPGDIGLVIGAGTIGIITQSALAGGCSDVIICDVFDEKLKVAEKYQGLHAVNSKDQQALADKVRELTGGEGVNVLFECSGAKPVIASISDHIAPGGTAVLVGMPIDPAPLDIVAAQAKEVTFKTILRYANMYPRTIRLLSSGKLNVAPLLSATYKFKDSVEAYERAAEPVRLM

SEQ ID NO: 51691 - DNA, 1041 bp, Rhizobium meliloti
  CDS (1)..(1041)
gtggcaaaggcgcttgtacttgaaaagaaggggcagttgtcgctgcgcgacatcccggtccggcgggatctgtcgccgaccgacgtgctgatcggaatccgcaccgtcggcgtttgcggctccgatgtccactattatacccatggaaagatcgggccctttgtcgtcaacgagccgatgatattgggccacgaggccgcgggcgtcgttctggaggtcggctcgcaagtccggcatctgaagaagggtgaccgtgtctgcatggaacccggcattccggacctctcctcccggtcgtccaagctgggcatctacaatgtcgatccgtccgtacggttctgggccacgccgccggtccatggatgcctgacgcccgaggtcgttcatccggcggccttcacctatcgtctgcccgaccacgtgtccttcgcggaaggggcgatggtcgagccgttcgccatcggcgtacaggccgcccttcgcgcgggcatcaggccaggcgatgtcggcgccgtcatgggggccggcccgatcggcatgatgacggcactggccgcgctcgcggggggatgctccaaggtctacgtggccgacctcgcgcagccgaagctggatgtcatcggggcctatgagggtatcgagacaatcaatgtccgccagcaggcggtatccgaggctctcgcgggggcgacgggcggctggggggcggatgtcgtcttcgagtgctccggagccgcacccgcaatccttgctcttccgagtcttgcgcgcccgggcggaaccgtcgtgctcgtcggcatgcccgtcgaacccgtccccttcgatatcgtcggtatgcaggccaaggaactgcggatcgagaccgtgttccgctatgccaatgtctacgaccgcgctatcgaactgatcgcctccggcaaggtcgatttgaaaccgctgatctcggcgaccattccgttcgacgagagtatcgcggccttcgaccgcgccgtcgaggcgcgccccacggacgtgaagatacagatcgagatgccggcttaa

SEQ ID NO: 51692 - protein, 346 aa, Rhizobium meliloti
MAKALVLEKKGQLSLRDIPVRRDLSPTDVLIGIRTVGVCGSDVHYYTHGKIGPFVVNEPMILGHEAAGVVLEVGSQVRHLKKGDRVCMEPGIPDLSSRSSKLGIYNVDPSVRFWATPPVHGCLTPEVVHPAAFTYRLPDHVSFAEGAMVEPFAIGVQAALRAGIRPGDVGAVMGAGPIGMMTALAALAGGCSKVYVADLAQPKLDVIGAYEGIETINVRQQAVSEALAGATGGWGADVVFECSGAAPAILALPSLARPGGTVVLVGMPVEPVPFDIVGMQAKELRIETVFRYANVYDRAIELIASGKVDLKPLISATIPFDESIAAFDRAVEARPTDVKIQIEMPA

SEQ ID NO: 51693 - DNA, 1029 bp, Haemophilus influenzae
  CDS (1)..(1029)
atgaaggagcgaatcaaagcaatatgtttagaaaaaccaaacaatgtagttgttaaagaagtgccttatcccgagaaaagtgataatgatgtacttattcaggtagaatcaatggggatttgtggttctgatattggtgcatatagaggaactaatccattagtaacttatccaagaatacttgggcatgaaattgtagggagagtaattgaaagtggaattggtatgtcagatggggtaagggttggagaccgagtaattgttgatccttatgtttgttgtggtcaatgctatccttgttcaattggtagaaccaattgttgtgaatcattaaaggtaattggtgttcatattgatggaggtatgcaagaggtaattagacatcccgctcatcttttaactaaagtcccagataacctaccgattcatcaattacctttagctgaacctttaacaatagctttacacgctttacatagaacaactttaaaatcaggggaacacatagtaattattggagctggtgcaattggattaatggctgcattagcagcggttcaatatggagcaatcccaattttagttgatatattagaacaacgtcttgagtatgcaaaatccttgggaattgaacatattgtaaatccgcataaggaggatgacattaaaagaattaaggaaattacaagtggtcgtatggctgaagttgttatggaggcatctggtgctaatatttctatcaaaaatactctgcattatgcctcctttgcaggaagaattgctttaacaggatggccaaaaacagaaactccattaccaacaaatttaattacctttaaagaattgaatatttatggttctagaacaagcaagggggaatttgaggaggcattggatatgcttgctactaataaaattaatgcatctcatatcattactaagtgtatcaaatttgaagaaattcctagttttatttctgatttatctgatcatccagaaaattatttaaaaattaatgcagttttctaa

SEQ ID NO: 51694 - protein, 342 aa, Haemophilus influenzae
MKERIKAICLEKPNNVVVKEVPYPEKSDNDVLIQVESMGICGSDIGAYRGTNPLVTYPRILGHEIVGRVIESGIGMSDGVRVGDRVIVDPYVCCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYASFAGRIALTGWPKTETPLPTNLITFKELNIYGSRTSKGEFEEALDMLATNKINASHIITKCIKFEEIPSFISDLSDHPENYLKINAVF

SEQ ID NO: 51695 - DNA, 1044 bp, Escherichia coli
  CDS (1)..(1044)
atgaaaaattcaaaagcaatattgcaggtgccgggcacaatgaaaattatttcagcagaaataccagtgcctaaagaagatgaagttttgattaaagtagaatatgtcggtatttgtggttcagatgtacatggttttgaatcaggcccgtttattccgcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatctgcccggacgttgattttatggcgacacaacccaactaccgcggcgcattaacgcactatctgtgtcatccggagagctttacttacaaactgcccgacaatatggacacgatggaaggggcgctggtggagcctgccgcagtcgggatgcatgccgcgatgctggcagatgttaaaccgggtaagaagataattattctgggagcaggttgtattggtttgatgacgttgcaagcgtgcaaatgcctgggagcaacggaaattgccgtcgttgatgtgctggaaaaacgtctggcaatggcggaacagcttggtgcgacagtggttattaacggcgcaaaagaagacactattgcacgctgtcagcaatttaccgaagacatgggcgcagatattgttttcgaaacagcgggttctgcggtcaccgttaaacaggcaccttatctggtaatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcttcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 51696 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 51697 - DNA, 25 bp, Primer
atgaaaaagttagtagccacagcac

SEQ ID NO: 51698 - DNA, 25 bp, Primer
ttaaaacgtaacgcccattttgatg

SEQ ID NO: 51699 - protein, 311 aa, consensus
  MISC_FEATURE (1)..(311): consensus for the disclosure of xaa see table XV
PXXXXXXXXXXXXXXXXXXXXXXXXXDXXXXXXXXXXXXXXXXXXXXXXXXXXXXGXEXXGXXXXXGXXVXXXXXXXXXGXXVXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXGXXXXXXGXXGXXGXXXXXXXXXXGAXXXXXXXXXXXXXXXXXAXXXGAXXXXXXXXXXXXXXXXXXXXXXXXXXXXXXXXXXXDXXXXXXGXXXXXXXXXXXXXXXXXXXXXG

SEQ ID NO: 51700 - protein, 84 aa, consensus
  MISC_FEATURE (1)..(84): consensus for the disclosure of xaa see table XV
XXXXXXXXXXXXXXXXXXXXXXXXXXXXXXXXXXXXXXXXXXXXXXXXXGXXXXXXXXXXXXXXXXXXXXXXXXXXXXXXXXXX

SEQ ID NO: 51701 - DNA, 1614 bp, Escherichia coli; identical to SEQ ID NO: 38469
  CDS (130)..(1503)

SEQ ID NO: 51702 - protein, 457 aa, Escherichia coli; identical to SEQ ID NO: 38470

SEQ ID NO: 51703 - DNA, 1221 bp, Thermococcus kodakaraensis; identical to SEQ ID NO: 38471
  CDS (1)..(1221)

SEQ ID NO: 51704 - protein, 406 aa, Thermococcus kodakaraensis; identical to SEQ ID NO: 38472

SEQ ID NO: 51705 - DNA, 1530 bp, Staphylococcus epidermidis RP62A; identical to SEQ ID NO: 38473
  CDS (1)..(1530)

SEQ ID NO: 51706 - protein, 509 aa, Staphylococcus epidermidis RP62A; identical to SEQ ID NO: 38474

SEQ ID NO: 51707 - DNA, 1452 bp, Homo sapiens; identical to SEQ ID NO: 38475
  CDS (1)..(1452)

SEQ ID NO: 51708 - protein, 483 aa, Homo sapiens; identical to SEQ ID NO: 38476

SEQ ID NO: 51709 - DNA, 1107 bp, Archaeoglobus fulgidus DSM 4304; identical to SEQ ID NO: 38477
  CDS (1)..(1107)

SEQ ID NO: 51710 - protein, 368 aa, Archaeoglobus fulgidus DSM 4304; identical to SEQ ID NO: 38478

SEQ ID NO: 51711 - DNA, 1131 bp, Thermoplasma volcanium GSS1; identical to SEQ ID NO: 38479
  CDS (1)..(1131)

SEQ ID NO: 51712 - protein, 376 aa, Thermoplasma volcanium GSS1; identical to SEQ ID NO: 38480

SEQ ID NO: 51713 - DNA, 1506 bp, Arabidopsis thaliana; identical to SEQ ID NO: 38481
  CDS (1)..(1506)

SEQ ID NO: 51714 - protein, 501 aa, Arabidopsis thaliana; identical to SEQ ID NO: 38482

SEQ ID NO: 51715 - DNA, 1833 bp, Arabidopsis thaliana; identical to SEQ ID NO: 38483
  CDS (1)..(1833)

SEQ ID NO: 51716 - protein, 610 aa, Arabidopsis thaliana; identical to SEQ ID NO: 38484

SEQ ID NO: 51717 - DNA, 1851 bp, Arabidopsis thaliana; identical to SEQ ID NO: 38485
  CDS (1)..(1851)

SEQ ID NO: 51718 - protein, 616 aa, Arabidopsis thaliana [sequence omitted]

SEQ ID NO: 51719 - DNA, 1497 bp, Arabidopsis thaliana; identical to SEQ ID NO: 38487
  CDS (1)..(1497)

SEQ ID NO: 51720 - protein, 498 aa, Arabidopsis thaliana; identical to SEQ ID NO: 38488

SEQ ID NO: 51721 - DNA, 2370 bp, Arabidopsis thaliana; identical to SEQ ID NO: 38489
  CDS (1)..(2370)

SEQ ID NO: 51722 - protein, 789 aa, Arabidopsis thaliana; identical to SEQ ID NO: 38490

SEQ ID NO: 51723 - DNA, 2142 bp, Arabidopsis thaliana; identical to SEQ ID NO: 38491
  CDS (1)..(2142)

SEQ ID NO: 51724 - protein, 713 aa, Arabidopsis thaliana; identical to SEQ ID NO: 38492

SEQ ID NO: 51725 - DNA, 1479 bp, Helicobacter pylori 26695; identical to SEQ ID NO: 38493
  CDS (1)..(1479)

SEQ ID NO: 51726 - protein, 492 aa, Helicobacter pylori 26695; identical to SEQ ID NO: 38494

SEQ ID NO: 51727 - DNA, 1950 bp, Treponema pallidum subsp. pallidum str. Nichols; identical to SEQ ID NO: 38495
  CDS (1)..(1950)

SEQ ID NO: 51728 - protein, 649 aa, Treponema pallidum subsp. pallidum str. Nichols; identical to SEQ ID NO: 38496

SEQ ID NO: 51729 - DNA, 1476 bp, Helicobacter pylori J99; identical to SEQ ID NO: 38497
  CDS (1)..(1476)

SEQ ID NO: 51730 - protein, 491 aa, Helicobacter pylori J99; identical to SEQ ID NO: 38498

SEQ ID NO: 51731 - DNA, 1833 bp, Pasteurella multocida subsp. multocida str. Pm70; identical to SEQ ID NO: 38499
  CDS (1)..(1833)

SEQ ID NO: 51732 - protein, 610 aa, Pasteurella multocida subsp. multocida str. Pm70; identical to SEQ ID NO: 38500

SEQ ID NO: 51733 - DNA, 1389 bp, Neisseria meningitidis MC58; identical to SEQ ID NO: 38501
  CDS (1)..(1389)

SEQ ID NO: 51734 - protein, 462 aa, Neisseria meningitidis MC58; identical to SEQ ID NO: 38502

SEQ ID NO: 51735 - DNA, 1278 bp, Methanothermobacter thermautotrophicus str. Delta H; identical to SEQ ID NO: 38503
  CDS (1)..(1278)

SEQ ID NO: 51736 - protein, 425 aa, Methanothermobacter thermautotrophicus str. Delta H; identical to SEQ ID NO: 38504

SEQ ID NO: 51737 - DNA, 1446 bp, Clostridium acetobutylicum ATCC 824; identical to SEQ ID NO: 38505
  CDS (1)..(1446)

SEQ ID NO: 51738 - protein, 481 aa, Clostridium acetobutylicum ATCC 824; identical to SEQ ID NO: 38506

SEQ ID NO: 51739 - DNA, 1167 bp, Thermoplasma acidophilum DSM 1728; identical to SEQ ID NO: 38507
  CDS (1)..(1167)

SEQ ID NO: 51740 - protein, 388 aa, Thermoplasma acidophilum DSM 1728; identical to SEQ ID NO: 38508

SEQ ID NO: 51741 - DNA, 1941 bp, Escherichia coli K12; identical to SEQ ID NO: 38509
  CDS (1)..(1941)

SEQ ID NO: 51742 - protein, 646 aa, Escherichia coli K12; identical to SEQ ID NO: 38510

SEQ ID NO: 51743 - DNA, 1554 bp, Caulobacter crescentus CB15; identical to SEQ ID NO: 38511
  CDS (1)..(1554)

SEQ ID NO: 51744 - protein, 517 aa, Caulobacter crescentus CB15; identical to SEQ ID NO: 38512

SEQ ID NO: 51745 - DNA, 1512 bp, Sinorhizobium meliloti 1021; identical to SEQ ID NO: 38513
  CDS (1)..(1512)

SEQ ID NO: 51746 - protein, 503 aa, Sinorhizobium meliloti 1021; identical to SEQ ID NO: 38514

SEQ ID NO: 51747 - DNA, 1479 bp, Synechocystis sp. PCC 6803; identical to SEQ ID NO: 38515
  CDS (1)..(1479)

SEQ ID NO: 51748 - protein, 492 aa, Synechocystis sp. PCC 6803; identical to SEQ ID NO: 38516

SEQ ID NO: 51749 - DNA, 1374 bp, Salmonella typhimurium LT2; identical to SEQ ID NO: 38517
  CDS (1)..(1374)

SEQ ID NO: 51750 - protein, 457 aa, Salmonella typhimurium LT2; identical to SEQ ID NO: 38518

SEQ ID NO: 51751 - DNA, 1890 bp, Salmonella typhimurium LT2; identical to SEQ ID NO: 38519
  CDS (1)..(1890)

SEQ ID NO: 51752 - protein, 629 aa, Salmonella typhimurium LT2; identical to SEQ ID NO: 38520

SEQ ID NO: 51753 - DNA, 1563 bp, Listeria monocytogenes EGD-e; identical to SEQ ID NO: 38521
  CDS (1)..(1563)

SEQ ID NO: 51754 - protein, 520 aa, Listeria monocytogenes EGD-e; identical to SEQ ID NO: 38522

SEQ ID NO: 51755 - DNA, 1542 bp, Nostoc sp. PCC 7120; identical to SEQ ID NO: 38523
  CDS (1)..(1542)

SEQ ID NO: 51756 - protein, 513 aa, Nostoc sp. PCC 7120; identical to SEQ ID NO: 38524

SEQ ID NO: 51757 - DNA, 1281 bp, Nostoc sp. PCC 7120; identical to SEQ ID NO: 38525
  CDS (1)..(1281)

SEQ ID NO: 51758 - protein, 426 aa, Nostoc sp. PCC 7120; identical to SEQ ID NO: 38526

SEQ ID NO: 51759 - DNA, 1200 bp, Caenorhabditis elegans; identical to SEQ ID NO: 38527
  CDS (1)..(1200)

SEQ ID NO: 51760 - protein, 399 aa, Caenorhabditis elegans; identical to SEQ ID NO: 38528

SEQ ID NO: 51761 - DNA, 1398 bp, Ralstonia solanacearum GMI1000; identical to SEQ ID NO: 38529
  CDS (1)..(1398)

SEQ ID NO: 51762 - protein, 465 aa, Ralstonia solanacearum GMI1000; identical to SEQ ID NO: 38530

SEQ ID NO: 51763 - DNA, 1509 bp, Agrobacterium tumefaciens str. C58; identical to SEQ ID NO: 38531
  CDS (1)..(1509)

SEQ ID NO: 51764 - protein, 502 aa, Agrobacterium tumefaciens str. C58; identical to SEQ ID NO: 38532

SEQ ID NO: 51765 - DNA, 1608 bp, Brucella melitensis 16M; identical to SEQ ID NO: 38533
  CDS (1)..(1608)

SEQ ID NO: 51766 - protein, 535 aa, Brucella melitensis 16M; identical to SEQ ID NO: 38534

SEQ ID NO: 51767 - DNA, 1437 bp, Clostridium perfringens str. 13; identical to SEQ ID NO: 38535
  CDS (1)..(1437)

SEQ ID NO: 51768 - protein, 478 aa, Clostridium perfringens str. 13; identical to SEQ ID NO: 38536

SEQ ID NO: 51769 - DNA, 1587 bp, Clostridium perfringens str. 13; identical to SEQ ID NO: 38537
  CDS (1)..(1587)

SEQ ID NO: 51770 - protein, 528 aa, Clostridium perfringens str. 13; identical to SEQ ID NO: 38538

SEQ ID NO: 51771 - DNA, 1989 bp, Schizosaccharomyces pombe; identical to SEQ ID NO: 38539
  CDS (1)..(1989)

SEQ ID NO: 51772 - protein, 662 aa, Schizosaccharomyces pombe; identical to SEQ ID NO: 38540

SEQ ID NO: 51773 - DNA, 1398 bp, Schizosaccharomyces pombe; identical to SEQ ID NO: 38541
  CDS (1)..(1398)

SEQ ID NO: 51774 - protein, 465 aa, Schizosaccharomyces pombe; identical to SEQ ID NO: 38542

SEQ ID NO: 51775 - DNA, 1362 bp, Schizosaccharomyces pombe; identical to SEQ ID NO: 38543
  CDS (1)..(1362)

SEQ ID NO: 51776 - protein, 453 aa, Schizosaccharomyces pombe; identical to SEQ ID NO: 38544

SEQ ID NO: 51777 - DNA, 1275 bp, Corynebacterium glutamicum ATCC 13032; identical to SEQ ID NO: 38545
  CDS (1)..(1275)

SEQ ID NO: 51778 - protein, 424 aa, Corynebacterium glutamicum ATCC 13032; identical to SEQ ID NO: 38546

SEQ ID NO: 51779 - DNA, 2199 bp, Corynebacterium glutamicum ATCC 13032; identical to SEQ ID NO: 38547
  CDS (1)..(2199)

SEQ ID NO: 51780 - protein, 732 aa, Corynebacterium glutamicum ATCC 13032; identical to SEQ ID NO: 38548

SEQ ID NO: 51781 - DNA, 1668 bp, Methanosarcina acetivorans C2A; identical to SEQ ID NO: 38549
  CDS (1)..(1668)

SEQ ID NO: 51782 - protein, 555 aa, Methanosarcina acetivorans C2A; identical to SEQ ID NO: 38550

SEQ ID NO: 51783 - DNA, 1764 bp, Methanosarcina mazei Go1; identical to SEQ ID NO: 38551
  CDS (1)..(1764)

SEQ ID NO: 51784 - protein, 587 aa, Methanosarcina mazei Go1; identical to SEQ ID NO: 38552

SEQ ID NO: 51785 - DNA, 1290 bp, Methanosarcina mazei Go1; identical to SEQ ID NO: 38553
  CDS (1)..(1290)

SEQ ID NO: 51786 - protein, 429 aa, Methanosarcina mazei Go1; identical to SEQ ID NO: 38554

SEQ ID NO: 51787 - DNA, 1293 bp, Xanthomonas campestris pv. campestris str. ATCC 33913; identical to SEQ ID NO: 38555
  CDS (1)..(1293)

SEQ ID NO: 51788 - protein, 430 aa, Xanthomonas campestris pv. campestris str. ATCC 33913; identical to SEQ ID NO: 38556

SEQ ID NO: 51789 - DNA, 1377 bp, Xanthomonas campestris pv. campestris str. ATCC 33913; identical to SEQ ID NO: 38557
  CDS (1)..(1377)

SEQ ID NO: 51790 - protein, 458 aa, Xanthomonas campestris pv. campestris str. ATCC 33913; identical to SEQ ID NO: 38558

SEQ ID NO: 51791 - DNA, 1293 bp, Xanthomonas axonopodis pv. citri str. 306; identical to SEQ ID NO: 38559
  CDS (1)..(1293)

SEQ ID NO: 51792 - protein, 430 aa, Xanthomonas axonopodis pv. citri str. 306; identical to SEQ ID NO: 38560

SEQ ID NO: 51793 - DNA, 1974 bp, Chlorobium tepidum TLS; identical to SEQ ID NO: 38561
  CDS (1)..(1974)

SEQ ID NO: 51794 - protein, 657 aa, Chlorobium tepidum TLS; identical to SEQ ID NO: 38562

SEQ ID NO: 51795 - DNA, 1245 bp, Chlorobium tepidum TLS; identical to SEQ ID NO: 38563
  CDS (1)..(1245)

SEQ ID NO: 51796 - protein, 414 aa, Chlorobium tepidum TLS; identical to SEQ ID NO: 38564

SEQ ID NO: 51797 - DNA, 1488 bp, Oceanobacillus iheyensis HTE831; identical to SEQ ID NO: 38565
  CDS (1)..(1488)

SEQ ID NO: 51798 - protein, 495 aa, Oceanobacillus iheyensis HTE831; identical to SEQ ID NO: 38566

SEQ ID NO: 51799 - DNA, 1566 bp, Leptospira interrogans serovar Lai str. 56601; identical to SEQ ID NO: 38567
  CDS (1)..(1566)

SEQ ID NO: 51800 - protein, 521 aa, Leptospira interrogans serovar Lai str. 56601; identical to SEQ ID NO: 38568

SEQ ID NO: 51801 - DNA, 1377 bp, Shewanella oneidensis MR-1; identical to SEQ ID NO: 38569
  CDS (1)..(1377)

SEQ ID NO: 51802 - protein, 458 aa, Shewanella oneidensis MR-1; identical to SEQ ID NO: 38570

SEQ ID NO: 51803 - DNA, 1302 bp, Shewanella oneidensis MR-1; identical to SEQ ID NO: 38571
  CDS (1)..(1302)

SEQ ID NO: 51804 - protein, 433 aa, Shewanella oneidensis MR-1; identical to SEQ ID NO: 38572

SEQ ID NO: 51805 - DNA, 1284 bp, Shewanella oneidensis MR-1; identical to SEQ ID NO: 38573
  CDS (1)..(1284)

SEQ ID NO: 51806 - protein, 427 aa, Shewanella oneidensis MR-1; identical to SEQ ID NO: 38574

SEQ ID NO: 51807 - DNA, 1230 bp, Shewanella oneidensis MR-1; identical to SEQ ID NO: 38575
  CDS (1)..(1230)

SEQ ID NO: 51808 - protein, 409 aa, Shewanella oneidensis MR-1; identical to SEQ ID NO: 38576

SEQ ID NO: 51809 - DNA, 1608 bp, Shewanella oneidensis MR-1; identical to SEQ ID NO: 38577
  CDS (1)..(1608)

SEQ ID NO: 51810 - protein, 535 aa, Shewanella oneidensis MR-1; identical to SEQ ID NO: 38578

SEQ ID NO: 51811 - DNA, 1872 bp, Shewanella oneidensis MR-1; identical to SEQ ID NO: 38579
  CDS (1)..(1872)

SEQ ID NO: 51812 - protein, 623 aa, Shewanella oneidensis MR-1; identical to SEQ ID NO: 38580

SEQ ID NO: 51813 - DNA, 1554 bp, Streptococcus mutans UA159; identical to SEQ ID NO: 38581
  CDS (1)..(1554)

SEQ ID NO: 51814 - protein, 517 aa, Streptococcus mutans UA159; identical to SEQ ID NO: 38582

SEQ ID NO: 51815 - DNA, 1446 bp, Clostridium tetani E88; identical to SEQ ID NO: 38583
  CDS (1)..(1446)

SEQ ID NO: 51816 - protein, 481 aa, Clostridium tetani E88; identical to SEQ ID NO: 38584

SEQ ID NO: 51817 - DNA, 1575 bp, Clostridium tetani E88; identical to SEQ ID NO: 38585
  CDS (1)..(1575)

SEQ ID NO: 51818 - protein, 524 aa, Clostridium tetani E88; identical to SEQ ID NO: 38586

SEQ ID NO: 51819 - DNA, 1113 bp, Clostridium tetani E88; identical to SEQ ID NO: 38587
  CDS (1)..(1113)

SEQ ID NO: 51820 - protein, 370 aa, Clostridium tetani E88; identical to SEQ ID NO: 38588

SEQ ID NO: 51821 - DNA, 1587 bp, Lactobacillus plantarum WCFS1; identical to SEQ ID NO: 38589
  CDS (1)..(1587)

SEQ ID NO: 51822 - protein, 528 aa, Lactobacillus plantarum WCFS1; identical to SEQ ID NO: 38590

SEQ ID NO: 51823 - DNA, 1380 bp, Vibrio parahaemolyticus RIMD 2210633; identical to SEQ ID NO: 38591
  CDS (1)..(1380)

SEQ ID NO: 51824 - protein, 459 aa, Vibrio parahaemolyticus RIMD 2210633; identical to SEQ ID NO: 38592

SEQ ID NO: 51825 - DNA, 1932 bp, Vibrio parahaemolyticus RIMD 2210633; identical to SEQ ID NO: 38593
  CDS (1)..(1932)

SEQ ID NO: 51826 - protein, 643 aa, Vibrio parahaemolyticus RIMD 2210633; identical to SEQ ID NO: 38594

SEQ ID NO: 51827 - DNA, 1125 bp, Bacteroides thetaiotaomicron VPI-5482; identical to SEQ ID NO: 38595
  CDS (1)..(1125)

SEQ ID NO: 51828 - protein, 374 aa, Bacteroides thetaiotaomicron VPI-5482; identical to SEQ ID NO: 38596

SEQ ID NO: 51829 - DNA, 1944 bp, Bacteroides thetaiotaomicron VPI-5482; identical to SEQ ID NO: 38597
  CDS (1)..(1944)

SEQ ID NO: 51830 - protein, 647 aa, Bacteroides thetaiotaomicron VPI-5482; identical to SEQ ID NO: 38598

SEQ ID NO: 51831 - DNA, 1611 bp, Enterococcus faecalis V583; identical to SEQ ID NO: 38599
  CDS (1)..(1611)

SEQ ID NO: 51832 - protein, 536 aa, Enterococcus faecalis V583; identical to SEQ ID NO: 38600

SEQ ID NO: 51833 - DNA, 1236 bp, Coxiella burnetii RSA 493; identical to SEQ ID NO: 38601
  CDS (1)..(1236)

SEQ ID NO: 51834 - protein, 411 aa, Coxiella burnetii RSA 493; identical to SEQ ID NO: 38602

SEQ ID NO: 51835 - DNA, 1545 bp, Bacillus cereus ATCC 14579; identical to SEQ ID NO: 38603
  CDS (1)..(1545)

SEQ ID NO: 51836 - protein, 514 aa, Bacillus cereus ATCC 14579; identical to SEQ ID NO: 38604

SEQ ID NO: 51837 - DNA, 1377 bp, Bacillus cereus ATCC 14579; identical to SEQ ID NO: 38605
  CDS (1)..(1377)

SEQ ID NO: 51838 - protein, 458 aa, Bacillus cereus ATCC 14579; identical to SEQ ID NO: 38606

SEQ ID NO: 51839 - DNA, 1446 bp, Bacillus cereus ATCC 14579; identical to SEQ ID NO: 38607
  CDS (1)..(1446)

SEQ ID NO: 51840 - protein, 481 aa, Bacillus cereus ATCC 14579; identical to SEQ ID NO: 38608

SEQ ID NO: 51841 - DNA, 1374 bp, Nitrosomonas europaea ATCC 19718; identical to SEQ ID NO: 38609
  CDS (1)..(1374)

SEQ ID NO: 51842 - protein, 457 aa, Nitrosomonas europaea ATCC 19718; identical to SEQ ID NO: 38610

SEQ ID NO: 51843 - DNA, 1860 bp, Arabidopsis thaliana; identical to SEQ ID NO: 38611
  CDS (1)..(1860)

SEQ ID NO: 51844 - protein, 619 aa, Arabidopsis thaliana; identical to SEQ ID NO: 38612

SEQ ID NO: 51845 - DNA, 1593 bp, Helicobacter hepaticus ATCC 51449; identical to SEQ ID NO: 38613
  CDS (1)..(1593)

SEQ ID NO: 51846 - protein, 530 aa, Helicobacter hepaticus ATCC 51449; identical to SEQ ID NO: 38614

SEQ ID NO: 51847 - DNA, 1359 bp, Rhodopirellula baltica SH 1; identical to SEQ ID NO: 38615
  CDS (1)..(1359)

SEQ ID NO: 51848 - protein, 452 aa, Rhodopirellula baltica SH 1; identical to SEQ ID NO: 38616

SEQ ID NO: 51849 - DNA, 2796 bp, Rhodopirellula baltica SH 1; identical to SEQ ID NO: 38617
  CDS (1)..(2796)

SEQ ID NO: 51850 - protein, 931 aa, Rhodopirellula baltica SH 1; identical to SEQ ID NO: 38618

SEQ ID NO: 51851 - DNA, 1752 bp, Wigglesworthia glossinidia endosymbiont of Glossina brevipalpis; identical to SEQ ID NO: 38619
  CDS (1)..(1752)

SEQ ID NO: 51852 - protein, 583 aa, Wigglesworthia glossinidia endosymbiont of Glossina brevipalpis; identical to SEQ ID NO: 38620

SEQ ID NO: 51853 - DNA, 1821 bp, Haemophilus ducreyi 35000HP; identical to SEQ ID NO: 38621
  CDS (1)..(1821)

SEQ ID NO: 51854 - protein, 606 aa, Haemophilus ducreyi 35000HP; identical to SEQ ID NO: 38622

SEQ ID NO: 51855 - DNA, 1812 bp, Prochlorococcus marinus subsp. marinus str. CCMP1375; identical to SEQ ID NO: 38623
  CDS (1)..(1812)

SEQ ID NO: 51856 - protein, 603 aa, Prochlorococcus marinus subsp. marinus str. CCMP1375; identical to SEQ ID NO: 38624

SEQ ID NO: 51857 - DNA, 1464 bp, Candidatus Blochmannia floridanus; identical to SEQ ID NO: 38625
  CDS (1)..(1464)

SEQ ID NO: 51858 - protein, 487 aa, Candidatus Blochmannia floridanus; identical to SEQ ID NO: 38626

SEQ ID NO: 51859 - DNA, 1725 bp, Bordetella pertussis Tohama I; identical to SEQ ID NO: 38627
  CDS (1)..(1725)

SEQ ID NO: 51860 - protein, 574 aa, Bordetella pertussis Tohama I; identical to SEQ ID NO: 38628

SEQ ID NO: 51861 - DNA, 1389 bp, Bordetella bronchiseptica RB50; identical to SEQ ID NO: 38629
  CDS (1)..(1389)

SEQ ID NO: 51862 - protein, 462 aa, Bordetella bronchiseptica RB50; identical to SEQ ID NO: 38630

SEQ ID NO: 51863 - DNA, 1779 bp, Prochlorococcus marinus subsp. pastoris str. CCMP1986; identical to SEQ ID NO: 38631
  CDS (1)..(1779)

SEQ ID NO: 51864 - protein, 592 aa, Prochlorococcus marinus subsp. pastoris str. CCMP1986; identical to SEQ ID NO: 38632

SEQ ID NO: 51865 - DNA, 1797 bp, Synechococcus sp. WH 8102; identical to SEQ ID NO: 38633
  CDS (1)..(1797)

SEQ ID NO: 51866 - protein, 598 aa, Synechococcus sp. WH 8102; identical to SEQ ID NO: 38634

SEQ ID NO: 51867 - DNA, 1419 bp, Chromobacterium violaceum ATCC 12472; identical to SEQ ID NO: 38635
  CDS (1)..(1419)

SEQ ID NO: 51868 - protein, 472 aa, Chromobacterium violaceum ATCC 12472; identical to SEQ ID NO: 38636

SEQ ID NO: 51869 - DNA, 1326 bp, Chromobacterium violaceum ATCC 12472; identical to SEQ ID NO: 38637
  CDS (1)..(1326)

SEQ ID NO: 51870 - protein, 441 aa, Chromobacterium violaceum ATCC 12472; identical to SEQ ID NO: 38638

SEQ ID NO: 51871 - DNA, 1263 bp, Chromobacterium violaceum ATCC 12472; identical to SEQ ID NO: 38639
  CDS (1)..(1263)

SEQ ID NO: 51872 - protein, 420 aa, Chromobacterium violaceum ATCC 12472; identical to SEQ ID NO: 38640

SEQ ID NO: 51873 - DNA, 1383 bp, Chromobacterium violaceum ATCC 12472; identical to SEQ ID NO: 38641
  CDS (1)..(1383)

SEQ ID NO: 51874 - protein, 460 aa, Chromobacterium violaceum ATCC 12472; identical to SEQ ID NO: 38642

SEQ ID NO: 51875 - DNA, 1320 bp, Chromobacterium violaceum ATCC 12472; identical to SEQ ID NO: 38643
  CDS (1)..(1320)

SEQ ID NO: 51876 - protein, 439 aa, Chromobacterium violaceum ATCC 12472; identical to SEQ ID NO: 38644

SEQ ID NO: 51877 - DNA, 1815 bp, Porphyromonas gingivalis W83; identical to SEQ ID NO: 38645
  CDS (1)..(1815)

SEQ ID NO: 51878 - protein, 604 aa, Porphyromonas gingivalis W83; identical to SEQ ID NO: 38646

SEQ ID NO: 51879 - DNA, 1284 bp, Porphyromonas gingivalis W83; identical to SEQ ID NO: 38647
  CDS (1)..(1284)

SEQ ID NO: 51880 - protein, 427 aa, Porphyromonas gingivalis W83; identical to SEQ ID NO: 38648

SEQ ID NO: 51881 - DNA, 1518 bp, Wolinella succinogenes DSM 1740; identical to SEQ ID NO: 38649
  CDS (1)..(1518)

SEQ ID NO: 51882 - protein, 505 aa, Wolinella succinogenes DSM 1740; identical to SEQ ID NO: 38650

SEQ ID NO: 51883 - DNA, 1215 bp, Oryza sativa (japonica cultivar-group); identical to SEQ ID NO: 38651
  CDS (1)..(1215)

SEQ ID NO: 51884 - protein, 404 aa, Oryza sativa (japonica cultivar-group); identical to SEQ ID NO: 38652

SEQ ID NO: 51885 - DNA, 2277 bp, Oryza sativa (japonica cultivar-group); identical to SEQ ID NO: 38653
  CDS (1)..(2277)

SEQ ID NO: 51886 - protein, 758 aa, Oryza sativa (japonica cultivar-group); identical to SEQ ID NO: 38654

SEQ ID NO: 51887 - DNA, 1485 bp, Oryza sativa (japonica cultivar-group); identical to SEQ ID NO: 38655
  CDS (1)..(1485)

SEQ ID NO: 51888 - protein, 494 aa, Oryza sativa (japonica cultivar-group); identical to SEQ ID NO: 38656

SEQ ID NO: 51889 - DNA, 2676 bp, Oryza sativa (japonica cultivar-group); identical to SEQ ID NO: 38657
  CDS (1)..(2676)

SEQ ID NO: 51890 - protein, 891 aa, Oryza sativa (japonica cultivar-group); identical to SEQ ID NO: 38658

SEQ ID NO: 51891 - DNA, 1155 bp, Gloeobacter violaceus PCC 7421; identical to SEQ ID NO: 38659
  CDS (1)..(1155)

SEQ ID NO: 51892 - protein, 384 aa, Gloeobacter violaceus PCC 7421; identical to SEQ ID NO: 38660

SEQ ID NO: 51893 - DNA, 1314 bp, Gloeobacter violaceus PCC 7421; identical to SEQ ID NO: 38661
  CDS (1)..(1314)

SEQ ID NO: 51894 - protein, 437 aa, Gloeobacter violaceus PCC 7421; identical to SEQ ID NO: 38662

SEQ ID NO: 51895 - DNA, 1305 bp, Photorhabdus luminescens subsp. laumondii TTO1; identical to SEQ ID NO: 38663
  CDS (1)..(1305)

SEQ ID NO: 51896 - protein, 434 aa, Photorhabdus luminescens subsp. laumondii TTO1; identical to SEQ ID NO: 38664

SEQ ID NO: 51897 - DNA, 1935 bp, Photorhabdus luminescens subsp. laumondii TTO1; identical to SEQ ID NO: 38665
  CDS (1)..(1935)

SEQ ID NO: 51898 - protein, 644 aa, Photorhabdus luminescens subsp. laumondii TTO1; identical to SEQ ID NO: 38666

SEQ ID NO: 51899 - DNA, 1380 bp, Vibrio vulnificus YJ016; identical to SEQ ID NO: 38667
  CDS (1)..(1380)

SEQ ID NO: 51900 - protein, 459 aa, Vibrio vulnificus YJ016; identical to SEQ ID NO: 38668

SEQ ID NO: 51901 - DNA, 1407 bp, Danio rerio; identical to SEQ ID NO: 38669
  CDS (1)..(1407)

SEQ ID NO: 51902 - protein, 468 aa, Danio rerio; identical to SEQ ID NO: 38670

SEQ ID NO: 51903 - DNA, 1425 bp, Rhodopseudomonas palustris CGA009; identical to SEQ ID NO: 38671
  CDS (1)..(1425)

SEQ ID NO: 51904 - protein, 474 aa, Rhodopseudomonas palustris CGA009; identical to SEQ ID NO: 38672

SEQ ID NO: 51905 - DNA, 2085 bp, Rhodopseudomonas palustris CGA009; identical to SEQ ID NO: 38673
  CDS (1)..(2085)

SEQ ID NO: 51906 - protein, 694 aa, Rhodopseudomonas palustris CGA009; identical to SEQ ID NO: 38674

SEQ ID NO: 51907 - DNA, 1659 bp, Onion yellows phytoplasma OY-M; identical to SEQ ID NO: 38675
  CDS (1)..(1659)

SEQ ID NO: 51908 - protein, 552 aa, Onion yellows phytoplasma OY-M; identical to SEQ ID NO: 38676

SEQ ID NO: 51909 - DNA, 1383 bp, Geobacter sulfurreducens PCA; identical to SEQ ID NO: 38677
  CDS (1)..(1383)

SEQ ID NO: 51910 - protein, 460 aa, Geobacter sulfurreducens PCA; identical to SEQ ID NO: 38678

SEQ ID NO: 51911 - DNA, 1353 bp, Geobacter sulfurreducens PCA; identical to SEQ ID NO: 38679
  CDS (1)..(1353)

SEQ ID NO: 51912 - protein, 450 aa, Geobacter sulfurreducens PCA; identical to SEQ ID NO: 38680

SEQ ID NO: 51913 - DNA, 1455 bp, Lactobacillus johnsonii NCC 533; identical to SEQ ID NO: 38681
  CDS (1)..(1455)

SEQ ID NO: 51914 - protein, 484 aa, Lactobacillus johnsonii NCC 533; identical to SEQ ID NO: 38682

SEQ ID NO: 51915 - DNA, 1227 bp, Wolbachia endosymbiont of Drosophila melanogaster; identical to SEQ ID NO: 38683
  CDS (1)..(1227)

SEQ ID NO: 51916 - protein, 408 aa, Wolbachia endosymbiont of Drosophila melanogaster; identical to SEQ ID NO: 38684

SEQ ID NO: 51917 - DNA, 1518 bp, Bdellovibrio bacteriovorus HD100; identical to SEQ ID NO: 38685
  CDS (1)..(1518)

SEQ ID NO: 51918 - protein, 505 aa, Bdellovibrio bacteriovorus HD100; identical to SEQ ID NO: 38686

SEQ ID NO: 51919 - DNA, 1518 bp, Bdellovibrio bacteriovorus HD100; identical to SEQ ID NO: 38687
  CDS (1)..(1518)

SEQ ID NO: 51920 - protein, 505 aa, Bdellovibrio bacteriovorus HD100; identical to SEQ ID NO: 38688

SEQ ID NO: 51921 - DNA, 1971 bp, Bdellovibrio bacteriovorus HD100; identical to SEQ ID NO: 38689
  CDS (1)..(1971)

SEQ ID NO: 51922 - protein, 656 aa, Bdellovibrio bacteriovorus HD100; identical to SEQ ID NO: 38690

SEQ ID NO: 51923 - DNA, 1650 bp, Bdellovibrio bacteriovorus HD100; identical to SEQ ID NO: 38691
  CDS (1)..(1650)

SEQ ID NO: 51924 - protein, 549 aa, Bdellovibrio bacteriovorus HD100; identical to SEQ ID NO: 38692

SEQ ID NO: 51925 - DNA, 1776 bp, Arabidopsis thaliana; identical to SEQ ID NO: 38693
  CDS (1)..(1776)

SEQ ID NO: 51926 - protein, 591 aa, Arabidopsis thaliana; identical to SEQ ID NO: 38694

SEQ ID NO: 51927 - DNA, 1446 bp, Bacillus cereus ATCC 10987; identical to SEQ ID NO: 38695
  CDS (1)..(1446)

SEQ ID NO: 51928 - protein, 481 aa, Bacillus cereus ATCC 10987; identical to SEQ ID NO: 38696

SEQ ID NO: 51929 - DNA, 2205 bp, Eremothecium gossypii; identical to SEQ ID NO: 38697
  CDS (1)..(2205)

SEQ ID NO: 51930 - protein, 734 aa, Eremothecium gossypii; identical to SEQ ID NO: 38698

SEQ ID NO: 51931 - DNA, 1197 bp, Eremothecium gossypii; identical to SEQ ID NO: 38699
  CDS (1)..(1197)

SEQ ID NO: 51932 - protein, 398 aa, Eremothecium gossypii; identical to SEQ ID NO: 38700

SEQ ID NO: 51933 - DNA, 1617 bp, Methanococcus maripaludis S2; identical to SEQ ID NO: 38701
  CDS (1)..(1617)

SEQ ID NO: 51934 - protein, 538 aa, Methanococcus maripaludis S2; identical to SEQ ID NO: 38702

SEQ ID NO: 51935 - DNA, 2100 bp, Xenopus tropicalis; identical to SEQ ID NO: 38703
  CDS (1)..(2100)

SEQ ID NO: 51936 - protein, 699 aa, Xenopus tropicalis; identical to SEQ ID NO: 38704

SEQ ID NO: 51937 - DNA, 1440 bp, Xenopus tropicalis; identical to SEQ ID NO: 38705
  CDS (1)..(1440)

SEQ ID NO: 51938 - protein, 479 aa, Xenopus tropicalis; identical to SEQ ID NO: 38706

SEQ ID NO: 51939 - DNA, 1809 bp, Anopheles gambiae str. PEST; identical to SEQ ID NO: 38707
  CDS (1)..(1809)

SEQ ID NO: 51940 - protein, 602 aa, Anopheles gambiae str. PEST; identical to SEQ ID NO: 38708

SEQ ID NO: 51941 - DNA, 1548 bp, Neurospora crassa; identical to SEQ ID NO: 38709
  CDS (1)..(1548)

SEQ ID NO: 51942 - protein, 515 aa, Neurospora crassa; identical to SEQ ID NO: 38710

SEQ ID NO: 51943 - DNA, 1203 bp, Neurospora crassa; identical to SEQ ID NO: 38711
  CDS (1)..(1203)

SEQ ID NO: 51944 - protein, 400 aa, Neurospora crassa; identical to SEQ ID NO: 38712

SEQ ID NO: 51945 - DNA, 1278 bp, Neurospora crassa; identical to SEQ ID NO: 38713
  CDS (1)..(1278)

SEQ ID NO: 51946 - protein, 425 aa, Neurospora crassa; identical to SEQ ID NO: 38714

SEQ ID NO: 51947 - DNA, 1278 bp, Magnaporthe grisea 70-15; identical to SEQ ID NO: 38715
  CDS (1)..(1278)

SEQ ID NO: 51948 - protein, 425 aa, Magnaporthe grisea 70-15; identical to SEQ ID NO: 38716

SEQ ID NO: 51949 - DNA, 2025 bp, Magnaporthe grisea 70-15; identical to SEQ ID NO: 38717
  CDS (1)..(2025)

SEQ ID NO: 51950 - protein, 674 aa, Magnaporthe grisea 70-15; identical to SEQ ID NO: 38718

SEQ ID NO: 51951 - DNA, 1746 bp, Gibberella zeae PH-1; identical to SEQ ID NO: 38719
  CDS (1)..(1746)

SEQ ID NO: 51952 - protein, 581 aa, Gibberella zeae PH-1; identical to SEQ ID NO: 38720

SEQ ID NO: 51953 - DNA, 1461 bp, Gibberella zeae PH-1; identical to SEQ ID NO: 38721
  CDS (1)..(1461)

SEQ ID NO: 51954 - protein, 486 aa, Gibberella zeae PH-1; identical to SEQ ID NO: 38722

SEQ ID NO: 51955 - DNA, 1206 bp, Gibberella zeae PH-1; identical to SEQ ID NO: 38723
  CDS (1)..(1206)

SEQ ID NO: 51956 - protein, 401 aa, Gibberella zeae PH-1; identical to SEQ ID NO: 38724

SEQ ID NO: 51957 - DNA, 1875 bp, Apis mellifera; identical to SEQ ID NO: 38725
  CDS (1)..(1875)

SEQ ID NO: 51958 - protein, 624 aa, Apis mellifera; identical to SEQ ID NO: 38726

SEQ ID NO: 51959 - DNA, 1656 bp, Ustilago maydis 521; identical to SEQ ID NO: 38727
  CDS (1)..(1656)

SEQ ID NO: 51960 - protein, 551 aa, Ustilago maydis 521; identical to SEQ ID NO: 38728

SEQ ID NO: 51961 - DNA, 1194 bp, Ustilago maydis 521; identical to SEQ ID NO: 38729
  CDS (1)..(1194)

SEQ ID NO: 51962 - protein, 397 aa, Ustilago maydis 521; identical to SEQ ID NO: 38730

SEQ ID NO: 51963 - DNA, 1266 bp, Aspergillus nidulans FGSC A4; identical to SEQ ID NO: 38731
  CDS (1)..(1266)

SEQ ID NO: 51964 - protein, 421 aa, Aspergillus nidulans FGSC A4; identical to SEQ ID NO: 38732

SEQ ID NO: 51965 - DNA, 1398 bp, Aspergillus nidulans FGSC A4; identical to SEQ ID NO: 38733
  CDS (1)..(1398)

SEQ ID NO: 51966 - protein, 465 aa, Aspergillus nidulans FGSC A4; identical to SEQ ID NO: 38734

SEQ ID NO: 51967 - DNA, 1497 bp, Aspergillus nidulans FGSC A4; identical to SEQ ID NO: 38735
  CDS (1)..(1497)

SEQ ID NO: 51968 - protein, 498 aa, Aspergillus nidulans FGSC A4; identical to SEQ ID NO: 38736

SEQ ID NO: 51969 - DNA, 1200 bp, Aspergillus nidulans FGSC A4; identical to SEQ ID NO: 38737
  CDS (1)..(1200)

SEQ ID NO: 51970 - protein, 399 aa, Aspergillus nidulans FGSC A4; identical to SEQ ID NO: 38738

SEQ ID NO: 51971 - DNA, 2178 bp, Candida glabrata CBS138; identical to SEQ ID NO: 38739
  CDS (1)..(2178)

SEQ ID NO: 51972 - protein, 725 aa, Candida glabrata CBS138; identical to SEQ ID NO: 38740

SEQ ID NO: 51973 - DNA, 1482 bp, Candida glabrata CBS138; identical to SEQ ID NO: 38741
  CDS (1)..(1482)

SEQ ID NO: 51974 - protein, 493 aa, Candida glabrata CBS138; identical to SEQ ID NO: 38742

SEQ ID NO: 51975 - DNA, 1635 bp, Candida glabrata CBS138; identical to SEQ ID NO: 38743
  CDS (1)..(1635)

SEQ ID NO: 51976 - protein, 544 aa, Candida glabrata CBS138; identical to SEQ ID NO: 38744

SEQ ID NO: 51977 - DNA, 1197 bp, Kluyveromyces lactis NRRL Y-1140; identical to SEQ ID NO: 38745
  CDS (1)..(1197)

SEQ ID NO: 51978 - protein, 398 aa, Kluyveromyces lactis NRRL Y-1140; identical to SEQ ID NO: 38746

SEQ ID NO: 51979 - DNA, 1464 bp, Kluyveromyces lactis NRRL Y-1140; identical to SEQ ID NO: 38747
  CDS (1)..(1464)

SEQ ID NO: 51980 - protein, 487 aa, Kluyveromyces lactis NRRL Y-1140; identical to SEQ ID NO: 38748

SEQ ID NO: 51981 - DNA, 2247 bp, Kluyveromyces lactis NRRL Y-1140; identical to SEQ ID NO: 38749
  CDS (1)..(2247)

SEQ ID NO: 51982 - protein, 748 aa, Kluyveromyces lactis NRRL Y-1140; identical to SEQ ID NO: 38750

SEQ ID NO: 51983 - DNA, 1665 bp, Kluyveromyces lactis NRRL Y-1140; identical to SEQ ID NO: 38751
  CDS (1)..(1665)

SEQ ID NO: 51984 - protein, 554 aa, Kluyveromyces lactis NRRL Y-1140; identical to SEQ ID NO: 38752

SEQ ID NO: 51985 - DNA, 1611 bp, Debaryomyces hansenii CBS767; identical to SEQ ID NO: 38753
  CDS (1)..(1611)

SEQ ID NO: 51986 - protein, 536 aa, Debaryomyces hansenii CBS767; identical to SEQ ID NO: 38754

SEQ ID NO: 51987 - DNA, 1917 bp, Oryza sativa (japonica cultivar-group); identical to SEQ ID NO: 38755
  CDS (1)..(1917)

SEQ ID NO: 51988 - protein, 638 aa, Oryza sativa (japonica cultivar-group); identical to SEQ ID NO: 38756

SEQ ID NO: 51989 - DNA, 1443 bp, Yarrowia lipolytica CLIB99; identical to SEQ ID NO: 38757
  CDS (1)..(1443)

SEQ ID NO: 51990 - protein, 480 aa, Yarrowia lipolytica CLIB99; identical to SEQ ID NO: 38758

SEQ ID NO: 51991 - DNA, 1188 bp, Yarrowia lipolytica CLIB99; identical to SEQ ID NO: 38759
  CDS (1)..(1188)

SEQ ID NO: 51992 - protein, 395 aa, Yarrowia lipolytica CLIB99; identical to SEQ ID NO: 38760

SEQ ID NO: 51993 - DNA, 1659 bp, Yarrowia lipolytica CLIB99; identical to SEQ ID NO: 38761
  CDS (1)..(1659)

SEQ ID NO: 51994 - protein, 552 aa, Yarrowia lipolytica CLIB99; identical to SEQ ID NO: 38762

SEQ ID NO: 51995 - DNA, 1194 bp, Yarrowia lipolytica CLIB99; identical to SEQ ID NO: 38763
  CDS (1)..(1194)

SEQ ID NO: 51996 - protein, 397 aa, Yarrowia lipolytica CLIB99; identical to SEQ ID NO: 38764

SEQ ID NO: 51997 - DNA, 2256 bp, Pan troglodytes; identical to SEQ ID NO: 38765
  CDS (1)..(2256)

SEQ ID NO: 51998 - protein, 751 aa, Pan troglodytes; identical to SEQ ID NO: 38766

SEQ ID NO: 51999 - DNA, 2127 bp, Oryza sativa (japonica cultivar-group); identical to SEQ ID NO: 38767
  CDS (1)..(2127)

SEQ ID NO: 52000 - protein, 708 aa, Oryza sativa (japonica cultivar-group); identical to SEQ ID NO: 38768

SEQ ID NO: 52001 - DNA, 2280 bp, Oryza sativa (japonica cultivar-group); identical to SEQ ID NO: 38769
  CDS (1)..(2280)

SEQ ID NO: 52002 - protein, 759 aa, Oryza sativa (japonica cultivar-group); identical to SEQ ID NO: 38770

SEQ ID NO: 52003 - DNA, 1554 bp, Thermus thermophilus HB27; identical to SEQ ID NO: 38771
  CDS (1)..(1554)

SEQ ID NO: 52004 - protein, 517 aa, Thermus thermophilus HB27; identical to SEQ ID NO: 38772

SEQ ID NO: 52005 - DNA, 1548 bp, Parachlamydia sp. UWE25; identical to SEQ ID NO: 38773
  CDS (1)..(1548)

SEQ ID NO: 52006 - protein, 515 aa, Parachlamydia sp. UWE25; identical to SEQ ID NO: 38774

SEQ ID NO: 52007 - DNA, 1734 bp, Desulfovibrio vulgaris subsp. vulgaris str. Hildenborough; identical to SEQ ID NO: 38775
  CDS (1)..(1734)

SEQ ID NO: 52008 - protein, 577 aa, Desulfovibrio vulgaris subsp. vulgaris str. Hildenborough; identical to SEQ ID NO: 38776

SEQ ID NO: 52009 - DNA, 1599 bp, Desulfovibrio vulgaris subsp. vulgaris str. Hildenborough; identical to SEQ ID NO: 38777
  CDS (1)..(1599)

SEQ ID NO: 52010 - protein, 532 aa, Desulfovibrio vulgaris subsp. vulgaris str. Hildenborough; identical to SEQ ID NO: 38778

SEQ ID NO: 52011 - DNA, 1404 bp, Bartonella quintana str. Toulouse; identical to SEQ ID NO: 38779
  CDS (1)..(1404)

SEQ ID NO: 52012 - protein, 467 aa, Bartonella quintana str. Toulouse; identical to SEQ ID NO: 38780

SEQ ID NO: 52013 - DNA, 1521 bp, Staphylococcus aureus subsp. aureus MRSA252; identical to SEQ ID NO: 38781
  CDS (1)..(1521)

SEQ ID NO: 52014 - protein, 506 aa, Staphylococcus aureus subsp. aureus MRSA252; identical to SEQ ID NO: 38782

SEQ ID NO: 52015 - DNA, 1152 bp, Acinetobacter sp. ADP1; identical to SEQ ID NO: 38783
  CDS (1)..(1152)

SEQ ID NO: 52016 - protein, 383 aa, Acinetobacter sp. ADP1; identical to SEQ ID NO: 38784

SEQ ID NO: 52017 - DNA, 1923 bp, Acinetobacter sp. ADP1; identical to SEQ ID NO: 38785
  CDS (1)..(1923)

SEQ ID NO: 52018 - protein, 640 aa, Acinetobacter sp. ADP1; identical to SEQ ID NO: 38786

SEQ ID NO: 52019 - DNA, 1914 bp, Erwinia carotovora subsp. atroseptica SCRI1043; identical to SEQ ID NO: 38787
  CDS (1)..(1914)

SEQ ID NO: 52020 - protein, 637 aa, Erwinia carotovora subsp. atroseptica SCRI1043; identical to SEQ ID NO: 38788

SEQ ID NO: 52021 - DNA, 1383 bp, Erwinia carotovora subsp. atroseptica SCRI1043; identical to SEQ ID NO: 38789
  CDS (1)..(1383)

SEQ ID NO: 52022 - protein, 460 aa, Erwinia carotovora subsp. atroseptica SCRI1043; identical to SEQ ID NO: 38790

SEQ ID NO: 52023 - DNA, 2001 bp, Mesoplasma florum L1; identical to SEQ ID NO: 38791
  CDS (1)..(2001)

SEQ ID NO: 52024 - protein, 666 aa, Mesoplasma florum L1; identical to SEQ ID NO: 38792

SEQ ID NO: 52025 - DNA, 1686 bp, Propionibacterium acnes KPA171202; identical to SEQ ID NO: 38793
  CDS (1)..(1686)

SEQ ID NO: 52026 - protein, 561 aa, Propionibacterium acnes KPA171202; identical to SEQ ID NO: 38794

SEQ ID NO: 52027 - DNA, 1476 bp, Leifsonia xyli subsp. xyli str. CTCB07; identical to SEQ ID NO: 38795
  CDS (1)..(1476)

SEQ ID NO: 52028 - protein, 491 aa, Leifsonia xyli subsp. xyli str. CTCB07; identical to SEQ ID NO: 38796

SEQ ID NO: 52029 - DNA, 1770 bp, Leifsonia xyli subsp. xyli str. CTCB07; identical to SEQ ID NO: 38797
  CDS (1)..(1770)

SEQ ID NO: 52030 - protein, 589 aa, Leifsonia xyli subsp. xyli str. CTCB07; identical to SEQ ID NO: 38798

SEQ ID NO: 52031 - DNA, 1275 bp, Desulfotalea psychrophila LSv54; identical to SEQ ID NO: 38799
  CDS (1)..(1275)

SEQ ID NO: 52032 - protein, 424 aa, Desulfotalea psychrophila LSv54; identical to SEQ ID NO: 38800

SEQ ID NO: 52033 - DNA, 1410 bp, Desulfotalea psychrophila LSv54; identical to SEQ ID NO: 38801
  CDS (1)..(1410)

SEQ ID NO: 52034 - protein, 469 aa, Desulfotalea psychrophila LSv54; identical to SEQ ID NO: 38802

SEQ ID NO: 52035 - DNA, 1383 bp, Yersinia pseudotuberculosis IP 32953; identical to SEQ ID NO: 38803
  CDS (1)..(1383)

SEQ ID NO: 52036 - protein, 460 aa, Yersinia pseudotuberculosis IP 32953; identical to SEQ ID NO: 38804

SEQ ID NO: 52037 - DNA, 1581 bp, Symbiobacterium thermophilum IAM 14863; identical to SEQ ID NO: 38805
  CDS (1)..(1581)

SEQ ID NO: 52038 - protein, 526 aa, Symbiobacterium thermophilum IAM 14863; identical to SEQ ID NO: 38806

SEQ ID NO: 52039 - DNA, 1587 bp, Bacillus cereus ZK; identical to SEQ ID NO: 38807
  CDS (1)..(1587)

SEQ ID NO: 52040 - protein, 528 aa, Bacillus cereus ZK; identical to SEQ ID NO: 38808

SEQ ID NO: 52041 - DNA, 1842 bp, Mannheimia succiniciproducens MBEL55E; identical to SEQ ID NO: 38809
  CDS (1)..(1842)

SEQ ID NO: 52042 - protein, 613 aa, Mannheimia succiniciproducens MBEL55E; identical to SEQ ID NO: 38810

SEQ ID NO: 52043 - DNA, 1254 bp, Mannheimia succiniciproducens MBEL55E; identical to SEQ ID NO: 38811
  CDS (1)..(1254)

SEQ ID NO: 52044 - protein, 417 aa, Mannheimia succiniciproducens MBEL55E; identical to SEQ ID NO: 38812

SEQ ID NO: 52045 - DNA, 1446 bp, Bacillus licheniformis ATCC 14580; identical to SEQ ID NO: 38813
  CDS (1)..(1446)

SEQ ID NO: 52046 - protein, 481 aa, Bacillus licheniformis ATCC 14580; identical to SEQ ID NO: 38814

SEQ ID NO: 52047 - DNA, 1911 bp, Bacteroides fragilis YCH46; identical to SEQ ID NO: 38815
  CDS (1)..(1911)

SEQ ID NO: 52048 - protein, 636 aa, Bacteroides fragilis YCH46; identical to SEQ ID NO: 38816

SEQ ID NO: 52049 - DNA, 1284 bp, Bacteroides fragilis YCH46; identical to SEQ ID NO: 38817
  CDS (1)..(1284)

SEQ ID NO: 52050 - protein, 427 aa, Bacteroides fragilis YCH46; identical to SEQ ID NO: 38818

SEQ ID NO: 52051 - DNA, 1362 bp, Methylococcus capsulatus str. Bath; identical to SEQ ID NO: 38819
  CDS (1)..(1362)

SEQ ID NO: 52052 - protein, 453 aa, Methylococcus capsulatus str. Bath; identical to SEQ ID NO: 38820

SEQ ID NO: 52053 - DNA, 1809 bp, Nocardia farcinica IFM 10152; identical to SEQ ID NO: 38821
  CDS (1)..(1809)

SEQ ID NO: 52054 - protein, 602 aa, Nocardia farcinica IFM 10152; identical to SEQ ID NO: 38822

SEQ ID NO: 52055 - DNA, 1770 bp, Legionella pneumophila str. Paris; identical to SEQ ID NO: 38823
  CDS (1)..(1770)

SEQ ID NO: 52056 - protein, 589 aa, Legionella pneumophila str. Paris; identical to SEQ ID NO: 38824

SEQ ID NO: 52057 - DNA, 1407 bp, Legionella pneumophila str. Lens; identical to SEQ ID NO: 38825
  CDS (1)..(1407)

SEQ ID NO: 52058 - protein, 468 aa, Legionella pneumophila str. Lens; identical to SEQ ID NO: 38826

SEQ ID NO: 52059 - DNA, 1368 bp, Photobacterium profundum SS9; identical to SEQ ID NO: 38827
  CDS (1)..(1368)

SEQ ID NO: 52060 - protein, 455 aa, Photobacterium profundum SS9; identical to SEQ ID NO: 38828

SEQ ID NO: 52061 - DNA, 1389 bp, Photobacterium profundum SS9; identical to SEQ ID NO: 38829
  CDS (1)..(1389)

SEQ ID NO: 52062 - protein, 462 aa, Photobacterium profundum SS9; identical to SEQ ID NO: 38830

SEQ ID NO: 52063 - DNA, 1872 bp, Photobacterium profundum SS9; identical to SEQ ID NO: 38831
  CDS (1)..(1872)

SEQ ID NO: 52064 - protein, 623 aa, Photobacterium profundum SS9; identical to SEQ ID NO: 38832

SEQ ID NO: 52065 - DNA, 1587 bp, Streptococcus thermophilus LMG 18311; identical to SEQ ID NO: 38833
  CDS (1)..(1587)

SEQ ID NO: 52066 - protein, 528 aa, Streptococcus thermophilus LMG 18311; identical to SEQ ID NO: 38834

SEQ ID NO: 52067 - DNA, 1554 bp, Thermus thermophilus HB8; identical to SEQ ID NO: 38835
  CDS (1)..(1554)

SEQ ID NO: 52068 - protein, 517 aa, Thermus thermophilus HB8; identical to SEQ ID NO: 38836

SEQ ID NO: 52069 - DNA, 1404 bp, Geobacillus kaustophilus HTA426; identical to SEQ ID NO: 38837
  CDS (1)..(1404)

SEQ ID NO: 52070 - protein, 467 aa, Geobacillus kaustophilus HTA426; identical to SEQ ID NO: 38838

SEQ ID NO: 52071 - DNA, 1425 bp, Idiomarina loihiensis L2TR; identical to SEQ ID NO: 38839
  CDS (1)..(1425)

SEQ ID NO: 52072 - protein, 474 aa, Idiomarina loihiensis L2TR; identical to SEQ ID NO: 38840

SEQ ID NO: 52073 - DNA, 1251 bp, Idiomarina loihiensis L2TR; identical to SEQ ID NO: 38841
  CDS (1)..(1251)

SEQ ID NO: 52074 - protein, 416 aa, Idiomarina loihiensis L2TR; identical to SEQ ID NO: 38842

SEQ ID NO: 52075 - DNA, 1785 bp, Idiomarina loihiensis L2TR; identical to SEQ ID NO: 38843
  CDS (1)..(1785)

SEQ ID NO: 52076 - protein, 594 aa, Idiomarina loihiensis L2TR; identical to SEQ ID NO: 38844

SEQ ID NO: 52077 - DNA, 1392 bp, Azoarcus sp. EbN1; identical to SEQ ID NO: 38845
  CDS (1)..(1392)

SEQ ID NO: 52078 - protein, 463 aa, Azoarcus sp. EbN1; identical to SEQ ID NO: 38846

SEQ ID NO: 52079 - DNA, 1527 bp, Azoarcus sp. EbN1; identical to SEQ ID NO: 38847
  CDS (1)..(1527)

SEQ ID NO: 52080 - protein, 508 aa, Azoarcus sp. EbN1; identical to SEQ ID NO: 38848

SEQ ID NO: 52081 - DNA, 1977 bp, Azoarcus sp. EbN1; identical to SEQ ID NO: 38849
  CDS (1)..(1977)

SEQ ID NO: 52082 - protein, 658 aa, Azoarcus sp. EbN1; identical to SEQ ID NO: 38850

SEQ ID NO: 52083 - DNA, 1479 bp, Zymomonas mobilis subsp. mobilis ZM4; identical to SEQ ID NO: 38851
  CDS (1)..(1479)

SEQ ID NO: 52084 - protein, 492 aa, Zymomonas mobilis subsp. mobilis ZM4; identical to SEQ ID NO: 38852

SEQ ID NO: 52085 - DNA, 1416 bp, Silicibacter pomeroyi DSS-3; identical to SEQ ID NO: 38853
  CDS (1)..(1416)

SEQ ID NO: 52086 - protein, 471 aa, Silicibacter pomeroyi DSS-3; identical to SEQ ID NO: 38854

SEQ ID NO: 52087 - DNA, 1326 bp, Francisella tularensis subsp. tularensis Schu 4; identical to SEQ ID NO: 38855
  CDS (1)..(1326)

SEQ ID NO: 52088 - protein, 441 aa, Francisella tularensis subsp. tularensis Schu 4; identical to SEQ ID NO: 38856

SEQ ID NO: 52089 - DNA, 1710 bp, Francisella tularensis subsp. tularensis Schu 4; identical to SEQ ID NO: 38857
  CDS (1)..(1710)

SEQ ID NO: 52090 - protein, 569 aa, Francisella tularensis subsp. tularensis Schu 4; identical to SEQ ID NO: 38858

SEQ ID NO: 52091 - DNA, 1614 bp, Bacillus clausii KSM-K16; identical to SEQ ID NO: 38859
  CDS (1)..(1614)

SEQ ID NO: 52092 - protein, 537 aa, Bacillus clausii KSM-K16; identical to SEQ ID NO: 38860

SEQ ID NO: 52093 - DNA, 1683 bp, Dehalococcoides ethenogenes 195; identical to SEQ ID NO: 38861
  CDS (1)..(1683)

SEQ ID NO: 52094 - protein, 560 aa, Dehalococcoides ethenogenes 195; identical to SEQ ID NO: 38862

SEQ ID NO: 52095 - DNA, 1362 bp, Rhodobacter sphaeroides 2.4.1; identical to SEQ ID NO: 38863
  CDS (1)..(1362)

SEQ ID NO: 52096 - protein, 453 aa, Rhodobacter sphaeroides 2.4.1; identical to SEQ ID NO: 38864

SEQ ID NO: 52097 - DNA, 1830 bp, Xylella fastidiosa Dixon; identical to SEQ ID NO: 38865
  CDS (1)..(1830)

SEQ ID NO: 52098 - protein, 609 aa, Xylella fastidiosa Dixon; identical to SEQ ID NO: 38866

SEQ ID NO: 52099 - DNA, 1656 bp, Magnetospirillum magnetotacticum MS-1; identical to SEQ ID NO: 38867
  CDS (1)..(1656)

SEQ ID NO: 52100 - protein, 551 aa, Magnetospirillum magnetotacticum MS-1; identical to SEQ ID NO: 38868

SEQ ID NO: 52101 - DNA, 1623 bp, Leuconostoc mesenteroides subsp. mesenteroides ATCC 8293; identical to SEQ ID NO: 38869
  CDS (1)..(1623)

SEQ ID NO: 52102 - protein, 540 aa, Leuconostoc mesenteroides subsp. mesenteroides ATCC 8293; identical to SEQ ID NO: 38870

SEQ ID NO: 52103 - DNA, 1260 bp, Azotobacter vinelandii; identical to SEQ ID NO: 38871
  CDS (1)..(1260)

SEQ ID NO: 52104 - protein, 419 aa, Azotobacter vinelandii; identical to SEQ ID NO: 38872

SEQ ID NO: 52105 - DNA, 1452 bp, Azotobacter vinelandii; identical to SEQ ID NO: 38873
  CDS (1)..(1452)

SEQ ID NO: 52106 - protein, 483 aa, Azotobacter vinelandii; identical to SEQ ID NO: 38874

SEQ ID NO: 52107 - DNA, 1677 bp, Azotobacter vinelandii; identical to SEQ ID NO: 38875
  CDS (1)..(1677)

SEQ ID NO: 52108 - protein, 558 aa, Azotobacter vinelandii; identical to SEQ ID NO: 38876

SEQ ID NO: 52109 - DNA, 1470 bp, Desulfitobacterium hafniense DCB-2; identical to SEQ ID NO: 38877
  CDS (1)..(1470)

SEQ ID NO: 52110 - protein, 489 aa, Desulfitobacterium hafniense DCB-2; identical to SEQ ID NO: 38878

SEQ ID NO: 52111 - DNA, 1530 bp, Nostoc punctiforme PCC 73102; identical to SEQ ID NO: 38879
  CDS (1)..(1530)

SEQ ID NO: 52112 - protein, 509 aa, Nostoc punctiforme PCC 73102; identical to SEQ ID NO: 38880

SEQ ID NO: 52113 - DNA, 1674 bp, Pseudomonas syringae pv. syringae B728a; identical to SEQ ID NO: 38881
  CDS (1)..(1674)

SEQ ID NO: 52114 - protein, 557 aa, Pseudomonas syringae pv. syringae B728a; identical to SEQ ID NO: 38882

SEQ ID NO: 52115 - DNA, 1860 bp, Actinobacillus pleuropneumoniae serovar 1 str. 4074; identical to SEQ ID NO: 38883
  CDS (1)..(1860)

SEQ ID NO: 52116 - protein, 619 aa, Actinobacillus pleuropneumoniae serovar 1 str. 4074; identical to SEQ ID NO: 38884

SEQ ID NO: 52117 - DNA, 1671 bp, Pseudomonas aeruginosa UCBPP-PA14; identical to SEQ ID NO: 38885
  CDS (1)..(1671)

SEQ ID NO: 52118 - protein, 556 aa, Pseudomonas aeruginosa UCBPP-PA14; identical to SEQ ID NO: 38886

SEQ ID NO: 52119 - DNA, 1377 bp, Pseudomonas aeruginosa UCBPP-PA14; identical to SEQ ID NO: 38887
  CDS (1)..(1377)

SEQ ID NO: 52120 - protein, 458 aa, Pseudomonas aeruginosa UCBPP-PA14; identical to SEQ ID NO: 38888

SEQ ID NO: 52121 - DNA, 1587 bp, Fusobacterium nucleatum subsp. vincentii ATCC 49256; identical to SEQ ID NO: 38889
  CDS (1)..(1587)

SEQ ID NO: 52122 - protein, 528 aa, Fusobacterium nucleatum subsp. vincentii ATCC 49256; identical to SEQ ID NO: 38890

SEQ ID NO: 52123 - DNA, 1704 bp, Psychrobacter sp. 273-4; identical to SEQ ID NO: 38891
  CDS (1)..(1704)

SEQ ID NO: 52124 - protein, 567 aa, Psychrobacter sp. 273-4; identical to SEQ ID NO: 38892

SEQ ID NO: 52125 - DNA, 1569 bp, Methanococcoides burtonii DSM 6242; identical to SEQ ID NO: 38893
  CDS (1)..(1569)

SEQ ID NO: 52126 - protein, 522 aa, Methanococcoides burtonii DSM 6242; identical to SEQ ID NO: 38894

SEQ ID NO: 52127 - DNA, 1821 bp, Dechloromonas aromatica RCB; identical to SEQ ID NO: 38895
  CDS (1)..(1821)

SEQ ID NO: 52128 - protein, 606 aa, Dechloromonas aromatica RCB; identical to SEQ ID NO: 38896

SEQ ID NO: 52129 - DNA, 1524 bp, Dechloromonas aromatica RCB; identical to SEQ ID NO: 38897
  CDS (1)..(1524)

SEQ ID NO: 52130 - protein, 507 aa, Dechloromonas aromatica RCB; identical to SEQ ID NO: 38898

SEQ ID NO: 52131 - DNA, 1401 bp, Dechloromonas aromatica RCB; identical to SEQ ID NO: 38899
  CDS (1)..(1401)

SEQ ID NO: 52132 - protein, 466 aa, Dechloromonas aromatica RCB; identical to SEQ ID NO: 38900

SEQ ID NO: 52133 - DNA, 1233 bp, Rickettsia rickettsii; identical to SEQ ID NO: 38901
  CDS (1)..(1233)

SEQ ID NO: 52134 - protein, 410 aa, Rickettsia rickettsii; identical to SEQ ID NO: 38902

SEQ ID NO: 52135 - DNA, 1842 bp, Haemophilus influenzae R2846; identical to SEQ ID NO: 38903
  CDS (1)..(1842)

SEQ ID NO: 52136 - protein, 613 aa, Haemophilus influenzae R2846; identical to SEQ ID NO: 38904

SEQ ID NO: 52137 - DNA, 1842 bp, Haemophilus influenzae R2866; identical to SEQ ID NO: 38905
  CDS (1)..(1842)

SEQ ID NO: 52138 - protein, 613 aa, Haemophilus influenzae R2866; identical to SEQ ID NO: 38906

SEQ ID NO: 52139 - DNA, 1248 bp, Haemophilus influenzae R2866; identical to SEQ ID NO: 38907
  CDS (1)..(1248)

SEQ ID NO: 52140 - protein, 415 aa, Haemophilus influenzae R2866; identical to SEQ ID NO: 38908

SEQ ID NO: 52141 - DNA, 1281 bp, Anabaena variabilis ATCC 29413; identical to SEQ ID NO: 38909
  CDS (1)..(1281)

SEQ ID NO: 52142 - protein, 426 aa, Anabaena variabilis ATCC 29413; identical to SEQ ID NO: 38910

SEQ ID NO: 52143 - DNA, 1542 bp, Anabaena variabilis ATCC 29413; identical to SEQ ID NO: 38911
  CDS (1)..(1542)

SEQ ID NO: 52144 - protein, 513 aa, Anabaena variabilis ATCC 29413; identical to SEQ ID NO: 38912

SEQ ID NO: 52145 - DNA, 1425 bp, Ralstonia eutropha JMP134; identical to SEQ ID NO: 38913
  CDS (1)..(1425)

SEQ ID NO: 52146 - protein, 474 aa, Ralstonia eutropha JMP134; identical to SEQ ID NO: 38914

SEQ ID NO: 52147 - DNA, 1521 bp, Ralstonia eutropha JMP134; identical to SEQ ID NO: 38915
  CDS (1)..(1521)

SEQ ID NO: 52148 - protein, 506 aa, Ralstonia eutropha JMP134; identical to SEQ ID NO: 38916

SEQ ID NO: 52149 - DNA, 1356 bp, Methylobacillus flagellatus KT; identical to SEQ ID NO: 38917
  CDS (1)..(1356)

SEQ ID NO: 52150 - protein, 451 aa, Methylobacillus flagellatus KT; identical to SEQ ID NO: 38918

SEQ ID NO: 52151 - DNA, 1383 bp, Methylobacillus flagellatus KT; identical to SEQ ID NO: 38919
  CDS (1)..(1383)

SEQ ID NO: 52152 - protein, 460 aa, Methylobacillus flagellatus KT; identical to SEQ ID NO: 38920

SEQ ID NO: 52153 - DNA, 1548 bp, Methylobacillus flagellatus KT; identical to SEQ ID NO: 38921
  CDS (1)..(1548)

SEQ ID NO: 52154 - protein, 515 aa, Methylobacillus flagellatus KT; identical to SEQ ID NO: 38922

SEQ ID NO: 52155 - DNA, 1443 bp, Crocosphaera watsonii WH 8501; identical to SEQ ID NO: 38923
  CDS (1)..(1443)

SEQ ID NO: 52156 - protein, 480 aa, Crocosphaera watsonii WH 8501; identical to SEQ ID NO: 38924

SEQ ID NO: 52157 - DNA, 1233 bp, Exiguobacterium sp. 255-15; identical to SEQ ID NO: 38925
  CDS (1)..(1233)

SEQ ID NO: 52158 - protein, 410 aa, Exiguobacterium sp. 255-15; identical to SEQ ID NO: 38926

SEQ ID NO: 52159 - DNA, 1536 bp, Exiguobacterium sp. 255-15; identical to SEQ ID NO: 38927
  CDS (1)..(1536)

SEQ ID NO: 52160 - protein, 511 aa, Exiguobacterium sp. 255-15; identical to SEQ ID NO: 38928

SEQ ID NO: 52161 - DNA, 1446 bp, Exiguobacterium sp. 255-15; identical to SEQ ID NO: 38929
  CDS (1)..(1446)

SEQ ID NO: 52162 - protein, 481 aa, Exiguobacterium sp. 255-15; identical to SEQ ID NO: 38930

SEQ ID NO: 52163 - DNA, 1398 bp, Burkholderia cepacia R1808; identical to SEQ ID NO: 38931
  CDS (1)..(1398)

SEQ ID NO: 52164 - protein, 465 aa, Burkholderia cepacia R1808; identical to SEQ ID NO: 38932

SEQ ID NO: 52165 - DNA, 1413 bp, Listeria monocytogenes str. 1/2a F6854; identical to SEQ ID NO: 38933
  CDS (1)..(1413)

SEQ ID NO: 52166 - protein, 470 aa, Listeria monocytogenes str. 1/2a F6854; identical to SEQ ID NO: 38934

SEQ ID NO: 52167 - DNA, 1467 bp, Rubrivivax gelatinosus PM1; identical to SEQ ID NO: 38935
  CDS (1)..(1467)

SEQ ID NO: 52168 - protein, 488 aa, Rubrivivax gelatinosus PM1; identical to SEQ ID NO: 38936

SEQ ID NO: 52169 - DNA, 1422 bp, Rubrivivax gelatinosus PM1; identical to SEQ ID NO: 38937
  CDS (1)..(1422)

SEQ ID NO: 52170 - protein, 473 aa, Rubrivivax gelatinosus PM1; identical to SEQ ID NO: 38938

SEQ ID NO: 52171 - DNA, 1182 bp, Rhodospirillum rubrum; identical to SEQ ID NO: 38939
  CDS (1)..(1182)

SEQ ID NO: 52172 - protein, 393 aa, Rhodospirillum rubrum; identical to SEQ ID NO: 38940

SEQ ID NO: 52173 - DNA, 2034 bp, Rhodospirillum rubrum; identical to SEQ ID NO: 38941
  CDS (1)..(2034)

SEQ ID NO: 52174 - protein, 677 aa, Rhodospirillum rubrum; identical to SEQ ID NO: 38942

SEQ ID NO: 52175 - DNA, 1905 bp, Ralstonia metallidurans CH34; identical to SEQ ID NO: 38943
  CDS (1)..(1905)

SEQ ID NO: 52176 - protein, 634 aa, Ralstonia metallidurans CH34; identical to SEQ ID NO: 38944

SEQ ID NO: 52177 - DNA, 1476 bp, Burkholderia fungorum LB400; identical to SEQ ID NO: 38945
  CDS (1)..(1476)

SEQ ID NO: 52178 - protein, 491 aa, Burkholderia fungorum LB400; identical to SEQ ID NO: 38946

SEQ ID NO: 52179 - DNA, 1512 bp, Thermobifida fusca; identical to SEQ ID NO: 38947
  CDS (1)..(1512)

SEQ ID NO: 52180 - protein, 503 aa, Thermobifida fusca; identical to SEQ ID NO: 38948

SEQ ID NO: 52181 - DNA, 1713 bp, Thermobifida fusca; identical to SEQ ID NO: 38949
  CDS (1)..(1713)

SEQ ID NO: 52182 - protein, 570 aa, Thermobifida fusca; identical to SEQ ID NO: 38950

SEQ ID NO: 52183 - DNA, 1740 bp, Methanosarcina barkeri str. fusaro; identical to SEQ ID NO: 38951
  CDS (1)..(1740)

SEQ ID NO: 52184 - protein, 579 aa, Methanosarcina barkeri str. fusaro; identical to SEQ ID NO: 38952

SEQ ID NO: 52185 - DNA, 1359 bp, Geobacter metallireducens GS-15; identical to SEQ ID NO: 38953
  CDS (1)..(1359)

SEQ ID NO: 52186 - protein, 452 aa, Geobacter metallireducens GS-15; identical to SEQ ID NO: 38954

SEQ ID NO: 52187 - DNA, 1395 bp, Novosphingobium aromaticivorans DSM 12444; identical to SEQ ID NO: 38955
  CDS (1)..(1395)

SEQ ID NO: 52188 - protein, 464 aa, Novosphingobium aromaticivorans DSM 12444; identical to SEQ ID NO: 38956

SEQ ID NO: 52189 - DNA, 1497 bp, Novosphingobium aromaticivorans DSM 12444; identical to SEQ ID NO: 38957
  CDS (1)..(1497)

SEQ ID NO: 52190 - protein, 498 aa, Novosphingobium aromaticivorans DSM 12444; identical to SEQ ID NO: 38958

SEQ ID NO: 52191 - DNA, 1260 bp, Cytophaga hutchinsonii; identical to SEQ ID NO: 38959
  CDS (1)..(1260)

SEQ ID NO: 52192 - protein, 419 aa, Cytophaga hutchinsonii; identical to SEQ ID NO: 38960

SEQ ID NO: 52193 - DNA, 1743 bp, Cytophaga hutchinsonii; identical to SEQ ID NO: 38961
  CDS (1)..(1743)

SEQ ID NO: 52194 - protein, 580 aa, Cytophaga hutchinsonii; identical to SEQ ID NO: 38962

SEQ ID NO: 52195 - DNA, 1395 bp, Microbulbifer degradans 2-40; identical to SEQ ID NO: 38963
  CDS (1)..(1395)

SEQ ID NO: 52196 - protein, 464 aa, Microbulbifer degradans 2-40; identical to SEQ ID NO: 38964

SEQ ID NO: 52197 - DNA, 1179 bp, Microbulbifer degradans 2-40; identical to SEQ ID NO: 38965
  CDS (1)..(1179)

SEQ ID NO: 52198 - protein, 392 aa, Microbulbifer degradans 2-40; identical to SEQ ID NO: 38966

SEQ ID NO: 52199 - DNA, 1788 bp, Microbulbifer degradans 2-40; identical to SEQ ID NO: 38967
  CDS (1)..(1788)

SEQ ID NO: 52200 - protein, 595 aa, Microbulbifer degradans 2-40; identical to SEQ ID NO: 38968

SEQ ID NO: 52201 - DNA, 1311 bp, Microbulbifer degradans 2-40; identical to SEQ ID NO: 38969
  CDS (1)..(1311)

SEQ ID NO: 52202 - protein, 436 aa, Microbulbifer degradans 2-40; identical to SEQ ID NO: 38970

SEQ ID NO: 52203 - DNA, 1197 bp, Microbulbifer degradans 2-40; identical to SEQ ID NO: 38971
  CDS (1)..(1197)

SEQ ID NO: 52204 - protein, 398 aa, Microbulbifer degradans 2-40; identical to SEQ ID NO: 38972

SEQ ID NO: 52205 - DNA, 1566 bp, Oenococcus oeni PSU-1; identical to SEQ ID NO: 38973
  CDS (1)..(1566)

SEQ ID NO: 52206 - protein, 521 aa, Oenococcus oeni PSU-1; identical to SEQ ID NO: 38974

SEQ ID NO: 52207 - DNA, 1626 bp, Haemophilus influenzae 86-028NP; identical to SEQ ID NO: 38975
  CDS (1)..(1626)

SEQ ID NO: 52208 - protein, 541 aa, Haemophilus influenzae 86-028NP; identical to SEQ ID NO: 38976

SEQ ID NO: 52209 - DNA, 1581 bp, Pediococcus pentosaceus ATCC 25745; identical to SEQ ID NO: 38977
  CDS (1)..(1581)

SEQ ID NO: 52210 - protein, 526 aa, Pediococcus pentosaceus ATCC 25745; identical to SEQ ID NO: 38978

SEQ ID NO: 52211 - DNA, 1362 bp, Pediococcus pentosaceus ATCC 25745; identical to SEQ ID NO: 38979
  CDS (1)..(1362)

SEQ ID NO: 52212 - protein, 453 aa, Pediococcus pentosaceus ATCC 25745; identical to SEQ ID NO: 38980

SEQ ID NO: 52213 - DNA, 1365 bp, Trichodesmium erythraeum IMS101; identical to SEQ ID NO: 38981
  CDS (1)..(1365)

SEQ ID NO: 52214 - protein, 454 aa, Trichodesmium erythraeum IMS101; identical to SEQ ID NO: 38982

SEQ ID NO: 52215 - DNA, 1488 bp, Trichodesmium erythraeum IMS101; identical to SEQ ID NO: 38983
  CDS (1)..(1488)

SEQ ID NO: 52216 - protein, 495 aa, Trichodesmium erythraeum IMS101; identical to SEQ ID NO: 38984

SEQ ID NO: 52217 - DNA, 1602 bp, Thiobacillus denitrificans ATCC 25259; identical to SEQ ID NO: 38985
  CDS (1)..(1602)

SEQ ID NO: 52218 - protein, 533 aa, Thiobacillus denitrificans ATCC 25259; identical to SEQ ID NO: 38986

SEQ ID NO: 52219 - DNA, 1434 bp, Thiobacillus denitrificans ATCC 25259; identical to SEQ ID NO: 38987
  CDS (1)..(1434)

SEQ ID NO: 52220 - protein, 477 aa, Thiobacillus denitrificans ATCC 25259; identical to SEQ ID NO: 38988

SEQ ID NO: 52221 - DNA, 1383 bp, Thiobacillus denitrificans ATCC 25259; identical to SEQ ID NO: 38989
  CDS (1)..(1383)

SEQ ID NO: 52222 - protein, 460 aa, Thiobacillus denitrificans ATCC 25259; identical to SEQ ID NO: 38990

SEQ ID NO: 52223 - DNA, 1338 bp, Silicibacter sp. TM1040; identical to SEQ ID NO: 38991
  CDS (1)..(1338)

SEQ ID NO: 52224 - protein, 445 aa, Silicibacter sp. TM1040; identical to SEQ ID NO: 38992

SEQ ID NO: 52225 - DNA, 1587 bp, Desulfovibrio desulfuricans G20; identical to SEQ ID NO: 38993
  CDS (1)..(1587)

SEQ ID NO: 52226 - protein, 528 aa, Desulfovibrio desulfuricans G20; identical to SEQ ID NO: 38994

SEQ ID NO: 52227 - DNA, 1659 bp, Chloroflexus aurantiacus; identical to SEQ ID NO: 38995
  CDS (1)..(1659)

SEQ ID NO: 52228 - protein, 552 aa, Chloroflexus aurantiacus; identical to SEQ ID NO: 38996

SEQ ID NO: 52229 - DNA, 1407 bp, Polaromonas sp. JS666; identical to SEQ ID NO: 38997
  CDS (1)..(1407)

SEQ ID NO: 52230 - protein, 468 aa, Polaromonas sp. JS666; identical to SEQ ID NO: 38998

SEQ ID NO: 52231 - DNA, 1269 bp, Polaromonas sp. JS666; identical to SEQ ID NO: 38999
  CDS (1)..(1269)

SEQ ID NO: 52232 - protein, 422 aa, Polaromonas sp. JS666; identical to SEQ ID NO: 39000

SEQ ID NO: 52233 - DNA, 1533 bp, Thermus thermophilus; identical to SEQ ID NO: 39001
  CDS (1)..(1533)

SEQ ID NO: 52234 - protein, 510 aa, Thermus thermophilus; identical to SEQ ID NO: 39002

SEQ ID NO: 52235 - DNA, 1407 bp, Brachydanio rerio; identical to SEQ ID NO: 39003
  CDS (1)..(1407)

SEQ ID NO: 52236 - protein, 468 aa, Brachydanio rerio; identical to SEQ ID NO: 39004

SEQ ID NO: 52237 - DNA, 2199 bp, Corynebacterium glutamicum; identical to SEQ ID NO: 39005
  CDS (1)..(2199)

SEQ ID NO: 52238 - protein, 732 aa, Corynebacterium glutamicum; identical to SEQ ID NO: 39006

SEQ ID NO: 52239 - DNA, 1908 bp, uncultured marine proteobacterium ANT8C10; identical to SEQ ID NO: 39007
  CDS (1)..(1908)

SEQ ID NO: 52240 - protein, 635 aa, uncultured marine proteobacterium ANT8C10; identical to SEQ ID NO: 39008

SEQ ID NO: 52241 - DNA, 1974 bp, Yersinia enterocolitica; identical to SEQ ID NO: 39009
  CDS (1)..(1974)

SEQ ID NO: 52242 - protein, 657 aa, Yersinia enterocolitica; identical to SEQ ID NO: 39010

SEQ ID NO: 52243 - DNA, 2247 bp, Arabidopsis thaliana; identical to SEQ ID NO: 39011
  CDS (1)..(2247)

SEQ ID NO: 52244 - protein, 748 aa, Arabidopsis thaliana; identical to SEQ ID NO: 39012

SEQ ID NO: 52245 - DNA, 1239 bp, Arabidopsis thaliana; identical to SEQ ID NO: 39013
  CDS (1)..(1239)

SEQ ID NO: 52246 - protein, 412 aa, Arabidopsis thaliana; identical to SEQ ID NO: 39014

SEQ ID NO: 52247 - DNA, 1860 bp, Arabidopsis thaliana; identical to SEQ ID NO: 39015
  CDS (1)..(1860)

SEQ ID NO: 52248 - protein, 619 aa, Arabidopsis thaliana; identical to SEQ ID NO: 39016

SEQ ID NO: 52249 - DNA, 1569 bp, Streptococcus sobrinus; identical to SEQ ID NO: 39017
  CDS (1)..(1569)

SEQ ID NO: 52250 - protein, 522 aa, Streptococcus sobrinus; identical to SEQ ID NO: 39018

SEQ ID NO: 52251 - DNA, 1464 bp, Synechococcus sp; identical to SEQ ID NO: 39019
  CDS (1)..(1464)

SEQ ID NO: 52252 - protein, 487 aa, Synechococcus sp; identical to SEQ ID NO: 39020

SEQ ID NO: 52253 - DNA, 1869 bp, Pisum sativum; identical to SEQ ID NO: 39021
  CDS (1)..(1869)

SEQ ID NO: 52254 - protein, 622 aa, Pisum sativum; identical to SEQ ID NO: 39022

SEQ ID NO: 52255 - DNA, 1494 bp, Lactobacillus reuteri; identical to SEQ ID NO: 39023
  CDS (1)..(1494)

SEQ ID NO: 52256 - protein, 497 aa, Lactobacillus reuteri; identical to SEQ ID NO: 39024

SEQ ID NO: 52257 - DNA, 1641 bp, Saccharomyces cerevisiae; identical to SEQ ID NO: 39025
  CDS (1)..(1641)

SEQ ID NO: 52258 - protein, 546 aa, Saccharomyces cerevisiae; identical to SEQ ID NO: 39026

SEQ ID NO: 52259 - DNA, 1440 bp, Bacillus subtilis; identical to SEQ ID NO: 39027
  CDS (1)..(1440)

SEQ ID NO: 52260 - protein, 479 aa, Bacillus subtilis; identical to SEQ ID NO: 39028

SEQ ID NO: 52261 - DNA, 1446 bp, Xenopus laevis; identical to SEQ ID NO: 39029
  CDS (1)..(1446)

SEQ ID NO: 52262 - protein, 481 aa, Xenopus laevis; identical to SEQ ID NO: 39030

SEQ ID NO: 52263 - DNA, 2336 bp, Klebsiella pneumoniae; identical to SEQ ID NO: 39031
  CDS (266)..(2197)

SEQ ID NO: 52264 - protein, 643 aa, Klebsiella pneumoniae; identical to SEQ ID NO: 39032

SEQ ID NO: 52265 - DNA, 2259 bp, Saccharomyces cerevisiae; identical to SEQ ID NO: 39033
  CDS (1)..(2259)

SEQ ID NO: 52266 - protein, 752 aa, Saccharomyces cerevisiae; identical to SEQ ID NO: 39034

SEQ ID NO: 52267 - DNA, 1575 bp, Streptococcus pneumoniae; identical to SEQ ID NO: 39035
  CDS (1)..(1575)

SEQ ID NO: 52268 - protein, 524 aa, Streptococcus pneumoniae; identical to SEQ ID NO: 39036

SEQ ID NO: 52269 - DNA, 1104 bp, Methanococcus jannaschii; identical to SEQ ID NO: 39037
  CDS (1)..(1104)

SEQ ID NO: 52270 - protein, 367 aa, Methanococcus jannaschii; identical to SEQ ID NO: 39038

SEQ ID NO: 52271 - DNA, 1239 bp, Arabidopsis thaliana; identical to SEQ ID NO: 39039
  CDS (1)..(1239)

SEQ ID NO: 52272 - protein, 412 aa, Arabidopsis thaliana; identical to SEQ ID NO: 39040

SEQ ID NO: 52273 - DNA, 1242 bp, Nicotiana tabacum; identical to SEQ ID NO: 39041
  CDS (1)..(1242)

SEQ ID NO: 52274 - protein, 413 aa, Nicotiana tabacum; identical to SEQ ID NO: 39042

SEQ ID NO: 52275 - DNA, 1185 bp, Schizosaccharomyces pombe; identical to SEQ ID NO: 39043
  CDS (1)..(1185)

SEQ ID NO: 52276 - protein, 394 aa, Schizosaccharomyces pombe; identical to SEQ ID NO: 39044

SEQ ID NO: 52277 - DNA, 1242 bp, Nicotiana tabacum; identical to SEQ ID NO: 39045
  CDS (1)..(1242)

SEQ ID NO: 52278 - protein, 413 aa, Nicotiana tabacum; identical to SEQ ID NO: 39046

SEQ ID NO: 52279 - DNA, 1242 bp, Nicotiana tabacum; identical to SEQ ID NO: 39047
  CDS (1)..(1242)

SEQ ID NO: 52280 - protein, 413 aa, Nicotiana tabacum; identical to SEQ ID NO: 39048

SEQ ID NO: 52281 - DNA, 1632 bp, Xylella fastidiosa; identical to SEQ ID NO: 39049
  CDS (1)..(1632)

SEQ ID NO: 52282 - protein, 543 aa, Xylella fastidiosa; identical to SEQ ID NO: 39050

SEQ ID NO: 52283 - DNA, 1365 bp, Escherichia coli; identical to SEQ ID NO: 39051
  CDS (1)..(1365)

SEQ ID NO: 52284 - protein, 454 aa, Escherichia coli; identical to SEQ ID NO: 39052

SEQ ID NO: 52285 - DNA, 2285 bp, Drosophila melanogaster; identical to SEQ ID NO: 39053
  CDS (152)..(2137)

SEQ ID NO: 52286 - protein, 661 aa, Drosophila melanogaster; identical to SEQ ID NO: 39054

SEQ ID NO: 52287 - DNA, 25 bp, Primer
atgaccgctttttctaccctgaatg

SEQ ID NO: 52288 - DNA, 24 bp, Primer
ttattttaataaccgcacccggca

SEQ ID NO: 52289 - protein, 414 aa, consensus; identical to SEQ ID NO: 39057
  MISC_FEATURE (1)..(414): consensus for the disclosure of xaa see table XV

SEQ ID NO: 52290 - protein, 94 aa, consensus; identical to SEQ ID NO: 39058
  MISC_FEATURE (1)..(94): consensus for the disclosure of xaa see table XV

SEQ ID NO: 52291 - protein, 116 aa, consensus; identical to SEQ ID NO: 39059
  MISC_FEATURE (1)..(116): consensus for the disclosure of xaa see table XV

SEQ ID NO: 52292 - protein, 99 aa, consensus; identical to SEQ ID NO: 39060
  MISC_FEATURE (1)..(99): consensus for the disclosure of xaa see table XV

SEQ ID NO: 52293 - DNA, 846 bp, Escherichia coli
  CDS (1)..(846)
atgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataa

SEQ ID NO: 52294 - protein, 281 aa, Escherichia coli
MTPILNHYFARINWSGAAAVNIDTLRALHLKHNCTIPFENLDVLLPREIQLDNQSPEEKLVIARRGGYCFEQNGVFERVLRELGFNVRSLLGRVVLSNPPALPPRTHRLLLVELEEEKWIADVGFGGQTLTAPIRLVSDLVQTTPHGEYRLLQEGDDWVLQFNHHQHWQSMYRFDLCEQQQSDYVMGNFWSAHWPQSHFRHHLLMCRHLPDGGKLTLTNFHFTHYENGHAVEQRNLPDVASLYAVMQEQFGLGVDDAKHGFTVDELALVMAAFDTHPEAGK

SEQ ID NO: 52295 - DNA, 873 bp, Danio rerio
  CDS (1)..(873)
atggatctaagagggtacttcaacaggattgggtttactggcccatatgacaaacctgacctggatactttacgcaccatccacatgctgcatgtgatgaaaattccatttgagaacttgagcatccactgcggagagaagaacacgacagacctgaacatcatctatcataaactggtgaaaagcaatcggggaggctggtgttgtgaaaacaacctcctgttctcatgggtcctaaaggagatgggttacaaatacaccacactaggctctaaggtgttcaacaagttccaaaatgatttctatcccgttgactctcacctcatcaacatggtagagattgatgggaagttttaccttacagacgtgagctatggagtgtcatgccaactgtggtatcctttagagatgatctcgggtaaagatcagccacagcctcccggagtattccggctcctaaaagaaggggtgaggtggactctggagaaaacgtcaagaaagcaagtggtcaaagataaggcctatgctaattccagcctcattgacaagcgcctgacgaaaacaatgtacagcttcccgttgacacctcgtgctaaagagcattttgtggatacgctggattgcctgcagactagtcctgattctagatttgtgctgaagtctatttgctcccttcagttacctgaaggcttcagagctctgatcgggtggacttacagtgagatcacctacaacccagaggacgactctgacatggtggaaatgaaggaaatccccaattgtgacatagagactgtgctgagggagaagtttaatgtggtgttagttaataagctcactcctaaaaacaataaagctaattattgcatgtaa

SEQ ID NO: 52296 - protein, 290 aa, Danio rerio
MDLRGYFNRIGFTGPYDKPDLDTLRTIHMLHVMKIPFENLSIHCGEKNTTDLNIIYHKLVKSNRGGWCCENNLLFSWVLKEMGYKYTTLGSKVFNKFQNDFYPVDSHLINMVEIDGKFYLTDVSYGVSCQLWYPLEMISGKDQPQPPGVFRLLKEGVRWTLEKTSRKQVVKDKAYANSSLIDKRLTKTMYSFPLTPRAKEHFVDTLDCLQTSPDSRFVLKSICSLQLPEGFRALIGWTYSEITYNPEDDSDMVEMKEIPNCDIETVLREKFNVVLVNKLTPKNNKANYCM

SEQ ID NO: 52297 - DNA, 792 bp, Staphylococcus epidermidis RP62A
  CDS (7)..(792)
ttagtaatggatatacaaaagtttgaatcttatttaaaaattaagcattcatattattcaaacccttctcttgaagcattgaattactatgtaagacgctttatgataactgtgccatttgaaaatattaatgttcaaaacaagattcctatctcaatcgatatcaaagatttatacaataaaattgttattcaacggcgtggcggtttttgctatgaattaaatcatttgtttgctacgtatttagaacataaaggcttccacgtcactcgtgctgcggcaacagttcacacaccaaatggtgggcgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttactgtgctgtttggattaatgacaatcaatatgccttacagaagcttagacaaaataaatggatgacactctatgaagcgcatttaaaacctcaaagcattaaagactttaaagataaaataagctacaatgagcatcatcctcattctatttttgtacgacatttgcttattacacaaccacaatcgtttggacgtgcaacaatgacttatcattctttaactttaagcaatgacagtactaaacataaatatgacgttactaccaataactacaagtattttttaaaaaaatattttaatttaaatgtatcaatcatcccatttgaaccataa

SEQ ID NO: 52298 - protein, 261 aa, Staphylococcus epidermidis RP62A
MDIQKFESYLKIKHSYYSNPSLEALNYYVRRFMITVPFENINVQNKIPISIDIKDLYNKIVIQRRGGFCYELNHLFATYLEHKGFHVTRAAATVHTPNGGRSPEGSHMSLYVNIEGTLYITDVGFGDLPTSIIEIGSKTQFIPTYDKNGVYCAVWINDNQYALQKLRQNKWMTLYEAHLKPQSIKDFKDKISYNEHHPHSIFVRHLLITQPQSFGRATMTYHSLTLSNDSTKHKYDVTTNNYKYFLKKYFNLNVSIIPFEP

SEQ ID NO: 52299 - DNA, 837 bp, Mesorhizobium loti MAFF303099
  CDS (1)..(837)
atgaacgatgctcctcccttcgacctcgacgcctatctcgctcgcatcggttacaccggtccgcgcaacgcgtcgctggatacgctgaaggcgctgcatttcgcgcatccgcaggcgatccccttcgagaacatcgatccgtttcttggtcgcccggtccggctcgaccttgccgcgctgcaggacaagatcgtccttggcgggcgcggtggctactgcttcgaacataacctgctcttcatgcatgcgctgaaggcgcttggtttcgaggtcggcgggttggccgcgcgtgtgctctggggccagagcgaggacgccatcaccgcgcgcagccacatgcttttgcgcgtcgagctcgacggccggacctacatcgccgatgtcggcttcggcggcctgaccctgaccgcgccgctgctgctggaaccgggccgcgaacagaaaaccccgcacgagcctttccgcatcgtcgaggccgacgatcatttccgcctgcaggccgccatcggcggcgactggcgctcgctctaccgcttcgacctgcagccgcaatacgaagtcgattactccgtcaccaattacttcctgtcgaccagcccgacatcgcatttcctctcctccgtcatcgcggcacgcgccgcgccggaccggcgctacgcgctgcggggaaaccgcttgtcgatccatcaccttggcggccgcaccgagcagacagagatagccaccgccgccgaccttgccgacacgctgcaaggcctgctcggcatcatcattcccgaccgcacggctttcgaggccaaggtgcgtgagacgaagatcgtggagaccaacgcatga

SEQ ID NO: 52300 - protein, 278 aa, Mesorhizobium loti MAFF303099
MNDAPPFDLDAYLARIGYTGPRNASLDTLKALHFAHPQAIPFENIDPFLGRPVRLDLAALQDKIVLGGRGGYCFEHNLLFMHALKALGFEVGGLAARVLWGQSEDAITARSHMLLRVELDGRTYIADVGFGGLTLTAPLLLEPGREQKTPHEPFRIVEADDHFRLQAAIGGDWRSLYRFDLQPQYEVDYSVTNYFLSTSPTSHFLSSVIAARAAPDRRYALRGNRLSIHHLGGRTEQTEIATAADLADTLQGLLGIIIPDRTAFEAKVRETKIVETNA

SEQ ID NO: 52301 - DNA, 813 bp, Mesorhizobium loti MAFF303099
  CDS (1)..(813)
atggcattcaatattgcgatctatctgaatcgtatcggccttgctcgagtgccgacaacggtcgacggtcttgttgcccttcagcaggctcaaatgcgcgcgattccctttgaaaacatcgatgtgctgttgggtgatatacccaatctgactgagaattcgatctgggccaaactgatcaatgcccggcgaggggggtattgcttcgaattgaacaagttgtttggcttggcgctcgaagcactcggtttcacgatccagcccatcctttgcagagtgcgtatgggtgctgcggagggtgggccacgcacacaccaggcattcatcttaaccatcgagggcgtcgactggctcgccgacgctggcttcggtggtccagcaccgattgcaccgctacggatcgatacagaggaactgcaaacagctggccgtgacgtgtttcgcctgcgagctgactccgccagcggagaactcgtcgttgaacgcaagaacgggaatgaatggttccctctttatggtttcgatcgagccaccgccttgccctcagattttgagggcgccaacttcatctgcgctcgctgggaccgttcgccgtttccatccagcctcatgatgagcgtgctgacagccgaagggcctgcgaacttgttcaacaaggatttcagcttgattcggaaccaaattgaggaaacagaaaccctcaaaacgaagagcgaactgcagcgagtcttgtccgatgtttttcggctgcaccttcctcggtccacgattgattcgttgtgggaaaagcttgggtcgcgtggacgggtatag

SEQ ID NO: 52302 - protein, 270 aa, Mesorhizobium loti MAFF303099
MAFNIAIYLNRIGLARVPTTVDGLVALQQAQMRAIPFENIDVLLGDIPNLTENSIWAKLINARRGGYCFELNKLFGLALEALGFTIQPILCRVRMGAAEGGPRTHQAFILTIEGVDWLADAGFGGPAPIAPLRIDTEELQTAGRDVFRLRADSASGELVVERKNGNEWFPLYGFDRATALPSDFEGANFICARWDRSPFPSSLMMSVLTAEGPANLFNKDFSLIRNQIEETETLKTKSELQRVLSDVFRLHLPRSTIDSLWEKLGSRGRV

SEQ ID NO: 52303 - DNA, 801 bp, Staphylococcus aureus subsp. aureus Mu50
  CDS (1)..(801)
atgcttatgaatattgcgaagttagagaattatttacaaattgattcatctcgttataatcgaccgagtattgaagcattaaattattatgcaacacgttttatgttaactgtaccttttgaaaatattgatgttcaaaatagtaagccgatatctataaatatcgatgcactttttaataaaattgttcatgataaacgtggtggtttttgttatgagttaaatacatttttcaaagcatatttacaacaaaaaggatttaatcctgaattaatgtcagctactattcacacacccggtggcggtcgtagtctgaacggttcacatgcttcacttgttgtttctataaatgatgtattctatgtaactgatgttggctttggagacttacctctacatgccattcctattacttcatctgagcatacacaaccaattactgatatcagtggtacattccgcgctatttttaacaacgaagacaaggatattttctatgttcaaaaattcgaaaatgatcattggcatacaaaatatgaagctgaattcaaacctaaacaaatagaagattttaatagcaacatcgaatataatcaaacgcatccagattcaatatttgtacagcatttattaattacaatgccacaatcatttggccgtgctacaatgtctgaaaatcatttaactttaacaaggaatggtagctcagaaaaatttgatgtcactaaagataactataaacattttttagaaaaatattttggactaaatgtaactattaatcgtattgaaaaacaataa

SEQ ID NO: 52304 - protein, 266 aa, Staphylococcus aureus subsp. aureus Mu50
MLMNIAKLENYLQIDSSRYNRPSIEALNYYATRFMLTVPFENIDVQNSKPISINIDALFNKIVHDKRGGFCYELNTFFKAYLQQKGFNPELMSATIHTPGGGRSLNGSHASLVVSINDVFYVTDVGFGDLPLHAIPITSSEHTQPITDISGTFRAIFNNEDKDIFYVQKFENDHWHTKYEAEFKPKQIEDFNSNIEYNQTHPDSIFVQHLLITMPQSFGRATMSENHLTLTRNGSSEKFDVTKDNYKHFLEKYFGLNVTINRIEKQ

SEQ ID NO: 52305 - DNA, 828 bp, Caulobacter crescentus CB15
  CDS (1)..(828)
gtggagctggacgcctatttccggcgtatcggctatgacggcccgcgcgagccgaccctggatacgctgcgggccatcgccttccgccacccggacgccatcccgttcgagaacctcgacgtcctcttggggcgcgggatcagcattgtccccagcgatgtcgacgccaagctgatcggcgccgggcggggcggctattgctacgagcagaacgggcttttgaagcgcgtgctacaggcgctgggcttccaagtcgaggggctgatggcccgcgtgctgtggatggcgccggaaggtgcgccgccgcgtccgcgctcgcaccaggtgctgggtgtcacaatcgacggcgagacctggctggccgacgccggctttggcggctgcgtgctgaccgcgccgctgcgcctgttctcggacgaggtccaggacagtccgcacggcaagttccgcatcgtcgacacgcagacgaacggcgtcgccgaacgccaggtccaggccgatttgtcgggccgctgggcgccgctctatcaggtgtcgcaaggcgcctgggccgaggtcgactacgagcaggccaatttctacacctacacccaccccagctcgcacttcacctggagcatgacggtggggcgcacgacgccgaccgcgcgctacgccctgaagaacaaccgcttcacccatcgcgacgtcacgggcgctgtggtcgagcagcgtgaccttaccgttgatgagctggaggcgacgttgcgccaggtgatcggcctgccggtggaggccgactggcggccggtgctggaacaggtcgtagcgtggggaacccccgcttga

SEQ ID NO: 52306 - protein, 275 aa, Caulobacter crescentus CB15
MELDAYFRRIGYDGPREPTLDTLRAIAFRHPDAIPFENLDVLLGRGISIVPSDVDAKLIGAGRGGYCYEQNGLLKRVLQALGFQVEGLMARVLWMAPEGAPPRPRSHQVLGVTIDGETWLADAGFGGCVLTAPLRLFSDEVQDSPHGKFRIVDTQTNGVAERQVQADLSGRWAPLYQVSQGAWAEVDYEQANFYTYTHPSSHFTWSMTVGRTTPTARYALKNNRFTHRDVTGAVVEQRDLTVDELEATLRQVIGLPVEADWRPVLEQVVAWGTPA

SEQ ID NO: 52307 - DNA, 801 bp, Staphylococcus aureus subsp. aureus MW2
  CDS (1)..(801)
atgcttatgaatattgcgaagttagagaattatttacaaattgattcatctcgttataatcgaccgagtattgaagcattaaattattatgcaacacgttttatgttaactgtaccttttgaaaatattgatgttcaaaatagtaagcctatatctataaatatcgatgcactttttaataaaattgttcatgataaacgtggtggtttttgttatgagttaaatacatttttcaaagcctatttacaacaaaaaggatttaatcctgcattaatgtcagctactattcacacacccggtggcggtcgtagtctgaacggttcacatgcttcacttgttgtttctataaatgatgtattctatgtaactgatgttggctttggagacttacctatacatgccattcctattacttcatctgagcatacacaaccaattactgatatcagtggtacattccgcgctatttttaacaacgaagacaaggatattttctatgttcaaaaattcgaaaatgatcattggcatacaaaatatgaagctgaattcaaacctaaacaaatagaagattttaatagcaacatcgaatataatcaaaccaacccagattcaatatttgtacagcatttattaattacaatgccacaatcatttggccgtgctacaatgtctgaaaatcatttaactttaacaaggaatggtagctcagaaaagttagctgtcactaaaaataactataaacattttttagaaaaatattttggactagatataactattaatcgtattgaaaaacaataa

SEQ ID NO: 52308 - protein, 266 aa, Staphylococcus aureus subsp. aureus MW2
MLMNIAKLENYLQIDSSRYNRPSIEALNYYATRFMLTVPFENIDVQNSKPISINIDALFNKIVHDKRGGFCYELNTFFKAYLQQKGFNPALMSATIHTPGGGRSLNGSHASLVVSINDVFYVTDVGFGDLPIHAIPITSSEHTQPITDISGTFRAIFNNEDKDIFYVQKFENDHWHTKYEAEFKPKQIEDFNSNIEYNQTNPDSIFVQHLLITMPQSFGRATMSENHLTLTRNGSSEKLAVTKNNYKHFLEKYFGLDITINRIEKQ

SEQ ID NO: 52309 - DNA, 840 bp, Bacillus anthracis str. A2012
  CDS (1)..(840)
atgatgaccaatttacaaaaggagttttttaaacgactaaaaattcctgcaaaagaaataacatttaatgatttagatgaaattctcttaaacatgggaatgattctcccctatgaaaatcttgatattatggctggcactattaaaaacatctcaaaaaataacttagtagaaaagttacttattcaaaaacgaggcggtctttgttatgaattaaactccttactatattactttttaatggattgtggatttcaagtatataaagtagccggtactgtttatgacctttacgataataaatggaaacctgatgatggtcatgtcattatcatattacatcataataaaaaagattatgttatagatgccggttttgcctctcacctacctttacatccagtcccttttagcggagaagtcatatcttctcaaacgggtgaatatcgaattcgcaaacgaactactcaaaaaggtacacacattttagaaatgagaaaaggagctaacggggaatctacaaattttttacaatctgaaccttcagatgaatggaaaataggctatgccttcactttagatccaatagatgagcaaaaggtgaataacattcaaaaagtcattgtagaacataaagaatctccttttaataaaggagctatcacttgtaaattaactaattatggtcacatatcattaacaaataaaaattatacagaaacctttaaaggcaccaaaaataaacgtccaatagaatcaaaagattatgctcgcattcttcgtgaatcttttggaataacacaagtgaaatatgtaggaaaaacactagaaagaggttag

SEQ ID NO: 52310 - protein, 279 aa, Bacillus anthracis str. A2012
MMTNLQKEFFKRLKIPAKEITFNDLDEILLNMGMILPYENLDIMAGTIKNISKNNLVEKLLIQKRGGLCYELNSLLYYFLMDCGFQVYKVAGTVYDLYDNKWKPDDGHVIIILHHNKKDYVIDAGFASHLPLHPVPFSGEVISSQTGEYRIRKRTTQKGTHILEMRKGANGESTNFLQSEPSDEWKIGYAFTLDPIDEQKVNNIQKVIVEHKESPFNKGAITCKLTNYGHISLTNKNYTETFKGTKNKRPIESKDYARILRESFGITQVKYVGKTLERG

SEQ ID NO: 52311 - DNA, 768 bp, Bacillus anthracis str. A2012
  CDS (1)..(768): r means g or a
atgacaagtctacaacataagctgtttacaagattgaatcgtgcaaaccgtaccgaagtaaagtttgaagaattaaatacaattctctttacatttgcacacactataccatttgagaatttagatgttatagcaagtaacacgaatacaattactatggaaaatttacagaataaaattttaagtagatcccgcggcggactttgttatgaattaaatacgcttttttattactttttaaaagattgtggttatgatgtacaactcgcattaggtaccgtatataaaaatgatataaacgcatgggcacttgagaatggacatataacgattattttaaattatgataaagtacgatacgtaattgatgtaggtattgcttcactagtacctctagtccctgtaccttttactggtgagtctgtttcttctaaaaatggtacgtatcgagtaagacaaaaagatacgagtaaagggaattacgttctagaaagaaaagatacgaacggtgagtggaaagtatgtcatgctttttataatcgtatgattgatgaaatagtagtgaatgatgttcaaaaaagagtagtagaagatgagaaatctattttcaataagggcccaattgcagtcaaattgacggactctggccatgtctctttaaccaatactagtttcactgaaatagttcatggtgaaaaaacgaaacgtgraattacagaagatcaatatagagagcttttatatactttatttgctattgagttatga

SEQ ID NO: 52312 - protein, 255 aa, Bacillus anthracis str. A2012
  misc_feature (237)..(237): Xaa can be Gly or Glu
MTSLQHKLFTRLNRANRTEVKFEELNTILFTFAHTIPFENLDVIASNTNTITMENLQNKILSRSRGGLCYELNTLFYYFLKDCGYDVQLALGTVYKNDINAWALENGHITIILNYDKVRYVIDVGIASLVPLVPVPFTGESVSSKNGTYRVRQKDTSKGNYVLERKDTNGEWKVCHAFYNRMIDEIVVNDVQKRVVEDEKSIFNKGPIAVKLTDSGHVSLTNTSFTEIVHGEKTKRXITEDQYRELLYTLFAIEL

SEQ ID NO: 52313 - DNA, 846 bp, Escherichia coli CFT073
  CDS (1)..(846)
atgacgcccattctgaatcattattttgcccgtattaactggttgggagctgctgcggccaatattgatacgctgcgtgcattgcacctgaaacacaattgcaccattccgtttgaaaatctcgacgttttgctgccgagggaaatacagcttgatgatcaatcgctggaagataaactggtgatagcccgtcgtggcggttactgttttgagcagaatggcgtgtttgagcgggtgttacgcgagctggggtttaacgttcgcagcttgttaggtcgcgtagtgttatcaaatccgccagcattaccgccgcgcacccatcgtttgctgttggtggaactggaaggggaaaaatggattgctgatgtcggtttcggtgggcagacgctaaccgcgccgattcgtttaatgccggatatcatgcaaaccacgccacacggagagtatcggttgttgcaagagggtgatgattgggtattgcagtttaatcatcatcagcactggcagtcgatgtaccgttttgatctctgcgagcagcaacaaagcgattatgtgatgggcaatttctggtcggcgcactggccgcagtcgcattttcgccatcatttgctgatgtgtcgccatttgccggacggtggcaagctaacgctgaccaattttcattttacccattatgaaaatgggcacgcagttgagcagcgaaatctaccagatgtggcgtcgttatatgccgtgatgcaggaacagtttggtctgggcgtagatgatgcgaaacatggctttactgtggatgagttagcgctggtgatggcggcgtttgatacgcacccggaggcgggaaaataa

SEQ ID NO: 52314 - protein, 281 aa, Escherichia coli CFT073
MTPILNHYFARINWLGAAAANIDTLRALHLKHNCTIPFENLDVLLPREIQLDDQSLEDKLVIARRGGYCFEQNGVFERVLRELGFNVRSLLGRVVLSNPPALPPRTHRLLLVELEGEKWIADVGFGGQTLTAPIRLMPDIMQTTPHGEYRLLQEGDDWVLQFNHHQHWQSMYRFDLCEQQQSDYVMGNFWSAHWPQSHFRHHLLMCRHLPDGGKLTLTNFHFTHYENGHAVEQRNLPDVASLYAVMQEQFGLGVDDAKHGFTVDELALVMAAFDTHPEAGK

SEQ ID NO: 52315 - DNA, 786 bp, Staphylococcus epidermidis ATCC 12228
  CDS (1)..(786)
atggatatacaaaaatttgaatcttatctaaaaattaaacattcatactattcgactccttctcttgaagcattaaattactatgtaagacgctttatgataactgtgccatttgaaaatattaatgttcaaaacaagattcctatctcaatcgatatcaaagatttatacaataaaattgttattcaacgtcgtggcggtttttgctatgaattaaatcatttgtttgctacgtatttagaacataaaggcttccatgtcactcgtgctgcggcaacagttcacacaccaaatggtggacgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttaccgtgctgtttggattaatgacaatcaatatgccttacagaagcttagacaaaataaatggatgacactctatgaagcgcatttaaaatctcaaagcattaaagactttgaagataaaataagctacaatgagcatcatcctcattctatttttgtacgacatttgcttattacacaaccacaatcatttggacgtgcaacaatgacttatcattctttaactttaagcaatgatagtactaaacataaatatgacgttactaccaataactacaaatattttttaaaaaaatattttaatttaaacgtatcaattatcccatttgaaccataa

SEQ ID NO: 52316 - protein, 261 aa, Staphylococcus epidermidis ATCC 12228
MDIQKFESYLKIKHSYYSTPSLEALNYYVRRFMITVPFENINVQNKIPISIDIKDLYNKIVIQRRGGFCYELNHLFATYLEHKGFHVTRAAATVHTPNGGRSPEGSHMSLYVNIEGTLYITDVGFGDLPTSIIEIGSKTQFIPTYDKNGVYRAVWINDNQYALQKLRQNKWMTLYEAHLKSQSIKDFEDKISYNEHHPHSIFVRHLLITQPQSFGRATMTYHSLTLSNDSTKHKYDVTTNNYKYFLKKYFNLNVSIIPFEP

SEQ ID NO: 52317 - DNA, 807 bp, Vibrio parahaemolyticus RIMD 2210633
  CDS (1)..(807)
atgaataagacggatctgaacgcctatttaaccaagctcggtttgccgagtgagttacccgccgatttggagtcattgcacaagattcacgtagcgcagcaccgttgcctgccgtttgagaactttgatatttcgttgcagcgtggcatctctgttgagattgaagacatcattcaaaaaaccgtgtatcactcccgtggtggctactgctttgaactgaatggcttaatgctcgatgtgctcaagaccctcgggtttgaagcgcgcagcttacttgggcgtgttcacgtgatggggacgccgacaggtcgcagccatcaaatcacgttggtgacgctggatgaacaagcatggattgtcgatgtaggctttggctccaatacgccgcgcgcgccattgccgtttatcctcaaccaagtgattcagacggatttacaaaccttccgctttgtcgaagatgcccagtttggttacttccttcaagtgttgtcaacggacggaacggacacatggaacaacctttatagcttcgatttagagtttgtgtttgcaggtgacatcgcgtgtggcaacttttttacctccacttctcccaactcgcgttttaccagcgcaagagtcgcggcgaaagcaacagaaagtgggttggtgacattgcttaactacacactcaaatacaccagccaaggtgagcagacagaattagagttagagccgggccaagcctatctggatgcattgaaagaatacttcggcattgagcttgatgcgcagtacggcgagcttcgtccgttgcctgacgcgtaa

SEQ ID NO: 52318 - protein, 268 aa, Vibrio parahaemolyticus RIMD 2210633
MNKTDLNAYLTKLGLPSELPADLESLHKIHVAQHRCLPFENFDISLQRGISVEIEDIIQKTVYHSRGGYCFELNGLMLDVLKTLGFEARSLLGRVHVMGTPTGRSHQITLVTLDEQAWIVDVGFGSNTPRAPLPFILNQVIQTDLQTFRFVEDAQFGYFLQVLSTDGTDTWNNLYSFDLEFVFAGDIACGNFFTSTSPNSRFTSARVAAKATESGLVTLLNYTLKYTSQGEQTELELEPGQAYLDALKEYFGIELDAQYGELRPLPDA

SEQ ID NO: 52319 - DNA, 846 bp, Salmonella enterica subsp. enterica serovar Typhi Ty2
  CDS (1)..(846)
atgacctcttttttacatgcttattttacgcgattaaattgtcagccgttggggggtcctacggttgaagcgctcagaacgcttcacttagcgcacaactgcgcgattccttttgaaaatctggatgtgctactgcctcgtgaaatacagcttgatgagacggcactagaggagaaactgctttatgcccgacgcggtggatactgttttgaactgaatggcctgtttgaacgcgcgttacgcgacatcggttttaacgtccgaagcttattggggcgggtcattctgtctcatcccgccagtttaccgccgcgcacgcaccgtttgctgctggttgatgttgaggatgagcagtggatcgcggacgtggggtttggcggccaaacgctaaccgcaccgcttcgtctgcaggctgaaattgcccagcaaacgccgcatggcgaataccgcctgatacaggaggggagcacatggattttacaattccgccaccatgagcactggcagtcgatgtactgttttgatctgggggtgcagcagcagagcgatcatgtaatgggcaatttctggtcggctcactggccgcaatcccattttcgtcatcatttgttgatgtgccgccatttgcctgatggcggcaagctgacattaacgaatttccacttcacgcgttaccaccagggacatgccgttgaacaggtcaatataccggatgtaccgtcgttgtatcagttacttcagcagcagtttggtctcggcgtaaatgatgtaaagcacggttttaccgaggcggagctggccgcggtaatggctgcatttgatacccatccggaggcgggaaaataa

SEQ ID NO: 52320 - protein, 281 aa, Salmonella enterica subsp. enterica serovar Typhi Ty2
MTSFLHAYFTRLNCQPLGGPTVEALRTLHLAHNCAIPFENLDVLLPREIQLDETALEEKLLYARRGGYCFELNGLFERALRDIGFNVRSLLGRVILSHPASLPPRTHRLLLVDVEDEQWIADVGFGGQTLTAPLRLQAEIAQQTPHGEYRLIQEGSTWILQFRHHEHWQSMYCFDLGVQQQSDHVMGNFWSAHWPQSHFRHHLLMCRHLPDGGKLTLTNFHFTRYHQGHAVEQVNIPDVPSLYQLLQQQFGLGVNDVKHGFTEAELAAVMAAFDTHPEAGK

SEQ ID NO: 52321 - DNA, 840 bp, Streptomyces avermitilis MA-4680
  CDS (1)..(840)
atgaattccgcccaggctgacgcctacctccgtcgtatcggcgtgacacaccccgcgtggcccaccgtcgatgtgctgcgcgagcttcaactgcaccatctgcgcaccgtgccgttcgagaacctgtcgatccatctcggcgaggagatcgtgctcgacgagaagcggctgctggacaaggtcgtgggcgcgcgacggggcggcttctgttacgaactgaacggggcgttcggggcgttgctggagtcgctcggcttcgacgtgacgctgctcgcggcacgggtgtacggggaggagggtcggctcggagtgccgtacgaccatctcgcgctgcgggtgcggacggtcgacggcggcgactggctggccgatgtgggcttcggggcgcacagtcactatccgctggccttcggggagcgtggtgagcaggtggatccgggcggcacgttccgggtgatcgaagcgggggtggacgcggcgggagcgcggagcagcggtgggtcggcggcatccggggacctcgatgtgctgagggacggcaagccccagtaccgcctggagacgcgaccgagggtgctcggggacttcgtggccgggctgtggtggcacagcacgtcgccgaagtcgcatttcacacagtcgctggtgtgctcgcgggtcacggaggacggagggcggatcacgctcagcggtcgcaggttcacggtgacggcggccgacggccggaaggaggtgtcggatctgggcacggacgaggaggtgctgggggtctatcgggagcggttcgggatcgagctcgatcaggtgccgaccgtgcaaaagaggggcgaaatcgggtaa

SEQ ID NO: 52322 - protein, 279 aa, Streptomyces avermitilis MA-4680
MNSAQADAYLRRIGVTHPAWPTVDVLRELQLHHLRTVPFENLSIHLGEEIVLDEKRLLDKVVGARRGGFCYELNGAFGALLESLGFDVTLLAARVYGEEGRLGVPYDHLALRVRTVDGGDWLADVGFGAHSHYPLAFGERGEQVDPGGTFRVIEAGVDAAGARSSGGSAASGDLDVLRDGKPQYRLETRPRVLGDFVAGLWWHSTSPKSHFTQSLVCSRVTEDGGRITLSGRRFTVTAADGRKEVSDLGTDEEVLGVYRERFGIELDQVPTVQKRGEIG

SEQ ID NO: 52323 - DNA, 840 bp, Bacillus cereus ATCC 14579
  CDS (1)..(840)
atgatgaccaatttacaaaaggagttttttaaacgcttaaaaattcctgcaaaagaaataacatttgatgatttagatgaaattctcttaaaaatgggaatgattctcccctatgaaaatcttgatattatggctggtactattaaaaatatctcaaaagataacttaatagaaaagttacttattcaaaaacgaggtggactttgttatgaattaaactccttattgtattattttttaattgattgtgggtttcaagtatacaaagtagccggtactgtttatgatctgtacgataataaatggaaacccgatgatggtcatgtcattatcatattaagtcatgaggataaagattatgttgtggatgcaggttttgcatctcatctccctttacatccagtcccttttaacggagaagtcatctcctctcaaacaggagaatatcgaattcgtaagcgaaatactcgaaaaggtacgcatattttagaaatgagaaaaggggctaacggggaatctacaagtttcttacaatctgaaccttcaaacgaatggaaaataggctatgctttcactgtagatccaatagatgagaaaaaagtgaataacattcaaaaagtgattgtagagcataaagaatctccttttaataaaggggctatcacttgtaaattaactacttatggtcacatatcattaacaaataaaaattatacagaaacctttaaaggcactaaaaataaacgaccaatagaatctaaagattatgctcgcattcttcgtgaatcttttggaataacgcaagagaaatatgtaggaaaaacactagaaagaggttag

SEQ ID NO: 52324 - protein, 279 aa, Bacillus cereus ATCC 14579
MMTNLQKEFFKRLKIPAKEITFDDLDEILLKMGMILPYENLDIMAGTIKNISKDNLIEKLLIQKRGGLCYELNSLLYYFLIDCGFQVYKVAGTVYDLYDNKWKPDDGHVIIILSHEDKDYVVDAGFASHLPLHPVPFNGEVISSQTGEYRIRKRNTRKGTHILEMRKGANGESTSFLQSEPSNEWKIGYAFTVDPIDEKKVNNIQKVIVEHKESPFNKGAITCKLTTYGHISLTNKNYTETFKGTKNKRPIESKDYARILRESFGITQEKYVGKTLERG

SEQ ID NO: 52325 - DNA, 831 bp, Mycobacterium avium subsp. paratuberculosis str. k10
  CDS (1)..(831)
atgacgctggatctgggcgcgtatttcgaccgcatcggttacggcggcaaggccgcgcccaacctcgaggtgctgcgggccctgatggccgcgcacaccggctcgatcccgttcgagaacctcgacccgctgatgggggtgccggtcgacgacctgagcccggcggcgctgaccgacaagctggtccaccggcgccgcggcggctactgctacgagcagaacggcctgctgggctacgcgctggccgaaatcggtttccgggtgcgccgattggccggccgggtggtgtggatgcagccgcccgacacgccgccgcgcgcccagacgcacacggtcttggcggtgacgttcccgggctcgcagggcgcctacctggtcgacgtcggcttcggtggccagacgttgccctcgcccatccgtttcgagaccggcaacgcccagcagaccacccacgagccgtaccggctcgatgaccgcggcgagggcctggtgctgcaggccctggtgcgcgatgaatggccgccgctgtacgtgttcggcacccgcaccgtgccgcagatcgacctgctggtgggcagctggtacgtctccacccacccgtcgtcgatgttcgtcaccgggctgatggtcgcgcggaccaccgccgacgcccggtggaacctggccgggcgcgagctgaccgtgcaccgcgcgcagagcagcgagaagatccgcctcgacgacgcggacgcggtgctcgacgtgctcggggagcggttcggcatcgacgtggccgggatcggccagcgcggcgcgctgctggcgcgcatcgagcaggtgctggacgcctga

SEQ ID NO: 52326 - protein, 276 aa, Mycobacterium avium subsp. paratuberculosis str. k10
MTLDLGAYFDRIGYGGKAAPNLEVLRALMAAHTGSIPFENLDPLMGVPVDDLSPAALTDKLVHRRRGGYCYEQNGLLGYALAEIGFRVRRLAGRVVWMQPPDTPPRAQTHTVLAVTFPGSQGAYLVDVGFGGQTLPSPIRFETGNAQQTTHEPYRLDDRGEGLVLQALVRDEWPPLYVFGTRTVPQIDLLVGSWYVSTHPSSMFVTGLMVARTTADARWNLAGRELTVHRAQSSEKIRLDDADAVLDVLGERFGIDVAGIGQRGALLARIEQVLDA

SEQ ID NO: 52327 - DNA, 792 bp, Bacillus cereus ATCC 10987
  CDS (1)..(792): s means g or c
atgacagactttcaaaaacaatttttcgcacgattacatatagaaaaaaaagacaaagtttcatttgaagatttacctaacattatgtacgcgatggcacaaactgtcccttttgaaaacttaaatatactcgaaaacaactttacagaaatatcaaaagaaaatctaaaagaaaaaattttagtaaacaaccgcggcggtctttgttatgaactcaatcctactatgtattacttccttaaagacgctggatttgatgttcatctcgtttcaggaacagtgtataacgctgcaaattctatatgggscgttgattctggccatatcgcaaccgttttaacacatcataatgaactttacttaattgaagtaggattcggatcatacttacctcttgcacctgttcctttctcaggtgaagtcattcactccgttacaggagattatcgtattcgtaaaaaaatgaccgaaaaaggaaactacatgttagagatgcgtaaaaacaatgagtttttggatcaatcttctactgatgattggacgttaggctatgcattttatatagaagaagtggatgaagaaaaagcaaatgcagcacaaaaaattatcgttgaacatgaggactcaccatttaacaaagtacctctcattgtaaaactaactgaagatgggcatgcatctttaacgaaggatagtctcacaatagcgaaaaatggtaaaaaaatgaaagaaaaaattacagatgtgcaatataaaaatcttttacatgcaaaattcggaattacattataa

SEQ ID NO: 52328 - protein, 263 aa, Bacillus cereus ATCC 10987
  misc_feature (103)..(103): Xaa can be Gly or Ala
MTDFQKQFFARLHIEKKDKVSFEDLPNIMYAMAQTVPFENLNILENNFTEISKENLKEKILVNNRGGLCYELNPTMYYFLKDAGFDVHLVSGTVYNAANSIWXVDSGHIATVLTHHNELYLIEVGFGSYLPLAPVPFSGEVIHSVTGDYRIRKKMTEKGNYMLEMRKNNEFLDQSSTDDWTLGYAFYIEEVDEEKANAAQKIIVEHEDSPFNKVPLIVKLTEDGHASLTKDSLTIAKNGKKMKEKITDVQYKNLLHAKFGITL

SEQ ID NO: 52329 - DNA, 933 bp, Neurospora crassa
  CDS (1)..(933)
atgacaccatatacccaagatcagctggatcgctatttccggcatatcggctattcgccgaaggatgccgaagacgacctcggcaggcttgccatgttgcagctacgccacatggcccgcgttccatttgagagtctgacattgcattactcccaacaccaccgattgtcactggacctggaggacctttttgaaaagattgtggacaaggggaggggaggctactgcatggaggtcaatacgttcttcggagccgtcttgcgcagtctgggttacacactcattaacgtaggaggaagagtgaaggcaggcgatggagagtacaaaggatggaatcacatggtcaacatcgtgaccatcaacaacacacgttatctggttgatgtaggatttggctcccatggctcggttaatccagtgcctctggagcacaacaacgtcttcactacagtctcaccagcacgaggtgtactcgaatacaaaagcctctcccaacacaccgaccctaccaaccaaaggatatgggtatactcaacccaggaaaacccgtctgcgccctggaaggaaatgtactgttttgccgccgacacagagttcttcccggccgattttgaggtcatgaacctatcaactatgaccagccctcaaagcttctttgtgcagaccgtcatgtgcatgtggcttctgctcaacgacaacaataacaacgacgacgacaacaaacagaaacagcctataggcctcctgatcttgcacaaggattatgtcaagaggaggataggcgataagtccgagatcatcgagcaatttgagtcggaagagcagagagtgaaggccctgcacaagtatttcggcatcgtgcttacaagaaaagagaaggaggcaattcgcggcttgccaagcgagttgaagacgaggtgcgggcattgttga

SEQ ID NO: 52330 - protein, 310 aa, Neurospora crassa
MTPYTQDQLDRYFRHIGYSPKDAEDDLGRLAMLQLRHMARVPFESLTLHYSQHHRLSLDLEDLFEKIVDKGRGGYCMEVNTFFGAVLRSLGYTLINVGGRVKAGDGEYKGWNHMVNIVTINNTRYLVDVGFGSHGSVNPVPLEHNNVFTTVSPARGVLEYKSLSQHTDPTNQRIWVYSTQENPSAPWKEMYCFAADTEFFPADFEVMNLSTMTSPQSFFVQTVMCMWLLLNDNNNNDDDNKQKQPIGLLILHKDYVKRRIGDKSEIIEQFESEEQRVKALHKYFGIVLTRKEKEAIRGLPSELKTRCGHC

SEQ ID NO: 52331 - DNA, 1113 bp, Magnaporthe grisea 70-15
  CDS (1)..(1113)
atgatcatccctaaaacgtcagtctgtttccgaggcctgtcgccccaattattatcggctcgcttcatcagcacagctcaagctcagcaatgcaagcggccaagatacgccaacttggaaataactgaatatttcaatcgaattcacctttctcctacacagcgaatcttctccgtcagcaaccttacatctgttcaacagctagcctaccttacccttctcaagaagcaccatcttgtcagcgtgccttatgagaatcttcaggctcattactcctggcacaaagggctcggtgtttcgccgacgcgtctctatgagaagattgtccgccaccgccgcggtggttggtgctttgaaacgaaccaattgcttaatacggtcctcctgtcgctgggattcgacgttattttggcaggttcgcgagtctttgagccctgcaacggcagattcggcggacttgtgcattgtgtcaatattgtcaagatcggtggcgtacactatttgctcgatgtgggctttggtggatacggtccaccccagcctgtaccattgctcgagggaacgggaggcattgaaccgaacggtctacagcacataggacctcaagcggagatgcgagtagtgaaacaggcgattgcacagcaggtcgatcaaactaggcggctatgggtatatcagttccgacgtggccctggtgaggagtggcagccaatgtgctgtttcaactcggactttgagttcctgcccgaggatatcgagatcctaaacacgcatggcatgagccgcacatgtttcgcatcacgtgaattgttgcttcagcgattcacaacatcaaatgagcccctaactgcacctgggagaacgaatatgaaggatgtcatggatggcgagctggacggctctattgtgctatatcagaataggttgaaatggcggagggaaggggatttgaaactgagccttgagttccgcaccgaagcggaacgtgttgaggctattcggttatattttggaattgtccttgacaaagaggagtcggagggaattaagggcactgcaagtgagactaggggttcttggtttggaacagcttttgacgatgagacgatttaa

SEQ ID NO: 52332 - protein, 370 aa, Magnaporthe grisea 70-15
MIIPKTSVCFRGLSPQLLSARFISTAQAQQCKRPRYANLEITEYFNRIHLSPTQRIFSVSNLTSVQQLAYLTLLKKHHLVSVPYENLQAHYSWHKGLGVSPTRLYEKIVRHRRGGWCFETNQLLNTVLLSLGFDVILAGSRVFEPCNGRFGGLVHCVNIVKIGGVHYLLDVGFGGYGPPQPVPLLEGTGGIEPNGLQHIGPQAEMRVVKQAIAQQVDQTRRLWVYQFRRGPGEEWQPMCCFNSDFEFLPEDIEILNTHGMSRTCFASRELLLQRFTTSNEPLTAPGRTNMKDVMDGELDGSIVLYQNRLKWRREGDLKLSLEFRTEAERVEAIRLYFGIVLDKEESEGIKGTASETRGSWFGTAFDDETI

SEQ ID NO: 52333 - DNA, 963 bp, Magnaporthe grisea 70-15
  CDS (1)..(963)
atggcttcgtacagcaaaggccagatcgaacagtacctggaccacatcggcttccggaatgcagacgcagggactctgccgccgccaaccctggccacgctcaccgaggtccaggcccgccacctcgcgcgcgtcccctttgagaacatttcgctgcggtacagcgccaagacgccgccgctgtcgctcgacgagcaggacctgttcgacaagattgtggttggcgggcgcggcggctactgcatggaggtcaacgccttcctgtcggccgtgatgcgcgggctgggtttcgacgtgctcaacgtcggcgggcggatcaaaaagtcggacgactcggggaggttttcgggattgagtcacatgctcaacatcgtcaccatcgacggccaacgataccaagtcgacgtcggcttcggcaaaggcggcccgccgatgcccatcccactccctcgcaaggacgacggcggccggcacgactttgtgcgcatcccgccgtcgtcaatgggccgcgtcgagtggcgcagcataccgcggcagcacctgcacgcggaccagcgcgtgtgggtgtactcgacgcgcgaggacggggaggaggagggctggaaggagcggtacagcttcgtggacgccgagttcttccccgaggactacgaggtgctcaacttccacaccatgacgcacccggacagcttctttctcaacaacgtcatggcggtgcggacggtgcccgagggtgaggtcgacggcgaggtcgtgctgccgtgccgcggcggctgtgcggcgaggggcacgtgggtgctgttcaacgacgagatcaagaggacggtcgctggcagggaggaggtcgtggagaggctgcagagcgaggaggagcgcatcagggggctggagaggtatttcggcatcaaagtctcgccggagcaggctgctgttatcaaagatcctctaggcggcggcagctga

SEQ ID NO: 52334 - protein, 320 aa, Magnaporthe grisea 70-15
MASYSKGQIEQYLDHIGFRNADAGTLPPPTLATLTEVQARHLARVPFENISLRYSAKTPPLSLDEQDLFDKIVVGGRGGYCMEVNAFLSAVMRGLGFDVLNVGGRIKKSDDSGRFSGLSHMLNIVTIDGQRYQVDVGFGKGGPPMPIPLPRKDDGGRHDFVRIPPSSMGRVEWRSIPRQHLHADQRVWVYSTREDGEEEGWKERYSFVDAEFFPEDYEVLNFHTMTHPDSFFLNNVMAVRTVPEGEVDGEVVLPCRGGCAARGTWVLFNDEIKRTVAGREEVVERLQSEEERIRGLERYFGIKVSPEQAAVIKDPLGGGS

SEQ ID NO: 52335 - DNA, 1032 bp, Gibberella zeae PH-1
  CDS (1)..(1032)
atgtcgtgtcttcccgacccaacagtactcacccaacttcaggtggaaaaccctccacgatacacccaagcacagcttcaagagtatctcaaagtcatcaagcttcctcagagattcctcgattcgccagtactgaaggattcgacccttgctcacaccaaggaacacggtcttcccctcattaaagccatcacccgttaccacacatgcaatatcccatttgagaaccttgaactccactactcagcacacaagaccatcacccttgacccatatgagcttttcgaaaagatagttacgcgtcgccgtggcggtcgatgtatggagaacaacacctttctcggtactgttcttcgctcatttggttacgaggttcgcgattgcggaggtcgagtggcgcgcgccatgagtccttatcccgatgttagaaagaaccaagcctacacttatgatggctggaaccacatgctcaacctcgctcactttgaggatgagtggtatatcgtcgatgtgggaatgggttcaatgggtcccaaccttcctttccctctacgccacgggttcgaaaccacgagtattgctcctcgaaagatccgtcttcagcgccgagctatcgctgagtctcacgcaagcaaccccaccaaaggaactaagctgtggtgctacgacgtctgcctcaagcctactgaggacggaactgatgtgtggacacctacttatgcctttactgagacggagtttctgccccaagattacgaggtcatgtcgtggtttacctctaccaacccgcgatctttctttactagatatgtcacctgtaccaagatgatccaagatgaggagaaggaagagattattggtaaccttaccttgttcaaagatacgatcagagagacaatcggcaatcagcgaaaggttattcgggagtgcaagactgaagaggagagaattcaggcgttggttgaagtatttgatgtgaatttgacggaggaggagaagaacggaattccagaggagagaagactagcttga

SEQ ID NO: 52336 - protein, 343 aa, Gibberella zeae PH-1
MSCLPDPTVLTQLQVENPPRYTQAQLQEYLKVIKLPQRFLDSPVLKDSTLAHTKEHGLPLIKAITRYHTCNIPFENLELHYSAHKTITLDPYELFEKIVTRRRGGRCMENNTFLGTVLRSFGYEVRDCGGRVARAMSPYPDVRKNQAYTYDGWNHMLNLAHFEDEWYIVDVGMGSMGPNLPFPLRHGFETTSIAPRKIRLQRRAIAESHASNPTKGTKLWCYDVCLKPTEDGTDVWTPTYAFTETEFLPQDYEVMSWFTSTNPRSFFTRYVTCTKMIQDEEKEEIIGNLTLFKDTIRETIGNQRKVIRECKTEEERIQALVEVFDVNLTEEEKNGIPEERRLA

SEQ ID NO: 52337 - DNA, 960 bp, Gibberella zeae PH-1
  CDS (1)..(960)
atgatggaaagaatcaagtacagtgagtctcagcttgagacttactacagccgcatcaacttccaagattcggatccaaaatacacaatcgacaatctttcaactgaagctcaaatcgatttcctcttcgaactgacgaagcgacaactcctcgctgttccttttgagaatctcacgctacactactcatggcatcgtacagttgatgtcaacgcagaccatctctttaccaagatcgtcaccgaaaaacgaggaggctactgcatggaaaacaacagtttcttccacacggttctcgtatcactgggttttgaggtgtacatggttgctgcaagagtctttagtcctgatgcgaagaggtacggcggtataacgcactgtctcaatgtcgtcacgatcggagacaagtcgtatgctgtcgatgttggatttggaggccgtacgccaactatccctatggaaatcctagatggggaggttttccggaggacagactcgggccagatgaggctccgacacgacacgattccagagtacctgaccaagcaaaaagtgtggatttacgagttccgctcaaatgaaagtggcgaatggattccccaatggtgtttcatagaccacgaagtcctccccgatgatatccgcgtcatgaacatggccccttcaaaaagcccctccagtttctttactttcaaagtcatcgccgtgcagttcgtttctgaaaaggaagactgctcggatatggagacgagagatttgaagaatgtcgacggtgttatcgacggcagtgtgtttattgatgggaatgttatgaagtataggaaggcgggcgttgtcaagatggaaaagacttttgagaccgaggatgagcggttggaggcgttgaagaagtattttgacattgagttgactgacgaaaataagagggctatcagaggaacggctggtgctataccgtag

SEQ ID NO: 52338 - protein, 319 aa, Gibberella zeae PH-1
MMERIKYSESQLETYYSRINFQDSDPKYTIDNLSTEAQIDFLFELTKRQLLAVPFENLTLHYSWHRTVDVNADHLFTKIVTEKRGGYCMENNSFFHTVLVSLGFEVYMVAARVFSPDAKRYGGITHCLNVVTIGDKSYAVDVGFGGRTPTIPMEILDGEVFRRTDSGQMRLRHDTIPEYLTKQKVWIYEFRSNESGEWIPQWCFIDHEVLPDDIRVMNMAPSKSPSSFFTFKVIAVQFVSEKEDCSDMETRDLKNVDGVIDGSVFIDGNVMKYRKAGVVKMEKTFETEDERLEALKKYFDIELTDENKRAIRGTAGAIP

SEQ ID NO: 52339 - DNA, 957 bp, Gibberella zeae PH-1
  CDS (1)..(957)
atgtcggctatatactcagaagcccaggtcgccaagtttctcaagcatattcaagtaccacaggagttctatgtgggcaacgagcctatccttgaccatgcctttctcactgtgctgcatcagcacatgattgcaaaggtaccctatgagaatatgacgctgcattactcgtcacatcgcaatgttattctcgaaccccaggctctgtatcagaaaattgtggtcgatgggcgtggaagaggaggttattgcatggagagcaatttgttcttctgttatatgcttcgagctcttggtttccaggtgtatcccgttggtgtgcgagtccgtcttcgcaaggatggtgttccccatggcggctatcccgggtgggttcacattgtcaacatcgtgacactacctgacaactcccgctgggtcatcgatgcatcttttggcggtgatggccctacccggcccatgcctctgatcgagggcgctgagtggcgcaacatgggtactcaggatgcccgtctcattaaggactttatccccggtcaaacagagctcacatctggtcgccgtctctggatctaccaatgccgcaactctcccgatcagaactggaacagcttctactcttttagtcactctgtcgaatggcttcccgctgattttgagattgccaactgctacacgggcacaagtcatcgaagcttccagacacataccgtgctggttgtgaaattcatgttgagggagagcaagacatcgacgacaggcgaagagatttatggaaagcgtatgttgattaatgacgtggtcaaggagaaccctggtggtaagacgatagtgctgaaggagttgaagaccgaggatgagagagtggaggcactgaaggagtattttgggattgatttgacgacggaagaaagagaggctatcaagggcttccaaactgagattaagagcgagtaa

SEQ ID NO: 52340 - protein, 318 aa, Gibberella zeae PH-1
MSAIYSEAQVAKFLKHIQVPQEFYVGNEPILDHAFLTVLHQHMIAKVPYENMTLHYSSHRNVILEPQALYQKIVVDGRGRGGYCMESNLFFCYMLRALGFQVYPVGVRVRLRKDGVPHGGYPGWVHIVNIVTLPDNSRWVIDASFGGDGPTRPMPLIEGAEWRNMGTQDARLIKDFIPGQTELTSGRRLWIYQCRNSPDQNWNSFYSFSHSVEWLPADFEIANCYTGTSHRSFQTHTVLVVKFMLRESKTSTTGEEIYGKRMLINDVVKENPGGKTIVLKELKTEDERVEALKEYFGIDLTTEEREAIKGFQTEIKSE

SEQ ID NO: 52341 - DNA, 1119 bp, Ustilago maydis 521
  CDS (1)..(1119)
atggtggttgttcgtccgaaactggtggaatcgtggctgagcgacgctcgattacgcgctgtgttgcatacgatctcattccccggatttcaagataaagagacatctacgcgcgctgcactgccatgtgcaacgctcgacactctaagcaagctgcatatccactttatgctcacgttcccgttcgaagcactgtcgatgaactacgagccgcacggagtcatgtcgtcacagctcgacgatatctacgagcggttgatcgagaagcgccacggtggagggtactgcctgcagatcaatctgctgtaccgcgaggtgctggccaagctcgcgtttcgcttcgtcggtgtgctaggccgcgtcttctcgcccatctcgaacagctggactggactgacgcatacggcgacgttggtgtacctgccgtcgcacatcgcgtcggatcgtggcagcatggtgtactatctgtcggatgtcggatttggaagcagtccgcatcggcccatgttgctgcgcaacgagtggcaagagtttggtcgtggtggcgacaagtttcgcatggtgcacagacatgtgcatccgcaatcgacgttcgagccagctggcgacgaacaagtagaccagcacgtcgcgcagatcgcgcgtgaccagagcgtgtggatcctccagcaccacaggcacggcacgcccgactggctcgactgctactcgttctcgaccgccgaatgcttctatccagactaccacgcgtccaacaaggccacctctcatccggaatcgcaacctttcgcgaccatgatcctcgtagtgcgctatctgctgcatgcaccacttgtcgagctttccgaagagctcctcgagcgcgacaaactgcccaagcagctgtatccctaccatccgagcgttgtagaacagcgcatgatcgtaggtgacaagcacattatcaaggtcggcgaccaacaggtgttgtccgagaagatcgccgacgaaggacacagggtcgatctgctgaaacacaactttgcactgctcacacatgtcgaaaaagacgacgcgctcagagagatccgtggcaagccgtcgagcttgaacgctttgagcacgcgcagcacacgctga

SEQ ID NO: 52342 - protein, 372 aa, Ustilago maydis 521
MVVVRPKLVESWLSDARLRAVLHTISFPGFQDKETSTRAALPCATLDTLSKLHIHFMLTFPFEALSMNYEPHGVMSSQLDDIYERLIEKRHGGGYCLQINLLYREVLAKLAFRFVGVLGRVFSPISNSWTGLTHTATLVYLPSHIASDRGSMVYYLSDVGFGSSPHRPMLLRNEWQEFGRGGDKFRMVHRHVHPQSTFEPAGDEQVDQHVAQIARDQSVWILQHHRHGTPDWLDCYSFSTAECFYPDYHASNKATSHPESQPFATMILVVRYLLHAPLVELSEELLERDKLPKQLYPYHPSVVEQRMIVGDKHIIKVGDQQVLSEKIADEGHRVDLLKHNFALLTHVEKDDALREIRGKPSSLNALSTRSTR

SEQ ID NO: 52343 - DNA, 1623 bp, Aspergillus nidulans FGSC A4
  CDS (1)..(1623)
atggcgtcaacattcactcgatcccagctagaagcatacctgcagcgcatcggttatgcaaactctgcttctgggccagaatgcccccgactgcatcaactccaggcatcaatcgaacaagacgctctgaaagcgttagaagaactgcaacgccgacatatttcatctattccttggggaaattcggccattcactactctcagcatcatagcatctccacgtacccgtcggcggtgttcgagaagctggtcgttcgccgcctcgatgggtattgcatggaaaacaccaacctactgtatgttgttcttcggtcactcggctatcaggcgtaccccgcagcaggaagggtatcgaacgcagcagcggacccagagaatgccggctctgaagttcgatatggttctttaggacatatggtgattatcgttggtatcagtaatcaaaagtatatggtcgacgtggggtttgggaacaatggaccaacatctccattgccgctcttaaggaacgtatcaggggatctcatcccaccagcacagatgaaattagacaaaacgcctctccccgaagcagtcgaccagagccaggaattctgggtctatagcgtcaggtacgggccggacaaagactgggcgcctatgtacgcatttgccgagaccgagttcctaccgcaagattttgccatgatgaatttcaacaccagcaaaggatccagcagctggtttacgcagagggttgtctgcgttagacacattttgggcgacgatgagagctccatcaaaggcctacatttataccatttccagccagctgcagcctctcgaggtcttctcagatctccccaacaagcacttccccgcttccccgcaccgtcacagcgcgccatgtcgactaccatccaagagaaattagatatcctgcagaactactctgcgtgtgatgtctccgacgttctcctcaagattcagaagccagcggatggatctcccccacgagctggatatctcgctgatctgaccccattctccccaatactcgggcgcaacacgacaacccccaagatcatcgcccccgcttcgacaatccaattcattcccaagtcctcctcgcccgcttccctcttttctgactccgcctccaccccaaatccagaccagactttccctcaaggaacccactgggttgacaacaccgagcccaacacgatcgtgctaatttcccaaccccccgggcaacactgcgccgttgttggcggtatcatggccgtgcggatgaaaagtctcggcattaagggcgttgtggttgacggccgaattcgggatctcaacgagatccagggcgcgagcttacccgtctgggccaaggggacatcgacagttggaacaggggcggaggcaaagccggggttgaggaatgtgaggattgatgtcgggggtgtgactgtggatccgggggatattgtcttttgtgatcctttggaaggtgttgttgtcattccaaaggatctgttggatcaggttttggaggttatgccgaggattgtggaggcagatgataaagtcaaagaggcggttgagggcgggatgagtgtttttgaggctttcaagaagtttagaggttaa

SEQ ID NO: 52344 - protein, 540 aa, Aspergillus nidulans FGSC A4
MASTFTRSQLEAYLQRIGYANSASGPECPRLHQLQASIEQDALKALEELQRRHISSIPWGNSAIHYSQHHSISTYPSAVFEKLVVRRLDGYCMENTNLLYVVLRSLGYQAYPAAGRVSNAAADPENAGSEVRYGSLGHMVIIVGISNQKYMVDVGFGNNGPTSPLPLLRNVSGDLIPPAQMKLDKTPLPEAVDQSQEFWVYSVRYGPDKDWAPMYAFAETEFLPQDFAMMNFNTSKGSSSWFTQRVVCVRHILGDDESSIKGLHLYHFQPAAASRGLLRSPQQALPRFPAPSQRAMSTTIQEKLDILQNYSACDVSDVLLKIQKPADGSPPRAGYLADLTPFSPILGRNTTTPKIIAPASTIQFIPKSSSPASLFSDSASTPNPDQTFPQGTHWVDNTEPNTIVLISQPPGQHCAVVGGIMAVRMKSLGIKGVVVDGRIRDLNEIQGASLPVWAKGTSTVGTGAEAKPGLRNVRIDVGGVTVDPGDIVFCDPLEGVVVIPKDLLDQVLEVMPRIVEADDKVKEAVEGGMSVFEAFKKFRG

SEQ ID NO: 52345 - DNA, 873 bp, Gallus gallus
  CDS (1)..(873)
atggacatcaaggagtattttgccagaatttcttatggaggcgcctatgaaaaaccagacctggaaaccttgacggaaatattccagcaccacatccaagcagttccttttgagaatctcagcattcactgtggggaaaccattgagctggacctagcagccacttacgacaagatagtgaggaagaaacgtggggggtggtgcatggagaacaaccacctcttatcttgggccctgaaaaccctagggtacaacgtcacccttttgggagcaaaagtatacatcccggagcacgatgcatatgctgatgacattgatcatctgttgctaaaagtggtgcttcatgacaaatcctacattgtggatggtggttttgggatggcctaccagctatggcagccgatggagctgatttcagggaaagatcagcctcagacgcctggcatcttccgcttcgtagaagagaatgggacctggtaccttgagaaggtgaaaaggaagcagtatgttcccaaccacagcgactctgctcctcataacgtagacaaagaagtttgccgtcgagtttatctcttcaccctccagccacgagacatagaagagttcagagccagaaatctgcacctgcagactgcaccagactcactttttgttactaagtccatttgcagcctgcagacccccgatggggtccgggcacttgttggatggaagcttactgagataaagtacaattataaggataacatggatctggtggagatcagaatccttgcagatgaagaaatggagaaaacattgaaggagaaattcaatataacattagataagaaatttgtacccatcaatacaagcaggctgtctctgttttaa

SEQ ID NO: 52346 - protein, 290 aa, Gallus gallus
MDIKEYFARISYGGAYEKPDLETLTEIFQHHIQAVPFENLSIHCGETIELDLAATYDKIVRKKRGGWCMENNHLLSWALKTLGYNVTLLGAKVYIPEHDAYADDIDHLLLKVVLHDKSYIVDGGFGMAYQLWQPMELISGKDQPQTPGIFRFVEENGTWYLEKVKRKQYVPNHSDSAPHNVDKEVCRRVYLFTLQPRDIEEFRARNLHLQTAPDSLFVTKSICSLQTPDGVRALVGWKLTEIKYNYKDNMDLVEIRILADEEMEKTLKEKFNITLDKKFVPINTSRLSLF

SEQ ID NO: 52347 - DNA, 873 bp, Pan troglodytes
  CDS (1)..(873)
atggacattgaagcatatcttgaaagaattggctataaaaagtctaggaacaaattggacttggaaacattaactgacattcttcaacaccagatccgagctgttccctttgagaaccttaacatccattgtggggaagccatggatttaggcttagaggccatttttgatcaagttgtgagaagaaatcggggtggatggtgtctccaggtcaatcatcttctgtactgggctctgaccactattggttttgagaccacaatgttgggaggttatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtatcttccgtttgacggaagagaatggattctggtatctagaccaaatcagaagggaacagtacattccaaatgaagaatttcttaattctgatctcctggaagacagcaaataccgaaaaatctactcctttactcttcagcctcgaacaattgaagattttgagtctatgaatacatacctgcagacatctccagcatctgtgtttactagtaaatcattttgttccttgcagaccccagatggggttcactgtttggtgggcttcaccctcacccataggagattcaattataaggacaatacagatctaatagagtttaagactctgagtgaggaagaaatagaaaaagtgctgaaaaatatatttaatatatccttggagagaaagcttgtgcccaaacatggtgatagattttttactatttag

SEQ ID NO: 52348 - protein, 290 aa, Pan troglodytes
MDIEAYLERIGYKKSRNKLDLETLTDILQHQIRAVPFENLNIHCGEAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCIFRLTEENGFWYLDQIRREQYIPNEEFLNSDLLEDSKYRKIYSFTLQPRTIEDFESMNTYLQTSPASVFTSKSFCSLQTPDGVHCLVGFTLTHRRFNYKDNTDLIEFKTLSEEEIEKVLKNIFNISLERKLVPKHGDRFFTI

SEQ ID NO: 52349 - DNA, 840 bp, Bacillus thuringiensis serovar konkukian str. 97-27
  CDS (1)..(840)
atgatgaccaatttacaaaaggagttttttaaacgactaaaaattcctgcaaaagaaataacatttaatgatttagatgaaattctcttaaacatgggaatgattctcccctatgaaaatcttgatattatggctggcactattaaaaacatctcaaaaaatagcttagtagaaaagttacttattcaaaaacgaggcggtctttgttatgaattaaactccttattatattactttttaatggattgtggatttcaagtatataaagtagccggtactgtttatgacctttacgataataaatggaaacctgatgatggtcatgtcattatcatattacatcataataaaaaagattatgttatagatgccggttttgcctctcacctacctttacatccagtcccttttagcggagaagtcatatcttctcaaacgggtgaatatcgaattcgcaaacgaactactcaaaaaggtacacacattttagaaatgagaaaaggagctaacggggaatctacagatttcttgcaatctgaaccttcagatgaatggaaaataggctatgccttcactttagatccaatagatgagaaaaaggttaataacattcagaaaatcattgtagaacataaagaatctccttttaataaaggagctatcacttgtaaattaactaattatggtcacatatcattaacaaataaaaattatacagaaacctttaaaggcaccaaaaataaacgtccaatagaatcaaaagattatgctcgcattcttcgtgaatcttttggaataacgcaagtgaaatatgtaggaaaaacactagaaagaggttag

SEQ ID NO: 52350 - protein, 279 aa, Bacillus thuringiensis serovar konkukian str. 97-27
MMTNLQKEFFKRLKIPAKEITFNDLDEILLNMGMILPYENLDIMAGTIKNISKNSLVEKLLIQKRGGLCYELNSLLYYFLMDCGFQVYKVAGTVYDLYDNKWKPDDGHVIIILHHNKKDYVIDAGFASHLPLHPVPFSGEVISSQTGEYRIRKRTTQKGTHILEMRKGANGESTDFLQSEPSDEWKIGYAFTLDPIDEKKVNNIQKIIVEHKESPFNKGAITCKLTNYGHISLTNKNYTETFKGTKNKRPIESKDYARILRESFGITQVKYVGKTLERG

SEQ ID NO: 52351 - DNA, 792 bp, Bacillus thuringiensis serovar konkukian str. 97-27
  CDS (1)..(792)
atgaccgactttcaaaaacaattttttgcaagattaaatatagcagaaaaacaaaaagtttcatttgaagatttatctaatattatgtacgcaatggcacaaactgtcccatttgaaaacttaaatgttctcgaaaagaattttaaggaaatatcaaaagaaaatctaaaagaaaaaattttagtaaacaatcgtggtggtctttgttatgaactcaatcctactatgtattatttccttaaagatgctggatttgatgtttatctcgtttcaggaacagtgtataacgctgcaaattccatatgggccgttgattccggacatatcgcaaccattttaaaacatcataatgagctttatttaattgaagttggattcggatcatacttaccgcttgcacctgttcctttctcaggtgaagtcgttcaatccgttacaggagattatcgtattcgtaaagaaatgaccgaaaaaggaaactacatgttagagatgcgtaaaaacgatgagtttttggatcaatcttctactgatgactggacgttaggctatgcattttatatagaagaagtggatgaaaaaaaagcaaatgcagcacaaaaaattattgttgaacacgatggctcaccatttaacaaagtacctcttattgtaaaactaactgaaggtgggcatgcctctttaacgaaggatagtctgacaatagtgaaaaacggtaaaaaaatgaaagaaaaagttacagatgtgcaatataaaaatcttttacattcaaaattcggaattacattataa

SEQ ID NO: 52352 - protein, 263 aa, Bacillus thuringiensis serovar konkukian str. 97-27
MTDFQKQFFARLNIAEKQKVSFEDLSNIMYAMAQTVPFENLNVLEKNFKEISKENLKEKILVNNRGGLCYELNPTMYYFLKDAGFDVYLVSGTVYNAANSIWAVDSGHIATILKHHNELYLIEVGFGSYLPLAPVPFSGEVVQSVTGDYRIRKEMTEKGNYMLEMRKNDEFLDQSSTDDWTLGYAFYIEEVDEKKANAAQKIIVEHDGSPFNKVPLIVKLTEGGHASLTKDSLTIVKNGKKMKEKVTDVQYKNLLHSKFGITL

SEQ ID NO: 52353 - DNA, 801 bp, Staphylococcus aureus subsp. aureus MRSA252
  CDS (1)..(801)
atgaatattgcaaagttagaagattatctacaaattgaaccaactcgttataatcaaccgagtattgaagcattaaattattatgcgactcgctttatgttaacggtgcctttcgaaaatattgatgttcaaaatggtaaaccaatatctgtagatatcgatgcacttttcaataaaattgttcatgataaacgcggtggtttttgttatgagttaaacacatttttcaaagcatatttacaacaaaaaggatttaacccagaattaatgtcggctaccattcatacacccggtggcggtcgtagtcaaaacggttcacatgcatcacttgttgtttctattaataatgtcttttatgtaaccgatgtcggctttggagacttacctctaaatgccataccgattactttaccagatgatacacagcagatcactgatatcagtgggacattccgcgctattttcaacagtgaggataaggacattttctatgttcaaaaatatgaaaataatcattggcatacaaaatacgaagctgaattcaaggctagagaaatagaagaattcgatcaaaacattgaatataatcaaacacatcctgattcagtatttgtaaaacatttattaattacaatgccacaatcatttggacgtgctacaatgtttgaaaaccatttaactttaacaaaagatggaacgccagaaaagttagctatcacaaaagataactataaacaatttttaacaaaatattttggattaaatgtaacaattagtcgacttgaaaacagcgacaattaa

SEQ ID NO: 52354 - protein, 266 aa, Staphylococcus aureus subsp. aureus MRSA252
MNIAKLEDYLQIEPTRYNQPSIEALNYYATRFMLTVPFENIDVQNGKPISVDIDALFNKIVHDKRGGFCYELNTFFKAYLQQKGFNPELMSATIHTPGGGRSQNGSHASLVVSINNVFYVTDVGFGDLPLNAIPITLPDDTQQITDISGTFRAIFNSEDKDIFYVQKYENNHWHTKYEAEFKAREIEEFDQNIEYNQTHPDSVFVKHLLITMPQSFGRATMFENHLTLTKDGTPEKLAITKDNYKQFLTKYFGLNVTISRLENSDN

SEQ ID NO: 52355 - DNA, 840 bp, Bacillus cereus ZK
  CDS (1)..(840)
atgatgaccaatttacaaaaggagttttttaaacgactaaaaattcctgcaaaagaaataacatttaatgatttagatgaaattctcttaaacatgggaatgattctcccctatgaaaatcttgatattatggctggcactattaaaaacatctcaaaaaataacttagtagaaaagttacttattcaaaaacgaggcggtctttgttatgaattaaactccttattatattactttttaatggattgtggatttcaagtatataaagtagccggtactgtttatgacctttacgataataaatggaaacctgatgatggtcatgtcattatcatattacatcataataaaaaagattatgttatagatgccggttttgcctctcatctacctttacatccagtcccttttaacggagaagtcatatcttctcaaacgggggaatatcgaattcgcaaacgaactactcgaaaaggtacacacattttagaaatgagaaaaggagctaacggggaatctactaatttcttgcaatctgaaccttcagatgaatggaaaataggctatgccttcactttagatccaatagatgagaaaaaggttaataacattcagaaaatcattgtagaacataaagaatctccttttaataaaggagctatcacttgtaaattaactaattatggtcacatatcattaacaaataaaaattatacagaaacctttaaaggcaccaaaaataaacgtccaatagaatcaaaagattatgctcgcattcttcgtgaatcttttggaataacacaagtgaaatatgtaggaaaaacactagaaagaggttag

SEQ ID NO: 52356 - protein, 279 aa, Bacillus cereus ZK
MMTNLQKEFFKRLKIPAKEITFNDLDEILLNMGMILPYENLDIMAGTIKNISKNNLVEKLLIQKRGGLCYELNSLLYYFLMDCGFQVYKVAGTVYDLYDNKWKPDDGHVIIILHHNKKDYVIDAGFASHLPLHPVPFNGEVISSQTGEYRIRKRTTRKGTHILEMRKGANGESTNFLQSEPSDEWKIGYAFTLDPIDEKKVNNIQKIIVEHKESPFNKGAITCKLTNYGHISLTNKNYTETFKGTKNKRPIESKDYARILRESFGITQVKYVGKTLERG

SEQ ID NO: 52357 - DNA, 759 bp, Bacillus licheniformis ATCC 14580
  CDS (1)..(759)
atgacgacgatgctcgattcgctgtttaagaggattggatacaagccaggtcagcaggtgacatttgccgacttgcccgagtttttatcgctgctggctttgcagtttccatttgaaaatggcgcggttttaagaaacgaacggatttcgatgacgaaaacagagctgacggaagccttgctgaacaataaaaggggcggtttatgctatgatttgaacgcttttctttactatgtgctgacagagctcggcttttccgttcacatggtccgcggaacggtatttaatgcaaaagagcaggcgtgggcgctgacgggaacgcatgtcgccgtaattctgcgggaaggtgatgaaacctatctgctggacactggattcggcatcaacctgccgcttgcacccgttccgttctcaggtgaacctgtcccctcaaaaacaggagcttaccgtatcagggaaacaaagacggataaaggggattaccttcttgaaatggataagggagatgggtggcagatcggctatgcattttcgctgacgccaatcgatgaagctgtgcttacatgcgtgcgggatgcaattttcgatgagaaggcgtcgccttttaataaaaacccgctcgcttccaagctgataaaggacggaaagttaattttgacgaaggatcacttcacaaagcagacagggggcggtttgacgaaagaggatgtgaatgcaggagatttccaaaccattttcgttcattcattttttgactga

SEQ ID NO: 52358 - protein, 252 aa, Bacillus licheniformis ATCC 14580
MTTMLDSLFKRIGYKPGQQVTFADLPEFLSLLALQFPFENGAVLRNERISMTKTELTEALLNNKRGGLCYDLNAFLYYVLTELGFSVHMVRGTVFNAKEQAWALTGTHVAVILREGDETYLLDTGFGINLPLAPVPFSGEPVPSKTGAYRIRETKTDKGDYLLEMDKGDGWQIGYAFSLTPIDEAVLTCVRDAIFDEKASPFNKNPLASKLIKDGKLILTKDHFTKQTGGGLTKEDVNAGDFQTIFVHSFFD

SEQ ID NO: 52359 - DNA, 873 bp, Burkholderia pseudomallei K96243
  CDS (1)..(873)
atgcgcgacgcagtcgatctttcccgttatttcgcccgcatcggttatcgcggccccgccgagccgacgctcgacgtccttcgccagttgcaactgctgcatccgcaatcgattccgttcgagaacctcaacccgttcaccggcgcgcgcgtcgcgctcgaactcgaatcggtcgtcgataagctggtcgggcagcgccgcggcggttactgcttcgagcagaacaagctcttctacacggtgctcgtgcagctcggctttcgcgtgacgccgctgatcgcgcgcgtgcgctggcagcgtccgccggaacagtcgacgccgcagacgcacatgctgctgcggatcgatctggacggcgacacctggttcgccgacgtcggcttcggttcgacgacgctgaccgcgccgctgcgccatgacccgaacgtcgcacagccgacgccgcacggcacgtttcgcgtcgtcgacgcgcccgtcgctggcgagttcgagatcgaatgcgaaacgccgaacggttggcatccgctgtatcgtttttcgctgaagcccgtcgagtgggtcgattacgaggtcgcgaactggtatacgtcgcggcaccccgattcgttcttcacgcacgatttcatcgcgtgccgaatcctgccggatgcgcgtgcgctgcttttcaacgatgcgttgacgctgcgaacggccgacggcgcggcgcacaccacccggctgacggatgccgacgcatgggctgcgtgcgtgcgcgagcgttttggtctcgacctggacggattcgatgcggcggcgctttatgcacgggcagtggcgcgcgccgacgaggcggcggctgccgccgagcggcgcgacggcggcgcggcgcgctga

SEQ ID NO: 52360 - protein, 290 aa, Burkholderia pseudomallei K96243
MRDAVDLSRYFARIGYRGPAEPTLDVLRQLQLLHPQSIPFENLNPFTGARVALELESVVDKLVGQRRGGYCFEQNKLFYTVLVQLGFRVTPLIARVRWQRPPEQSTPQTHMLLRIDLDGDTWFADVGFGSTTLTAPLRHDPNVAQPTPHGTFRVVDAPVAGEFEIECETPNGWHPLYRFSLKPVEWVDYEVANWYTSRHPDSFFTHDFIACRILPDARALLFNDALTLRTADGAAHTTRLTDADAWAACVRERFGLDLDGFDAAALYARAVARADEAAAAAERRDGGAAR

SEQ ID NO: 52361 - DNA, 882 bp, Nocardia farcinica IFM 10152
  CDS (1)..(882)
atgagcaagcccgacgaccccgcctaccactggaacggcgcggagctggacctggacgcgtacctggccaggatcgggttcgccggcgagcgcgcgcccaccctggccacgctgcgtgaactcgtgtaccggcacaccaccgcgatccccttcgagaatctcgaggccgtgctcggccggcccgtgcgcctcgacctggcgaccctacaagacaagctcgtgcacagcagacgcggcggctactgctacgagaacgccggcctgttcgccgccgcgctggaacgtctcgggttcggtgtcaccggccacaccggccgggtcaccatgggggcgggcggcctacgcccggccacgcacgcgctgttacgggtcaccaccgccgacgacgaccgggtgtggatgtgcgacgtcggcttcggccgcggcccgctgcgcccctacgagctgcgcccgcaaccggacgaattcaccctgggggactggcgtttccggctcgagcgccgcaccggcgaactcggcaccgacctgtgggtgctgcaccagttcggcagggacggctgggtcgaccgctacaccttcaccaccgcgccgcagtaccggatcgacttcgaggtcggcaaccacttcgtgtcgacctcgccgcgctcgccgttcacgacccgtccgttcctgcagcggttccattccgaccgccaccacgtgctcgacggactgaccctgatcaccgaacgccccgacggcagcgccgacatccgtgccctgacaccgggcgagttgcccgaggtcatcaacgagctcttcgacatcgaactgcccggcccggacctggatgcgctcaccaccggcagctggctcgagcgcgtcgctgcgggcaccccgtag

SEQ ID NO: 52362 - protein, 293 aa, Nocardia farcinica IFM 10152
MSKPDDPAYHWNGAELDLDAYLARIGFAGERAPTLATLRELVYRHTTAIPFENLEAVLGRPVRLDLATLQDKLVHSRRGGYCYENAGLFAAALERLGFGVTGHTGRVTMGAGGLRPATHALLRVTTADDDRVWMCDVGFGRGPLRPYELRPQPDEFTLGDWRFRLERRTGELGTDLWVLHQFGRDGWVDRYTFTTAPQYRIDFEVGNHFVSTSPRSPFTTRPFLQRFHSDRHHVLDGLTLITERPDGSADIRALTPGELPEVINELFDIELPGPDLDALTTGSWLERVAAGTP

SEQ ID NO: 52363 - DNA, 882 bp, Desulfitobacterium hafniense DCB-2
  CDS (1)..(882)
atggttaatttgattattgaaaatatcgaatattgctcgttttcccagtccagcattgttaagcgaggagatgaagctattatgtacgaagaattatccgcacccctgccggataaaaagcggtatctggaaagaatcggctttaccggcgaactgaggcccaacctggacacgctcaatcgacttatcctggcccagctgcacactgttccctttgaaaatctcgacgtttatgatgttggccgggatattctcctggacaccgaatccctttttgacaaaattgtcgttcagggcagaggcggctattgctttgaactcaacgggcttttcatgagccttttgcaggatattggcttcgattgttatcccgttatggtgcgggtagtctggatggcgacgggctatatgcctatttcgcactgtgccggaattgtcactattgagggaacacggtacttctgtgatgtgggtttcggcggcccggccccctgcagcgcgctgaggctggatgaccccggggagcagcaatcgggagcgaaccgctttgtttttgctcaagcccctgatggcgactttatcatttacaggacagtggatggtggcagggagcaactcctcaaatttaacgatcgcccctgccagaatgtggatttccttgcccccaacgaatatttatcccagaataaacaatccggctttaaacaaatgcgtatgatcaatatcgcccgggaaggcggcagtgccgcgatcaacaacaatgttctgagactccatcagggcgggcaggtggaagaaaccctgctcgacacggaagacaagctcagggaagcgctcctgaattatttcggtctggcggtcagctttcctctcaaactttaa

SEQ ID NO: 52364 - protein, 293 aa, Desulfitobacterium hafniense DCB-2
MVNLIIENIEYCSFSQSSIVKRGDEAIMYEELSAPLPDKKRYLERIGFTGELRPNLDTLNRLILAQLHTVPFENLDVYDVGRDILLDTESLFDKIVVQGRGGYCFELNGLFMSLLQDIGFDCYPVMVRVVWMATGYMPISHCAGIVTIEGTRYFCDVGFGGPAPCSALRLDDPGEQQSGANRFVFAQAPDGDFIIYRTVDGGREQLLKFNDRPCQNVDFLAPNEYLSQNKQSGFKQMRMINIAREGGSAAINNNVLRLHQGGQVEETLLDTEDKLREALLNYFGLAVSFPLKL

SEQ ID NO: 52365 - DNA, 840 bp, Pseudomonas aeruginosa UCBPP-PA14
  CDS (1)..(840)
atgaccccgctgacgcccgagcagacccatgcctacctgcaccatatcggcatcgacgatcccggtccgccgagcctggcgaatctcgaccggctgatcgacgcgcatctgcgccgggtcgccttcgagaacctcgacgtgctgctcgaccgccccatcgagatcgacgccgacaaggttttcgccaaggtcgtcgagggcagccgcggcggttattgcttcgaactcaactcgctgttcgcccgcctgctgctggccctcggctacgagctggaactgctggtggcacgggtacgctgggggctcccggaggacgcgccgctgacccagcaatcgcatctgatgctgcgtctgtacctggcggagggcgagttcctggtggatgtcggcttcggctcggccaatccgccgcgagcactgcctttgccgggcgacgaggcggacgccggacaggtgcattgcgtgcgcctggtcgacccgcacgccggtctctacgaaagcgccgtgcgcggtcgcagcggctggctgccgctgtaccgcttcgacctgcgcccgcagttgtggatcgattacatcccgcgcaactggtacacctcgacccacccgcacagcgtgttccgccagggcctgaaggccgccataaccgagggcgacctgcgcctgaccctggccgacgggctgttcggccagcgcgccggcaacggcgagacgctgcagcgccaactgcgcgacgtcgaggaactgctggacatcctgcagacccgttttcgcctgcgcctcgacccggcctccgaagtgccggcgctggcgcgacggctggcgggactgatctccgcctga

SEQ ID NO: 52366 - protein, 279 aa, Pseudomonas aeruginosa UCBPP-PA14
MTPLTPEQTHAYLHHIGIDDPGPPSLANLDRLIDAHLRRVAFENLDVLLDRPIEIDADKVFAKVVEGSRGGYCFELNSLFARLLLALGYELELLVARVRWGLPEDAPLTQQSHLMLRLYLAEGEFLVDVGFGSANPPRALPLPGDEADAGQVHCVRLVDPHAGLYESAVRGRSGWLPLYRFDLRPQLWIDYIPRNWYTSTHPHSVFRQGLKAAITEGDLRLTLADGLFGQRAGNGETLQRQLRDVEELLDILQTRFRLRLDPASEVPALARRLAGLISA

SEQ ID NO: 52367 - DNA, 846 bp, Ralstonia eutropha JMP134
  CDS (1)..(846)
atgatcacgcttgacgctccccgcctggacgcctacctcgcacgccttggcctcgacgcaccaccgtcccccacgctggaatcccttgatgcgctcatcgcggcgcagctcgcacgcatccccttcgagaacatcgacccgctgctgggccgccctgtacggatcgacatcgatgccgtgttcgacaagctggtcacgcgcggacgcggcgggtattgcttcgaactcaacacgctgctggccgcagcgctgacggcgctgggctacaccgtaacgccgctggccgcgcgtgtacgctggggggtggccaatgacgtgcagaccatggcttcgcacatgctgctgcgcgtagaagtcgcgcatcgcagctatcttgccgatgttggctttggcggcccctcgccgttcaggtcgctgccattgtcggcgccggccgcgtcagcattcccctatcggctggtcccggctccggacgacaccactgccagcacgttccatggccaggatctcgaagtgcgcggagacgagggctggctcaaggtctaccgcttcgacctgacaccgcagccgtggatcgatttcatcgcgcgcaactggtacatctgcacgcatccggacagccctttcacgcagcggctgatggtggcccgtaccgatggcgatctgcgactgaccctggccaacggcgaactggccgcgcgcgctgcggacggcaccgtgcaccggcagccgttgtccaccgcgggcgatgtcatcgacgtgctggccgaccgctttcacgtggcactggatgccgacagccgcgccgggctcgagcgtgtgctgcctgcgctgctgggcgcctga

SEQ ID NO: 52368 - protein, 281 aa, Ralstonia eutropha JMP134
MITLDAPRLDAYLARLGLDAPPSPTLESLDALIAAQLARIPFENIDPLLGRPVRIDIDAVFDKLVTRGRGGYCFELNTLLAAALTALGYTVTPLAARVRWGVANDVQTMASHMLLRVEVAHRSYLADVGFGGPSPFRSLPLSAPAASAFPYRLVPAPDDTTASTFHGQDLEVRGDEGWLKVYRFDLTPQPWIDFIARNWYICTHPDSPFTQRLMVARTDGDLRLTLANGELAARAADGTVHRQPLSTAGDVIDVLADRFHVALDADSRAGLERVLPALLGA

SEQ ID NO: 52369 - DNA, 834 bp, Burkholderia cepacia R1808
  CDS (1)..(834)
atgactgactcgttcgacctttcgcgctacttcgcccgcatcggctacgacggcccggccgagccgacgctcgacgtgctgcgccgcctgcatctgctgcatccgcaggcgatcccgttcgaaaacctcaatccgctgaccggcgcgcgcgtcgcgctcgacgtgccggcgatcgtcgccaaggtcgtcgcgcgccgccgcggcggctattgcttcgaactgaacaagctgttctacacggcgctcacgacgctcggctttcgcgtcacgccgctgatcgcgcgcgtgcgctggatgcggccgcccgaggccgtcaccgcgcaggcgcacatgctgctgcgcatcgatctggacggcgcggcgtggctcgccgacatcggcttcggcagcgcgacgctcaccgcgccgctgcgcttcgcgccgggcgagcggcagctgacgccgcacggcgcgtttcgcgtcgtcgacgcaccggtcgacggcgagttcgacatgcagttcgagattcccgacggctggcaaaccacctaccgcttttcgctgaagccggccgagtggatcgattacgacgccgcgaactggttcacgtcgacctatcccgaatcgatcttcgtgaacgacctgatcgcgtgccgcgtgctgccgaccggccgcgcggcgctgttcaacaccgtgctgacgctgcgcgacgcggccggcgccgggcgcaccgtcacgttcgacgacgcggccgcgtggggcgcgtgcctgcgcgacacgatcggcatcgacaccgccggcttcgatctcgacgcgctgttcgcgcgggtcgccgcgcgggccggcaacatctga

SEQ ID NO: 52370 - protein, 277 aa, Burkholderia cepacia R1808
MTDSFDLSRYFARIGYDGPAEPTLDVLRRLHLLHPQAIPFENLNPLTGARVALDVPAIVAKVVARRRGGYCFELNKLFYTALTTLGFRVTPLIARVRWMRPPEAVTAQAHMLLRIDLDGAAWLADIGFGSATLTAPLRFAPGERQLTPHGAFRVVDAPVDGEFDMQFEIPDGWQTTYRFSLKPAEWIDYDAANWFTSTYPESIFVNDLIACRVLPTGRAALFNTVLTLRDAAGAGRTVTFDDAAAWGACLRDTIGIDTAGFDLDALFARVAARAGNI

SEQ ID NO: 52371 - DNA, 840 bp, Bacillus cereus G9241
  CDS (1)..(840)
atgatgaccgatttacaaaaggagttttttaaacgattaaaaattcctgcaaaagaaataacatttgatgatttagatgaaattctcttaaaaatgggattgattctcccctatgaaaatctcgatattatggctggtactattaaaaacatctcaaaaaataacttaatagaaaagttacttattcaaaaacgaggcggtctttgttatgaattaaactccttattgtattactttttaatggattgtggatttcaagtatataaagtagctggtactgtttatgacctttatgacaataaatggaaacccgatgatggtcatgtcattatcatattaaatcataataataaagattatgttatagacgccggttttgcctctcatctacctttacatccagtcccttttaacggagaagtcatctcttctcaaacgggtgaatatcgaatttgcaaacgaattacccgaaaaggtacacacattttagaaatgagaaaaggagctaacggggaatctacaaatttcttgcaatctgagccttcagatgaatggaaaataggctatgccttcactttagatccaatagatgagaaaaaggtgaataacattcagaaagtcattgtagaacataaagaatctccttttaataaaggggctatcacttgtaaattaactgattatggtcacgtatcattaacaaataaaaattatacagaaacctttaaaggcacaaaaaataaacggccaatagattctaaagattatgctcgcattcttcgtgaatcttttggaataacgcaagtgaaatatgtaggaaaaacactagaaagaggatag

SEQ ID NO: 52372 - protein, 279 aa, Bacillus cereus G9241
MMTDLQKEFFKRLKIPAKEITFDDLDEILLKMGLILPYENLDIMAGTIKNISKNNLIEKLLIQKRGGLCYELNSLLYYFLMDCGFQVYKVAGTVYDLYDNKWKPDDGHVIIILNHNNKDYVIDAGFASHLPLHPVPFNGEVISSQTGEYRICKRITRKGTHILEMRKGANGESTNFLQSEPSDEWKIGYAFTLDPIDEKKVNNIQKVIVEHKESPFNKGAITCKLTDYGHVSLTNKNYTETFKGTKNKRPIDSKDYARILRESFGITQVKYVGKTLERG

SEQ ID NO: 52373 - DNA, 879 bp, Pseudomonas fluorescens PfO-1
  CDS (1)..(879)
atggcgaccatcggcggaacgatccgcgcccccatgcaaaaggacccagccatgagcgagcctcgcctgacgaatctgaaacagtacctgcaacgcctgggattcgacgcgcccccggcaccgacccttgaaaccctgcgattgttgcaactgcgccataccggcgcctttcctttcgaaaacctgtcgacgctcagtggcgaacccgtcctgatcgatctgccctccattgagcgcaaggtcctgaacaacgcccgtggcgggtactgctacgagctgaacaacctgtttctggccttgctgctggagctggggttcgacgcgcggggcatcagcgggcgcgtggtcatgaatcagcccgaaggcagctggacggcacgcacccaccgcctgagcctggtgaccattgacgacgtgcgctacatcaccgacgtcggcttcggcggcatggtgccgaccgcgccactggtgctcgataccgacgccgagcaatacacgccgcacgaaccgtatcgcatcgaagtgcaggccgatggctacatgctgcgggccagagtcgctggcgaatggcggccgatgtacctgttcgatctgcagcgccaggaagacatcgattacaccctcggcaactggtacgtctcgacccacccggactcgccatttgcccagcgcctgatggtggcgcgtacgggcgacggctggcggcgcaccttgaacaacggcagtttcgcgatccaccgtatcggcgccgagagcgagcggcgtgaagtgacggatgtcgatgaactgatcgaattgctggaacgggaattcggcttgcgcctgccgcaccagctcggtgcgcgagaggctctggcgcgcttgattcagccagtttga

SEQ ID NO: 52374 - protein, 292 aa, Pseudomonas fluorescens PfO-1
MATIGGTIRAPMQKDPAMSEPRLTNLKQYLQRLGFDAPPAPTLETLRLLQLRHTGAFPFENLSTLSGEPVLIDLPSIERKVLNNARGGYCYELNNLFLALLLELGFDARGISGRVVMNQPEGSWTARTHRLSLVTIDDVRYITDVGFGGMVPTAPLVLDTDAEQYTPHEPYRIEVQADGYMLRARVAGEWRPMYLFDLQRQEDIDYTLGNWYVSTHPDSPFAQRLMVARTGDGWRRTLNNGSFAIHRIGAESERREVTDVDELIELLEREFGLRLPHQLGAREALARLIQPV

SEQ ID NO: 52375 - DNA, 879 bp, Ralstonia metallidurans CH34
  CDS (1)..(879)
atgcttgccgccgacgaaatccccgctctccaccccgaccagttggtcgcctggctgcgacgcatcggcatcgcagaggttcccgacgcccccacgctaccggtgctgaacacgctgatcgcggcccaactcgcgcacatcccgttcgagaatctcgacgcgctgctcggccgccgggtgtcgatcgatctgccctcggtattcgaaaaactcgtggcgcagggccgcggcggctactgcttcgagcagaacaccctgctctgcgccggcctcaaggcactcggttacgcagtgacgccgcttgcagcgcgcgtgcgctggcatgtgccggaagccacgccgacggggctgtcgcacatgctcctgcgcgtagaagtggcgcacgaaagctatatcgccgatgtgggcttcggcgggccgacgccggaccgcgccttgtcgctatcgctgccgccggatgaaaacacgccctatcgtctgcatccctccccggcaaacgcgctgacgggtacgggttttcactgcctggatctgacggtgcccgacgtcagcgacgacgcttcgggttggcaaccgatctaccgtttcgacctgaccccgcagccctggatcgatttcatcgcgcggaactggtacgtctccacgcatccagacagccacttcacccgtacgctgatggccgcgcgtaccgacggcgacacccggctcgcgctcgccaatggcaacctgagcgagcgctcgcccgacggcagcgtgcgaaaaaccgccctggcgtcggccgacgccgtgatcgacacgctggcaacgcgcttccagatccggctcgatcccgccttgcgcgccgcgctggcgacacgactgccagcggtgctcggatag

SEQ ID NO: 52376 - protein, 292 aa, Ralstonia metallidurans CH34
MLAADEIPALHPDQLVAWLRRIGIAEVPDAPTLPVLNTLIAAQLAHIPFENLDALLGRRVSIDLPSVFEKLVAQGRGGYCFEQNTLLCAGLKALGYAVTPLAARVRWHVPEATPTGLSHMLLRVEVAHESYIADVGFGGPTPDRALSLSLPPDENTPYRLHPSPANALTGTGFHCLDLTVPDVSDDASGWQPIYRFDLTPQPWIDFIARNWYVSTHPDSHFTRTLMAARTDGDTRLALANGNLSERSPDGSVRKTALASADAVIDTLATRFQIRLDPALRAALATRLPAVLG

SEQ ID NO: 52377 - DNA, 825 bp, Burkholderia fungorum LB400
  CDS (1)..(825)
atgaatctggaaaactacttcgcccgcataggctacgacggtccgcgcgcggcaacgctcgaagtgcttcacacgcttcaccgcctgcacccgcgcgcgatcccgttcgagaacctgaacccgttcacgcggcgtcctgtgaaactggatctcgacgcagtggaacgcaaactcgtcaccgggcgccgcggcggctactgtttcgaacagaacgcgctattcgccgacgtgctgctccagttgggcttcgcggtcacgccattgctcgggcgcgtgctctggggccgcgaatcggacgcggttccgccgcgcacgcatatggtgttgcgcatcgacctgaacgacgaagcctggatcgccgacgtcggcttcggcagcgtgacgctgaccgcgccgctgcggctgaccgcgggcctcgcgcagcccaccgaactcggcacgttccgtcttgccgatgcatcgcgcgacgcactctttctggaagtgcaggcgcgtgacgaaagctgggcgcgggtctaccgcttcgatctgcatccggtcgagtggatcgattacgaaacctcgaactggtacacgtcgacctcgccggaagcgatttttgcgagcaccctgattgtgtgccgcgtgttgcccgaagcgcggctcgcgttgctcaacgatcaactgagcgagcgcgccgcggacggccggctcatcagcgagcggcaacttcgcagcgccgctgaacttgccgcgtgtctgcgcgatcagttcggcttgaacaccggcgagttcgacatcgccgagatattcgaacgcgtgcgcacgccggtcacaaccgcgtag

SEQ ID NO: 52378 - protein, 274 aa, Burkholderia fungorum LB400
MNLENYFARIGYDGPRAATLEVLHTLHRLHPRAIPFENLNPFTRRPVKLDLDAVERKLVTGRRGGYCFEQNALFADVLLQLGFAVTPLLGRVLWGRESDAVPPRTHMVLRIDLNDEAWIADVGFGSVTLTAPLRLTAGLAQPTELGTFRLADASRDALFLEVQARDESWARVYRFDLHPVEWIDYETSNWYTSTSPEAIFASTLIVCRVLPEARLALLNDQLSERAADGRLISERQLRSAAELAACLRDQFGLNTGEFDIAEIFERVRTPVTTA

SEQ ID NO: 52379 - DNA, 882 bp, Novosphingobium aromaticivorans DSM 12444
  CDS (1)..(882)
atggggcacgccggtcatccggagaacggaaacaacgccatggcaaatcccctcatcgaggacgacgaaatgacgctgaacgagacgcaacttgccgcatacctcgccaagatcggcattgaaggcgaagtctcgctcgatcttcatggtctggcgaggcttcaccgcgcccacctgttggggatcacgtgggaggctatcgatgcgttcatggactggccgtcatccgtcgcgccgtccgctgctttcgccaagatcatcgaacaaggtcgcggcggctggtgttacgagatgaacggcctcttcggagcggcgctttcggcgctcggcttccgcgtgacgcggctttgcggctgtgtcgaccggccggttctgggcgatgccgccataggcaaccacctgacgttgcgggtcgacctggatcgtccctacctggctgaagtcggcgtggcggatgctttgttcgagccggtgccgatcggcgtcgggccgatccgtcaacgtggcttcgacttctccatcaaggctgcggacgacggttggctccgccttcataaccatgcccatggcaccgcccgtactgtcgatttcaagcctgatcacagcgacgaggccgcgctgtccgcgatgcaggcgtggctcatgcgtgaaccggcctcgcccttcaccaatgccctggcggtgtatcgtcacactgtggatggctatgtcgcgttgcaaaatgatcgactgcgccgtgtaaccgccctgggtgtccagcaagagaacatcgatggcgcggatcaccttgcgcaggtgctggaggatgtgttcagtctttcggttccgcaccctgagcgcatctgggaaaaggttgccgccattcgtctggtcacagcctga

SEQ ID NO: 52380 - protein, 293 aa, Novosphingobium aromaticivorans DSM 12444
MGHAGHPENGNNAMANPLIEDDEMTLNETQLAAYLAKIGIEGEVSLDLHGLARLHRAHLLGITWEAIDAFMDWPSSVAPSAAFAKIIEQGRGGWCYEMNGLFGAALSALGFRVTRLCGCVDRPVLGDAAIGNHLTLRVDLDRPYLAEVGVADALFEPVPIGVGPIRQRGFDFSIKAADDGWLRLHNHAHGTARTVDFKPDHSDEAALSAMQAWLMREPASPFTNALAVYRHTVDGYVALQNDRLRRVTALGVQQENIDGADHLAQVLEDVFSLSVPHPERIWEKVAAIRLVTA

SEQ ID NO: 52381 - DNA, 846 bp, Novosphingobium aromaticivorans DSM 12444
  CDS (1)..(846)
atgctgcatgaagcgttgtcggccgaggaacttgctgcctacctgcaacggatcgggttcgacgacgagcctcgacgcgatctcgccacgcttgaccggatcgtgcaggctcatgtcaggatgatcccgttcgagaacctcgacgcccagcttggccgccctctctcgaccgatccgcgcgcggcctttgcaaagctggtggaacggcggcgcggcggatggtgctatgaacacaacggggtgctggcagcggcattgagggcgatcggtttcgcggtcacgcggatgagcgcgggcgtgatgcgcgaggtcaggggcgatgcggcaatgggttcgcacttgtgcctgctggtagaatgcgaggggccgcgcctcgtcgacgccgggttcggaagctggatcggggcaccgcttccgctggagacagggacctgggtccacgatccccttcccgtcagcctcggaacgctggaagatggaatgtggcggctttccgccaccatcggcacgacggctatgtcctacgatttccacgccgccccggccgacgaagatcttctgtcacggatgtgccactggcaggccaatgacccggcatcggtcttcgtccagaaccttacggtgcagcgacgcgacgcgggacagtacctgatgctgcgcggcaaggtcctgtccgtggtgacggccggcggagaggaacggcgggagctgggctcggccgacgaactggccgaggcgttgcgcgacctgttcctgctcgacgtgcccgaggccgtcacgctgtggcccgcgatagaggcgcgccacgaagcgctgttcggcgatcaggccgcacccacgacatag

SEQ ID NO: 52382 - protein, 281 aa, Novosphingobium aromaticivorans DSM 12444
MLHEALSAEELAAYLQRIGFDDEPRRDLATLDRIVQAHVRMIPFENLDAQLGRPLSTDPRAAFAKLVERRRGGWCYEHNGVLAAALRAIGFAVTRMSAGVMREVRGDAAMGSHLCLLVECEGPRLVDAGFGSWIGAPLPLETGTWVHDPLPVSLGTLEDGMWRLSATIGTTAMSYDFHAAPADEDLLSRMCHWQANDPASVFVQNLTVQRRDAGQYLMLRGKVLSVVTAGGEERRELGSADELAEALRDLFLLDVPEAVTLWPAIEARHEALFGDQAAPTT

SEQ ID NO: 52383 - DNA, 801 bp, Microbulbifer degradans 2-40
  CDS (1)..(801)
atgcatttaggcccaaccacaacaagctacctaaacgctttaggtttacccgtaacggccaaacccacgttgcagttgctgcaaaatattcaaagtaaccacatagcattttttagttttaataaccttgctgttttacttaagcaagaaatccccttggctatagaagttattgcagaaaaaatattgcgcaagaagctgggcggctactgctttgagcaaaataaacttgcgtatcatgtactgcaaaatattggctttaaagtagagctactgttagcaaaagtagtaatgaataaagatatagaagccccgcgaacccaccgtattaccttagtaaccataaatgagcagcgctatttaattgatgtaggttttggcgtacaaggcccacgccacccaatgttattagaattaaacaccgaacaagaccaaggcgatttttgctatcgcatagtcaaatacaaaaacaatgactattgcctgcaaattaaaaaaccaggaggctattttaacctctaccatttcgacctaggccactacacaaatgcagactgcgaaattggccacttctattcgcacaaacaccccaatgccaccttcgcatgcaacctagtagcaggccggcgcctatacggcgaatattactcactcgttaataaagaattacgccactaccaaaacggcaaagaaacaaccaccacaatccaaaccgctacccagcttaatagcattttaaaagaacactttttgctgcagccacaagcgagtgatgtagaaaagatataccaaagtttgtaa

SEQ ID NO: 52384 - protein, 266 aa, Microbulbifer degradans 2-40
MHLGPTTTSYLNALGLPVTAKPTLQLLQNIQSNHIAFFSFNNLAVLLKQEIPLAIEVIAEKILRKKLGGYCFEQNKLAYHVLQNIGFKVELLLAKVVMNKDIEAPRTHRITLVTINEQRYLIDVGFGVQGPRHPMLLELNTEQDQGDFCYRIVKYKNNDYCLQIKKPGGYFNLYHFDLGHYTNADCEIGHFYSHKHPNATFACNLVAGRRLYGEYYSLVNKELRHYQNGKETTTTIQTATQLNSILKEHFLLQPQASDVEKIYQSL

SEQ ID NO: 52385 - DNA, 813 bp, Chloroflexus aurantiacus
  CDS (1)..(813)
atggatataactgcttatctcaaccgcatcaattatgctggcccgctggcacccaccgccgagaccttgcggcggttgcacctagcgcacctgctctcagtgcctttcgagaaccttagcatccactggcatgagcctatcgtcctcacagatgaagcccttttccagaagattgtattgcgccagcgcggcggcttctgttacgagctgaacgggctgttcgcttccttgctgcggaccttaggcttccaggttgagatgctctcggcaggcgtgatgaataagcgcggtgagttcgggccggagttcgaccacatgaccttgatggtcacacttgcggagcgctggctggtagacgttggcttcggtgactctttccgtgagccgctgcttctggatgcgcgtacggagcaggtgcagggtcggcgcgcttaccgcattgaggaggtcggcgacgggcgtttaatcctgatggagcgccgagagggcgacgagtggcaggcgcaataccgcttcagcctggagccgcacgtctacgctgattatgcagggatgtgccgctatcatcagacctcacctgagtcacacttcacgcagcgacgaatctgttctttggcgacagcggatgggcgggtgacattgagtgagcggcggctgattatcacgcgagggggtgagcggcaggagcgggagttggggagtgcggaggagtatggggaggtgttgcgcacacactttggtatcgaagccgcgccgaaccaggggatgcagccgaccgcaatgaggaggtctgttattctcgaaacatactag

SEQ ID NO: 52386 - protein, 270 aa, Chloroflexus aurantiacus
MDITAYLNRINYAGPLAPTAETLRRLHLAHLLSVPFENLSIHWHEPIVLTDEALFQKIVLRQRGGFCYELNGLFASLLRTLGFQVEMLSAGVMNKRGEFGPEFDHMTLMVTLAERWLVDVGFGDSFREPLLLDARTEQVQGRRAYRIEEVGDGRLILMERREGDEWQAQYRFSLEPHVYADYAGMCRYHQTSPESHFTQRRICSLATADGRVTLSERRLIITRGGERQERELGSAEEYGEVLRTHFGIEAAPNQGMQPTAMRRSVILETY

SEQ ID NO: 52387 - DNA, 759 bp, Angiococcus disciformis
  CDS (1)..(759)
atgttcgacgccactcgctacctggagcgtatcggtgtctcggcgggtacgccgctcgccgcgctccatcgggcccacctcgaggccgtgccgttcgagaacctcgacatccacctgaagcggcccatccggctcgatgaggcggccttcttcgagaaggtcgtcctccagcggcgcggtgggttctgctacgagctcaatggcctcttcgcccgcctgctccggactctcggttaccgggtgacgctgctgtcggcgcgcgtggcctcgcgtcccgatggcagcgcctacggtcccgacttcgaccatctggcgctcctggtggaggacgcctcgggccgctggctggccgacgtgggcttcggcgagtgcttcctggagccgctgcgcctcgacgagcgcggcgtgcagacccaggacggacgcggccaccggctggtcgaggacgcggaggggctcgtcgtctggcgcgaggcggcgtcgggggactggaaggcccagtacgtcgtctcgctcatcccgcgcgagctcggggacttcgcggccatgtgccaccaccagcagacctcgccggagtcccacttcacgcagcgacgcctctgcacccggaccacgccggacgggcgcatcaccctcaaggagggcgcgctcgtcgtcacctcggggggcgcgcgccacgagcagcggctcccggacgaggccgcgtggcgggccgcgctcacgcggcacttcggcatcaccctgccctccggcggatga

SEQ ID NO: 52388 - protein, 252 aa, Angiococcus disciformis
MFDATRYLERIGVSAGTPLAALHRAHLEAVPFENLDIHLKRPIRLDEAAFFEKVVLQRRGGFCYELNGLFARLLRTLGYRVTLLSARVASRPDGSAYGPDFDHLALLVEDASGRWLADVGFGECFLEPLRLDERGVQTQDGRGHRLVEDAEGLVVWREAASGDWKAQYVVSLIPRELGDFAAMCHHQQTSPESHFTQRRLCTRTTPDGRITLKEGALVVTSGGARHEQRLPDEAAWRAALTRHFGITLPSGG

SEQ ID NO: 52389 - DNA, 834 bp, Brachydanio rerio
  CDS (1)..(834)
atgatggatgttcaaaggtatttggctcgtatcggctgttctggtccatgtcccccgacactggagactctgcgatatctacacctgaaccacttactgacggttccctttgaaaacctcaccattcacacccggggtcgggtcaggctggagctgccacttctgtatgaaaaaatcgtggtgaatcatcgtggaggattctgctttgagattaacggactcttctcctggctgctgtctcagatgggttatgatgtcactttgctctcggcacaggtaaggagtcggttcaccggagcttacggacctccattcgaccacttgttcttgatggtgaaggtggatgaacacaggtggctctgcgatgttgggtttgggtctggattccagcttcctctttctcttgagactgacagtcctcagatccagagccacggcgtttatcgcctcagatctgaaggaaacttgattttcatggaaagtaagtcagagattggtggggaatgttggacagaacagtataagttcactcttgagcctcgagacagagctgatttcagagccatgtgtgactaccatcagagttctgttagctcacttatgttctgcaagtctctctgttcactgttgttgcccaccgggagaatcaccatcatgggccgcagactgattataagcagtttgggctcaggtgatggagaacatgcatcaagaaccataacagatctttcagatgaagaaatcacagagttgttgagggagaagtttggaattgttcttcaagctccactcattcctaaagataacgtggttttaccaccaatcaagtattaa

SEQ ID NO: 52390 - protein, 277 aa, Brachydanio rerio
MMDVQRYLARIGCSGPCPPTLETLRYLHLNHLLTVPFENLTIHTRGRVRLELPLLYEKIVVNHRGGFCFEINGLFSWLLSQMGYDVTLLSAQVRSRFTGAYGPPFDHLFLMVKVDEHRWLCDVGFGSGFQLPLSLETDSPQIQSHGVYRLRSEGNLIFMESKSEIGGECWTEQYKFTLEPRDRADFRAMCDYHQSSVSSLMFCKSLCSLLLPTGRITIMGRRLIISSLGSGDGEHASRTITDLSDEEITELLREKFGIVLQAPLIPKDNVVLPPIKY

SEQ ID NO: 52391 - DNA, 807 bp, Brachydanio rerio
  CDS (1)..(807)
atgtacacggaccgttctggtccatgtcccccgacactggagactctgcgatatctacacctgaaccacttactgacggttccctttgaaaacctcaccattcacaccctgggtcgggtcaggctggagctgccacttctgtatgaaaaaatcgtggtgaattatcgtggaggattctgctttgagattaacggactcttctcctggctgctgtctcagatgggttatgatgtcactttgctctcggcacaggtcagaaatcggtttaccggagtttacggacctccatttgaccacttcctcatgatggtgatggtggatgaacacaggtggctctgtgatgttgggtttgggtctggattccagcttcctctttctcttgagactgacagtcctcagattcagagccacggcgtttatcgcctcagatctgaaggaaacttgattttcatggaaagtaagtcagagattggtggggaatgttggacagaacagtataagttcactctggagcctcgagacagagctgatttcagagccatgtgtgactaccatcagagttctgttagctcactttttttctgcaagtctctctgttcactgttgttgcccaccgggagaatcaccatcatgggccgcagactgattataagcagtttgggctcagatgatggagaacatgcatcaagaaccataacagatctttcagatgaagaaatcacagagttgttgagggagaagtttggaattgttcttcaagctccactcattcctaaagatattgagattgtaccaccaaacaattag

SEQ ID NO: 52392 - protein, 268 aa, Brachydanio rerio
MYTDRSGPCPPTLETLRYLHLNHLLTVPFENLTIHTLGRVRLELPLLYEKIVVNYRGGFCFEINGLFSWLLSQMGYDVTLLSAQVRNRFTGVYGPPFDHFLMMVMVDEHRWLCDVGFGSGFQLPLSLETDSPQIQSHGVYRLRSEGNLIFMESKSEIGGECWTEQYKFTLEPRDRADFRAMCDYHQSSVSSLFFCKSLCSLLLPTGRITIMGRRLIISSLGSDDGEHASRTITDLSDEEITELLREKFGIVLQAPLIPKDIEIVPPNN

SEQ ID NO: 52393 - DNA, 873 bp, Macaca mulatta
  CDS (1)..(873)
atggacattgaagcatattttgaaagaattggctataagaactctaggaacaagctggacttggaaacattaactgacattcttgagcaccagatccgagctgttccctttgagaaccttaacatgcattgtggggaagctatggagttgggcttagagactatttttgatcacattgtaagaagaaaccggggtgggtggtgtctccaggtcaatcaacttctgtactgggctctgaccacaatcggttttcagaccacaatgttaggagggtatgtttacatccctgcagctaacaaatacagcactggcatgattcaccttctcctgcaggtaaccattgatggcaggaactacattgctgatgctggctttggaagctcctcccagatgtggcagcctctggaattaatttctgggaaggatcagcctcagatgccttccattttccgcttgacagaacagaaaggaatctggtacctggaccaaatcagaagagagcagtatattccaaacacagaatttcttaattctgatctcctgccaaagacgacacaccaaaaagtgtactcttttacgcttgaacctcgaaaaattgaagattttgagtctatgaatacatacctgcaaacgtctccaacatctgcatttacaaccacatcattttgttccttgcagaccccagaaggggttcactgtttggtgggcttcaccctcacctatagaatattcaattataaagacaatacagatctgatcgagtttaaaactctgattgaggaagaagttgaagaagtgctgaaaaatatatttaagatttccttggggagaaagctcgtgcccaaacctggtaatggatccttcactatttag

SEQ ID NO: 52394 - protein, 290 aa, Macaca mulatta
MDIEAYFERIGYKNSRNKLDLETLTDILEHQIRAVPFENLNMHCGEAMELGLETIFDHIVRRNRGGWCLQVNQLLYWALTTIGFQTTMLGGYVYIPAANKYSTGMIHLLLQVTIDGRNYIADAGFGSSSQMWQPLELISGKDQPQMPSIFRLTEQKGIWYLDQIRREQYIPNTEFLNSDLLPKTTHQKVYSFTLEPRKIEDFESMNTYLQTSPTSAFTTTSFCSLQTPEGVHCLVGFTLTYRIFNYKDNTDLIEFKTLIEEEVEEVLKNIFKISLGRKLVPKPGNGSFTI

SEQ ID NO: 52395 - DNA, 873 bp, Rattus norvegicus
  CDS (1)..(873)
atggacattgaagcgtactttgaaagaattggttatcagaagtccacgaacaaactggacttgcaaacattaactgaaatccttcagcatcagatacgggctatcccttttgagaacttgaacatccattgtgggaaacccatggaactgagcttagaggccacttttcatcacattgtgaagaagaagcggggtgggtggtgtcttcaagtcaatcatcttctttactgggctctgaccatgataggttttgaggtcacaatgttaggaggatgtgtttatagccctccaacctgcaaatatagcaacactatgattcaccttctactacaggtgaccatcagtggcaaaaaatatattgtagatagtgcattcccattttcctgccagatgtgggagcctctggaattgacatctggaaaggatcagcctcaggtgcctgccatcttccacttgacagaagggaatggaatttggtatctgggacaaactaaaagacaagaatttgttccaaaccaagaattcattgattctaattttcttgagaagaacaaacatagaaaaatctactcttttactcttgaacctcgaacgattgaagatttccagaacgtgagtgcatactaccagaaatctccaacatctgtgatgacaaacacatcactttgctccctgcatacccaagaaggggtccatggtttagtaggcaccattcttatccataagaaattcaattataaggacaatgtagatcttgtggagtttaagactctgaaggaagaagaaatagaagaagtcctgaagcgcgtttttggtattcgcttggagacaaagcttgtgcccaaatgtggtaattggctttttactatttag

SEQ ID NO: 52396 - protein, 290 aa, Rattus norvegicus
MDIEAYFERIGYQKSTNKLDLQTLTEILQHQIRAIPFENLNIHCGKPMELSLEATFHHIVKKKRGGWCLQVNHLLYWALTMIGFEVTMLGGCVYSPPTCKYSNTMIHLLLQVTISGKKYIVDSAFPFSCQMWEPLELTSGKDQPQVPAIFHLTEGNGIWYLGQTKRQEFVPNQEFIDSNFLEKNKHRKIYSFTLEPRTIEDFQNVSAYYQKSPTSVMTNTSLCSLHTQEGVHGLVGTILIHKKFNYKDNVDLVEFKTLKEEEIEEVLKRVFGIRLETKLVPKCGNWLFTI

SEQ ID NO: 52397 - DNA, 1029 bp, Streptomyces hygroscopicus
  CDS (1)..(1029)
gtgggacgagctggagaaagccgatacggacgctcccgccgcatccgccccgactcccgcatccgccgaaactcccgcatccgccccaaccgccggagccaccccgtcacccggagccaccccgtcacccggagccaccccgtcacccggagccactctgccacccgcgcccaccccgccttccggagccgcccaggagtgagccctgcccagcccagcacaactccactcggcagaccggcaccgaccgaagcggcaagaaagggatcgcacatgttcagcacggacacgtacctggcgcatctggggtttccccagccgcccgcccccaccctgccgaacctccggcagttgcaccgcggccatctgatggcggtcccttacgacaccaaccacacccaccgcctcagcgcggagaacatggccgacatcgatatcgacaaggcattcgaggccatcgtgccgaccggcgccggtggcatgtgcctggagctgaacaccctgttcgcccagttgctccgcgagctgggctatgacctggacgtcatcagcggaggcacgtatctgcccggtgacatcttcgcccccgaccccgagcacatgctgatgctcgtccgtatcgacgggcaggagtggctggccgatgtggggcacgccggtctctgtttcaccgagccgctgcgcctgtccgaggaggtgcagtggcagtacggctgcgctttccggctgatccggcgggatggctatctcgtgctccaggccaagaccctggaccacgactggcgcaccacctaccgcttcaccaccgagcccaggacctatgacgcctgggccggggtcggtgagggcaatggcccggccatcctggcggcgatgcgccgacgcaggcgcgccatcgacaaggggcaggtcttcctcaccaacaacatgttcacgatcgtggagaacggccatgagaaggtcaccctcctcgtcgatccggaacggcgcgcccaggtgctcgacacgtactgggacggtcgcgactga

SEQ ID NO: 52398 - protein, 342 aa, Streptomyces hygroscopicus
MGRAGESRYGRSRRIRPDSRIRRNSRIRPNRRSHPVTRSHPVTRSHPVTRSHSATRAHPAFRSRPGVSPAQPSTTPLGRPAPTEAARKGSHMFSTDTYLAHLGFPQPPAPTLPNLRQLHRGHLMAVPYDTNHTHRLSAENMADIDIDKAFEAIVPTGAGGMCLELNTLFAQLLRELGYDLDVISGGTYLPGDIFAPDPEHMLMLVRIDGQEWLADVGHAGLCFTEPLRLSEEVQWQYGCAFRLIRRDGYLVLQAKTLDHDWRTTYRFTTEPRTYDAWAGVGEGNGPAILAAMRRRRRAIDKGQVFLTNNMFTIVENGHEKVTLLVDPERRAQVLDTYWDGRD

SEQ ID NO: 52399 - DNA, 828 bp, Streptomyces murayamaensis
  CDS (1)..(828)
atgtggaacggtgaagaggtcgacctggacgcgtacttcgcgcggatcgggtacgggggcagcgcggcgccgacgctcgccacgctgagcgcgctgcaccgggcgcacacggtcgccatacccttcgagaacctggacgtggcgctcggcaggcccgtgccgctggacgtcaagagcatccagcgcaagctcgtcggccagtcgcgcggcggctactgctacgagcacaacacgctgttcgccgccgtcgtggagcggctggggttcgaggtggcggcgcgcggggcgcgcaaccggacgcgcggtgccgtactgacggcggtcacgcacgcgttgctgctggtcaccgtcgagggcgagcgctggctgtgcgacaccggtttcggcagccagggcccgctggagccggtgccgctgcgcgacggcgcggtggtcgagcagggcggctggacgttcgggatcacgtctgaggccgagggcatccatgtgctgagctcgctgcggcccgagggatgggtgggtctttactccttcgccccgcagacgctgtaccccgcggacttcgcggtcatgaaccactacagctcctcgcatccgctgtccaagttcgtcggccaggtggtggcgcagcgccgggcgcccggggtgcgccgcgcgctggtgcgcgacgagctcaccaccgtccgtacggacggctccagtgagcaagtgaccgtgcccgccgaggagttggggcgggtgctgacggaggtgttcgggatcgtgctggaggacgacgaggtcgtacgcctcggggagctcggcccgggcgggtccgccggagcgtga

SEQ ID NO: 52400 - protein, 275 aa, Streptomyces murayamaensis
MWNGEEVDLDAYFARIGYGGSAAPTLATLSALHRAHTVAIPFENLDVALGRPVPLDVKSIQRKLVGQSRGGYCYEHNTLFAAVVERLGFEVAARGARNRTRGAVLTAVTHALLLVTVEGERWLCDTGFGSQGPLEPVPLRDGAVVEQGGWTFGITSEAEGIHVLSSLRPEGWVGLYSFAPQTLYPADFAVMNHYSSSHPLSKFVGQVVAQRRAPGVRRALVRDELTTVRTDGSSEQVTVPAEELGRVLTEVFGIVLEDDEVVRLGELGPGGSAGA

SEQ ID NO: 52401 - DNA, 774 bp, Streptomyces hygroscopicus
  CDS (1)..(774)
atgttcgacgtggcgaagtatctgcggcgcatcggggtggaggggacgcccccaccgaccctcgacaccctccgtcatctgcacaaacggcatctcatggcggtcccgtacgacaactccacagcccccgaccggctcccggcctcgcggcatctgacgaacgtcccgctggacctggtgttcgggcatgtggtgaccgagggccatggcggagtgtgctacgagctcaaccggttgttccacacgctgctggcggagctcggctacgacgtgcgcatggtggcggcggcggtgcggcaggcgaacgggaccttcggcccggagcgggagcacaccttcgacctggtccacctcgatggccggacccacctcgtggacgtgggcttccccgggccgtcctattcggagccgttgtacctgtccgaagaagagcagcaccagtacggctgctcgtaccgcgtgaccgaacacgacggctaccgggtggtggaacggcggcccaaggggagcgactggcagccggtgtaccggttccggccggagctggccgatccgtccggctgggacgcggtgcggctggacagcctggacgactacgcacaggactcggtgctcgccgggaccaccttccgcagccgggccacggacaacgggaagatcgtgctgatcggcaggcgctacttcaccgtcgaggacggggtggagcgcaccaaggtgctggtgaaggcggacgaattccaagacgtggtcgacctgatcctggcgggcgcatga

SEQ ID NO: 52402 - protein, 257 aa, Streptomyces hygroscopicus
MFDVAKYLRRIGVEGTPPPTLDTLRHLHKRHLMAVPYDNSTAPDRLPASRHLTNVPLDLVFGHVVTEGHGGVCYELNRLFHTLLAELGYDVRMVAAAVRQANGTFGPEREHTFDLVHLDGRTHLVDVGFPGPSYSEPLYLSEEEQHQYGCSYRVTEHDGYRVVERRPKGSDWQPVYRFRPELADPSGWDAVRLDSLDDYAQDSVLAGTTFRSRATDNGKIVLIGRRYFTVEDGVERTKVLVKADEFQDVVDLILAGA

SEQ ID NO: 52403 - DNA, 873 bp, Homo sapiens
  CDS (1)..(873)
atggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcaatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgagaaatatatttaagatttccttggggagaaatctcgtgcccaaacctggtgatggatcccttactatttag

SEQ ID NO: 52404 - protein, 290 aa, Homo sapiens [sequence omitted]

SEQ ID NO: 52405 - DNA, 834 bp, Streptomyces hygroscopicus
  CDS (1)..(834)
gtgcggagctggaccagagccaatgtaaacgttgtttccttctcggatgaagtggagttcggcgtgttcgtcaaaagggactatcttcagcgcataggttacgaaggatccggtattccgaaccttcagaccctggcggaacttcagtggctgcatctctgtagcctcccctacgacaccggttacattctgcatcagccgtacgaggattttgacatgccccgcgtattcgaagcggtgatgaaacggggcggagtctgtttcgagttgaatttcctcttccatcgtctccttgtcgagatgggattcgatgcgcatgtgaattccgccagcacggctctccccggcggccagtggggttccgagatcgagcacatggctatccgtgtccgtatagacgacgtggattggctcgtcgacgtcgggcacggaagcgtggccatcacggagcccctgcgtatcgatgaacaggcgggaagcgtggttcagatgggcacggagttccgcttggccacgcggggcgagtggcgcgtccttcaatacaagccaaagggcagggattggcgtgacgcatatcggatgaaaatcaaagatcgtgccatttccgattggaatacatggcgagaagaactgccgcccgacgcggaccctgtggtgccgcggaagcggcgacgcggtgtggagaacgggcaggtgaccctcgtcgccaatctcttcaggtccatcatcgggggcgaggagacggtgaagcacgtacgtgatgaagcagagctgatcgagatcatgactacttactggggagagtccgcacctatcgtcgggtacgaacgatga

SEQ ID NO: 52406 - protein, 277 aa, Streptomyces hygroscopicus
MRSWTRANVNVVSFSDEVEFGVFVKRDYLQRIGYEGSGIPNLQTLAELQWLHLCSLPYDTGYILHQPYEDFDMPRVFEAVMKRGGVCFELNFLFHRLLVEMGFDAHVNSASTALPGGQWGSEIEHMAIRVRIDDVDWLVDVGHGSVAITEPLRIDEQAGSVVQMGTEFRLATRGEWRVLQYKPKGRDWRDAYRMKIKDRAISDWNTWREELPPDADPVVPRKRRRGVENGQVTLVANLFRSIIGGEETVKHVRDEAELIEIMTTYWGESAPIVGYER

SEQ ID NO: 52407 - DNA, 780 bp, Actinosynnema pretiosum
  CDS (1)..(780)
gtgtacgacaccaacacctacctggcccggctcggcgtcgaggtcacccgccccgaccgggccgcgctgaccgcgctgcaccgcgcccacctgcgggcgctgcactacgacaacaccgccgccgccactcaggacggccccgttcccgacaacctcgccgacctggacgtggacgcgaccttcgacgggctcgtcacggccgggcggggcggcatctgcttcgagctgaacctgctgttccaccggctgctcaccgacctcggcttcaccacgaccgtgctgtcggcgggcgtggccgacgaggagggcggcttcagccccgacctggcgcaccggttcaccgccgtgcacctggacggcgaggtgctgctggccgacgtgggcttcgccggaccgtcctacctggacccgatcaggctggccccggacgagcaggtccagcacgggtgcgcgttccgggtggtggagcaggacggcaggcacctcgtgctgcgcaggagccgcaccaccgactggcgcccgctctacgagttcgccaccacccccaggacgctgtccgactgggacggcttcaccccgagactgcgccgctacctggaccgcgcggtgatcgcgggcaccaccctgctgtgccgcgcggtcgacgacggccaccgggccctggtgggcaagcggcacctcgtggtccgtgacggccacgagacggtgaccaccctgctggacccggccgagcacgcgcgcgtgagcgccgagatccgcaccgggatctgcgccgactga

SEQ ID NO: 52408 - protein, 259 aa, Actinosynnema pretiosum
MYDTNTYLARLGVEVTRPDRAALTALHRAHLRALHYDNTAAATQDGPVPDNLADLDVDATFDGLVTAGRGGICFELNLLFHRLLTDLGFTTTVLSAGVADEEGGFSPDLAHRFTAVHLDGEVLLADVGFAGPSYLDPIRLAPDEQVQHGCAFRVVEQDGRHLVLRRSRTTDWRPLYEFATTPRTLSDWDGFTPRLRRYLDRAVIAGTTLLCRAVDDGHRALVGKRHLVVRDGHETVTTLLDPAEHARVSAEIRTGICAD

SEQ ID NO: 52409 - DNA, 873 bp, Mus spretus
  CDS (1)..(873)
atggacattgaagcatactttgaaagaattggttaccagaagtccagcaacaaactggacttgcagacattaactgaaatccttcagcatcagatacgggctattccttttgagaacttgaacatccattgtgggaaaaccatggagctgagcttagaggatacctttcatcaaattgtgaggaagaagcggggagggtggtgtcttcaagtcaaccatcttctctactgggctctgaccatgatagggtttgagaccacaatgttaggaggatgtgtttatgtcccttcagcccgcaagtatagtaacactatgatacaccttctactacaggtgaccatcagtggcaaaacatatattgtagatagtgcattcccattttcctgccagctatgggagcctctggagttgatatctgggaaggatcagcctcaggttcctgccatcttccacctgagagaagagaatggaacctggtacctggaacaaactaaaagacaagaatatgttccaaaccaagaattcattgattctaattttcttgagaagaacacacatcgaaaaatatattcttttactcttgaaccacgaacgattgaagatttccagagtataagtacatactaccaggtatctcaaacatctgtgatgacaaacacatcactttgttccctacataccaaagacggagtccatggcttaatgggcaccattcttgcctataagaagttcaattataaggacaatatagatctggtagagtttaagactctgaaggaagaagaaatagaagaaatcctgaagagtgtttttggaattcacttggagacaaagcttgtgcccaaatgtggcaatgccttttttactatttag

SEQ ID NO: 52410 - protein, 290 aa, Mus spretus
MDIEAYFERIGYQKSSNKLDLQTLTEILQHQIRAIPFENLNIHCGKTMELSLEDTFHQIVRKKRGGWCLQVNHLLYWALTMIGFETTMLGGCVYVPSARKYSNTMIHLLLQVTISGKTYIVDSAFPFSCQLWEPLELISGKDQPQVPAIFHLREENGTWYLEQTKRQEYVPNQEFIDSNFLEKNTHRKIYSFTLEPRTIEDFQSISTYYQVSQTSVMTNTSLCSLHTKDGVHGLMGTILAYKKFNYKDNIDLVEFKTLKEEEIEEILKSVFGIHLETKLVPKCGNAFFTI

SEQ ID NO: 52411 - DNA, 873 bp, Mus spretus
  CDS (1)..(873)
atggacatcgaagcgtactttgaaagaattggttatcagagcaccaggagcaaactggacttgaaaacattaaccgatatccttcagcaccagatacgggctattccctttgagaacttgaacatccattgtggggaatccatggaactgagtttagaagccatctttgatcaaattgtgaggaagaagcggggtggatggtgtctccaggttaatcatctgctgtactgggctctgaccaaaatgggctttgaaaccacaatgctgggaggatatgtctttaacactccagccaataagtacagcagtggcatgattcaccttctagttcaggtcaccatcagtggaaaggactacattgttgatgctgggtttggacgttcctaccagatgtgggagcctctggaattaacatctggaaaggatcagcctcaggtgcctgccatcttccgtttgacagaggagaatggaacctggtatttggaccaaatcagaagagagcagtatgttccaaaccaagaatttattaactcagacctccttgaaaagaacaaataccgaaaaatctattcctttactcttgagccccgaactattgaagattttgagtccatgaatacctaccttcagacatcaccagcgtctgtgtttactagcaaatcattttgttccctgcagaccccagaaggggttcattgtttggttggctccaccctcacttatagaagatttagttacaaggacaacgtcgatcttgtagagtttaagagtctgactgaggaagaaatagaagatgtactgagaacaatatttggggtttctttagagagaaaacttgtgcctaaacatggtgatcgattttttaccatttag

SEQ ID NO: 52412 - protein, 290 aa, Mus spretus
MDIEAYFERIGYQSTRSKLDLKTLTDILQHQIRAIPFENLNIHCGESMELSLEAIFDQIVRKKRGGWCLQVNHLLYWALTKMGFETTMLGGYVFNTPANKYSSGMIHLLVQVTISGKDYIVDAGFGRSYQMWEPLELTSGKDQPQVPAIFRLTEENGTWYLDQIRREQYVPNQEFINSDLLEKNKYRKIYSFTLEPRTIEDFESMNTYLQTSPASVFTSKSFCSLQTPEGVHCLVGSTLTYRRFSYKDNVDLVEFKSLTEEEIEDVLRTIFGVSLERKLVPKHGDRFFTI

SEQ ID NO: 52413 - DNA, 873 bp, Mus spretus
  CDS (1)..(873)
atggacatcgaagcatactttgaaaggattggttacaagaactcagtgaataaattggacttagccacattaactgaagttcttcagcaccagatgcgagcagttccttttgagaatcttaacatgcattgtggagaagccatgcatctggatttacaggacatttttgaccacatagtaaggaagaagagaggtggatggtgtctccaggttaatcatctgctgtactgggctctgaccaaaatgggctttgaaaccacaatgttgggaggatatgtttacataactccagtcagcaaatatagcagtgaaatggtccaccttctagtacaggtgaccatcagtgacaggaagtacattgtggattccgcctatggaggctcctaccagatgtgggagcctctggaattaacatctgggaaggatcagcctcaggtgcctgccatcttccttttgacagaggagaatggaacctggtacttggaccaaatcagaagagagcagtatgttccaaatgaagaatttgttaactcagacctccttgaaaagaacaaatatcgaaaaatctactcctttactcttgagccccgagttatcgaggattttgaatatgtgaatagctatcttcagacatcgccagcgtctgtgtttgtaagcacatcgttctgttccttgcagacctcagaaggggttcgctgcttagtgggctccacctttacaagtaggagattcagctataaggacgatgtagatctggttgagtttaaatatgtgaatgaggaagaaatagaagacgtactgaaaaccgcatttggcatttctttggagagaaagtttgtgcccaaacatggtgaactagtttttactatttag

SEQ ID NO: 52414 - protein, 290 aa, Mus spretus
MDIEAYFERIGYKNSVNKLDLATLTEVLQHQMRAVPFENLNMHCGEAMHLDLQDIFDHIVRKKRGGWCLQVNHLLYWALTKMGFETTMLGGYVYITPVSKYSSEMVHLLVQVTISDRKYIVDSAYGGSYQMWEPLELTSGKDQPQVPAIFLLTEENGTWYLDQIRREQYVPNEEFVNSDLLEKNKYRKIYSFTLEPRVIEDFEYVNSYLQTSPASVFVSTSFCSLQTSEGVRCLVGSTFTSRRFSYKDDVDLVEFKYVNEEEIEDVLKTAFGISLERKFVPKHGELVFTI

SEQ ID NO: 52415 - DNA, 873 bp, Cricetulus griseus
  CDS (1)..(873)
atggacattgacgcgtactttgaaaggattggttatcagaattccaggaacaaactggacttgcaaacattaactgaaatccttcagcaccagatacaaactattccctttgagaacttgaacatccattgtggggaatccatggagctgggcttagagactatctttgatcaaattgtgaagaagaagaggggtgggtggtgtcttcaggttaatcatctcctgtactgggctctgacaaaaatgggctttgaaaccacaatgttgggagggtatgtctttaacactccagctaataagtatagcagtggtatgattcaccttctagtacaggtgaccatcagtgacaggaactacattgttgatgctggatttggacgttccctccagatgtgggagcctctggagttagcctcagggaaggaccagcctcaagtgcctgccatcttccgtttgacagaagagaatgaaacctggtacttggaccaaatcagaagagaacaatatgttccaaaccaagaatttgttaactcagacctccttgagaagaacaaatacagaaagatctattcttttactcttgaaccccgtactattgaggactttgagtccatcaatgcctaccttcagacatcaccagcatccgtgtttacaagcaaatcattttgttctttgcagaccccagaaggggttcactgtttagtgggctgcaccctcacctataggaaattcagttataaggacaatgtagatcttgtggagtttaagagtctgaaggaggaagaaatagaagatgtactcaaaactatatttggcatttctttagagaaaaaacttgtgcccaagcatggtgataggttttttaccatttag

SEQ ID NO: 52416 - protein, 290 aa, Cricetulus griseus
MDIDAYFERIGYQNSRNKLDLQTLTEILQHQIQTIPFENLNIHCGESMELGLETIFDQIVKKKRGGWCLQVNHLLYWALTKMGFETTMLGGYVFNTPANKYSSGMIHLLVQVTISDRNYIVDAGFGRSLQMWEPLELASGKDQPQVPAIFRLTEENETWYLDQIRREQYVPNQEFVNSDLLEKNKYRKIYSFTLEPRTIEDFESINAYLQTSPASVFTSKSFCSLQTPEGVHCLVGCTLTYRKFSYKDNVDLVEFKSLKEEEIEDVLKTIFGISLEKKLVPKHGDRFFTI

SEQ ID NO: 52417 - DNA, 873 bp, Homo sapiens
  CDS (1)..(873)
atggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttatatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcaaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttag

SEQ ID NO: 52418 - protein, 290 aa, Homo sapiens [sequence omitted]

SEQ ID NO: 52419 - DNA, 873 bp, Homo sapiens
  CDS (1)..(873)
atggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccactgacggcaggaattacattgtcgatgctgggtctggaagctcctcccagatgtggcagcctctagaattaatttctgggaaggatcagcctcaggtgccttgcattttctgcttgacagaagagagaggaatctggtacttggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatagatcccttactatttag

SEQ ID NO: 52420 - protein, 290 aa, Homo sapiens [sequence omitted]

SEQ ID NO: 52421 - DNA, 873 bp, Gallus gallus
  CDS (1)..(873)
atgaatcttgaagagtattttgcaagaactgggtataaaggttcccttgaaaatcaagacttggaaaccttaactgatatattccagcaccacatccgtgctgttccatttgaaaacctcagcatccattgtggggagaaaattactttggagctggagcacgtttataacaaaattgtgcacaagaagcgtggtggttggtgcatggaaaataaccagctgttgggttgggtcctgaaatgcctgggctatgacaccagctttttgggagcatacgtcttcaatccacatgaaaacgcatatgccaccatcatgacccatctcctagtgaaggtggttattgagggaaaagcctacattgttgatgcgggcttcggtgtatcctaccaaatgtggcaaccgatggagcttgtatcagggaaagaccagccccaggctcctggcatctttcgcttcacagaaaagaatgccatctggtaccttgagaaaatgagacggaaacaatatatccccaatcaaaatttctctaattctgatcttctagagaaaaaagactgtcggaaagtgtatatgttcagtctggaaccacggacagtggaagatttctgttttcagtgcacgtaccttcagacgtctccagattccctctttacaaagaagtccatctgcacccttcagaccaccgatggctttcgagcgctcattggatggacgctcaccgagaccaaatacaattacaaggaaaacatggatctggtggaatttataacccttaaagacgaagaggtggagaagacactgaaagataaattcaacatcaccctagagagaaagctcgtcccaattaacgtcaaaggattttatacaatctag

SEQ ID NO: 52422 - protein, 290 aa, Gallus gallus
MNLEEYFARTGYKGSLENQDLETLTDIFQHHIRAVPFENLSIHCGEKITLELEHVYNKIVHKKRGGWCMENNQLLGWVLKCLGYDTSFLGAYVFNPHENAYATIMTHLLVKVVIEGKAYIVDAGFGVSYQMWQPMELVSGKDQPQAPGIFRFTEKNAIWYLEKMRRKQYIPNQNFSNSDLLEKKDCRKVYMFSLEPRTVEDFCFQCTYLQTSPDSLFTKKSICTLQTTDGFRALIGWTLTETKYNYKENMDLVEFITLKDEEVEKTLKDKFNITLERKLVPINVKGFYTI

SEQ ID NO: 52423 - DNA, 873 bp, Homo sapiens
  CDS (1)..(873)
atggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttag

SEQ ID NO: 52424 - protein, 290 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 52425 - DNA, 873 bp, Mesocricetus auratus
  CDS (1)..(873)
atggacatcgaagcctatttcgaaaggatcggttataacaacccagtctatacattggatttggccacactaaccgaagttcttcagcaccagatgcgaacaattccttttgagaatctcaacatgcactgtggagaagccatggacctgggcttagaggctacttttgatcaaattgtgcggaagaagcggggcgggtggtgtctccaggttaatcatctcctgtactgggctctgacccaaatgggctttgaaaccaccatgttgggaggatatgtttacatagtgcctgtcagtaagtacagcagtgagatgattcaccttctagtgcaggtgaccatcagtgacaggaactacattgttgatgctgcctatggaggctcctaccagatgtgggagcctgtagaattagcatcagggaaggaccagcctcaggtgcctgccatcttccgtttgacagaagagaacgaaacctggtacttggaccaaatcagaagagagcagcatgttccaaaccaagaatttgtcaactcggacctccttgagaagaacacatatcgaaagatctattcttttactctccaaccccgcactatcgaggattttgaatatgcgaatacctaccttcagatatctccagtatctgtgtttgtaaacacatcattttgttccttgcaaacctcagaaggggtttgctgcttaataggctccactattgcgaggaggaaattcagttataaggaaaatgtagatctggtggagtttaagaatgtgagtgaggaagaaatagaagatgtgctgaaaactgcgtttggtgtttctttagagagaaagtttgtgcccaaaaatggtaacctatcttttagtatttag

SEQ ID NO: 52426 - protein, 290 aa, Mesocricetus auratus
MDIEAYFERIGYNNPVYTLDLATLTEVLQHQMRTIPFENLNMHCGEAMDLGLEATFDQIVRKKRGGWCLQVNHLLYWALTQMGFETTMLGGYVYIVPVSKYSSEMIHLLVQVTISDRNYIVDAAYGGSYQMWEPVELASGKDQPQVPAIFRLTEENETWYLDQIRREQHVPNQEFVNSDLLEKNTYRKIYSFTLQPRTIEDFEYANTYLQISPVSVFVNTSFCSLQTSEGVCCLIGSTIARRKFSYKENVDLVEFKNVSEEEIEDVLKTAFGVSLERKFVPKNGNLSFSI

SEQ ID NO: 52427 - DNA, 873 bp, Oryctolagus cuniculus
  CDS (1)..(873)
atggatattgaagcatattatcaaagaattggttacaaaaacccaaggaacaaattggacttggaatcactaacagacatttttcagcaccagatccgaactgttccctatgagaaccttagcattcactgtggggagtccatggagttggacttagaggccatttttgatcaaattgtgaggaggaatagaggtggctggtgtctccaggtcaactatcttttgtactgggctttgactaccactggttttgagaccacaatgttaggagggtttgtttgcggcagtcatactgacaaatacagcactggcatgattcacctcatagtacaggtgaccatcaatggcaggaactacattgtcgatgctgggtttggacgctcctaccagatgtggcagcctgtggagttaatttctgggaaagatcagcctcaagtgccttccatattccgcttgagagaagagggagaaacctggtacctggaccaaatcagaagacagcaacatgttccagaccaagaatttcttaattctgaacttctggaaaggaaaacacaccgaaaactctattgctttactcttcaacctcgaacaattgaagaatttgagtctgcaaacacatatcttcaaatatctccatcatctccatttttagacaaatcaatttgttccttgcagaccccagaaggtgttcactgtttggtgggtctcatcctcaccttcaggacctacaattacaaggaaaatacagatctggtagagtttaaagttctgactgaggaagaagtggaggaagtgctgaaaactatatttaatatttccttgggaaaaaagcttgtgtccaaaaatggtaatttgtttttcactatttag

SEQ ID NO: 52428 - protein, 290 aa, Oryctolagus cuniculus
MDIEAYYQRIGYKNPRNKLDLESLTDIFQHQIRTVPYENLSIHCGESMELDLEAIFDQIVRRNRGGWCLQVNYLLYWALTTTGFETTMLGGFVCGSHTDKYSTGMIHLIVQVTINGRNYIVDAGFGRSYQMWQPVELISGKDQPQVPSIFRLREEGETWYLDQIRRQQHVPDQEFLNSELLERKTHRKLYCFTLQPRTIEEFESANTYLQISPSSPFLDKSICSLQTPEGVHCLVGLILTFRTYNYKENTDLVEFKVLTEEEVEEVLKTIFNISLGKKLVSKNGNLFFTI

SEQ ID NO: 52429 - DNA, 873 bp, Rattus norvegicus
  CDS (1)..(873)
atggacatcgaagcatacttcgaaaggattggttacaagaactcagtgaataagttggacttggccacattaactgaagttcttcaacaccagatgcgagcagttccttttgagaatcttagtatgcactgtggagaagccatgtgtctgggcttagaggccacttttgaccacatagtaaggaaaaagcggggtgggtggtgtctccaggttaatcatctgctgtactgggctctgaccaaaatgggttttgaaaccacaatgttgggaggatatgtttacataactccagtcaacaaatatagcagtgaaatggtccaccttctagtacaagtgaccatcagtgacaggaactacattgtggattctgcctatggaagctcctaccagatgtgggagcctctggaattaacctcagggaaggatcagcctcaggtgcctgccatctttcgtttgacagaagagaatggaacctggtacttggaccaaatcagaagagagcaggatgttccaaaccaagagtttgttaactcggacctccttgaaaagagcaaatatcgaaaaatctattcctttactcttgagccccgcactattgaggattttgaatatgtgaatacctaccttcagacatcgccagcctctgtgtttgtaagcacatcgttctgttccttgcagacctcagaaggggtttgctgtttaattggttccacccttacaagtaggagattcagttataaggacaatgtagatctggttgagtttaagagtctgactgaggaagaaatagaagatgtactgaaaaccacatttggcatttctttggagaaaaagtttgtgcccaaacatggcgaactcgtttttactatttag

SEQ ID NO: 52430 - protein, 290 aa, Rattus norvegicus
MDIEAYFERIGYKNSVNKLDLATLTEVLQHQMRAVPFENLSMHCGEAMCLGLEATFDHIVRKKRGGWCLQVNHLLYWALTKMGFETTMLGGYVYITPVNKYSSEMVHLLVQVTISDRNYIVDSAYGSSYQMWEPLELTSGKDQPQVPAIFRLTEENGTWYLDQIRREQDVPNQEFVNSDLLEKSKYRKIYSFTLEPRTIEDFEYVNTYLQTSPASVFVSTSFCSLQTSEGVCCLIGSTLTSRRFSYKDNVDLVEFKSLTEEEIEDVLKTTFGISLEKKFVPKHGELVFTI

SEQ ID NO: 52431 - DNA, 873 bp, Gallus gallus
  CDS (1)..(873)
atggacatcaaggagtattttgccagaatttcttatggaggctcctatgaaaaaccagacctggaaaccttgacggaaatattccagcaccacatccaagcagttccttttgagaatctcagcattcactgtggggaaaccattgagctggacctagcagccacttacgacaagatagtgaggaagaaacgtgggggctggtgcatggagaacaaccacctcttatcttgggccctgaaaaccctagggtacaacgtcacccttttgggagcaaaagtatacatcccggagcacgatgcatatgctgatgacattgatcatctgttgctaaaagtggtgcttcatgacaaatcctacattgtggatggcggttttgggatggcctaccagctatggcagccgatggagctgatttcagggaaagatcagcctcagacgcccggcatcttccgcttcgtagaagagaatgggacctggtaccttgagaaggtgaaaaggaagcagtacgttcccaaccacagcgactccgctcctcataacgtagacaaagaagtttgccgtcgagtttatctcttcaccctccagccacgagacatagaagagttcagagccagaaatctacacctgcagactgcaccagactcactttttgttactaagtccatttgcagcctgcagacccccgatggggtccgggcactcgttggatggaagcttactgagataaagtacaattataaggataacatggatctggtggagatcagaatccttgcagatgaagaaatggagaaaacattgaaggagaaattcaatataacattagataagaaatttgtacccatcaatacaagcaggctgtctctgttttaa

SEQ ID NO: 52432 - protein, 290 aa, Gallus gallus
MDIKEYFARISYGGSYEKPDLETLTEIFQHHIQAVPFENLSIHCGETIELDLAATYDKIVRKKRGGWCMENNHLLSWALKTLGYNVTLLGAKVYIPEHDAYADDIDHLLLKVVLHDKSYIVDGGFGMAYQLWQPMELISGKDQPQTPGIFRFVEENGTWYLEKVKRKQYVPNHSDSAPHNVDKEVCRRVYLFTLQPRDIEEFRARNLHLQTAPDSLFVTKSICSLQTPDGVRALVGWKLTEIKYNYKDNMDLVEIRILADEEMEKTLKEKFNITLDKKFVPINTSRLSLF

SEQ ID NO: 52433 - DNA, 873 bp, Homo sapiens
  CDS (1)..(873)
atggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttag

SEQ ID NO: 52434 - protein, 290 aa, Homo sapiens
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLKNIFKISLGRNLVPKPGDGSLTI

SEQ ID NO: 52435 - DNA, 873 bp, Mesocricetus auratus
  CDS (1)..(873)
atggacattgaagcatactttgaaaggattggttatcagaactccaggaacaaactggacttgcaaacattaactgaaatccttcagcaccagatacgagctattccctttgagaacttgaacatccattgtggggaatccatggaactgagcttagagaccatctttgatcaaattgtgcggaagaagaggggtgggtggtgtctccaggttaatcatctcctgtactgggctctgaccaaaatgggctttgaaaccacaatgttgggagggtatgtctttaacactccagctaataagtacagcagtggtatgattcaccttctagtacaggtgaccatcagtgataggaactacattgttgatgctgggtttggacgttccctccaaatgtgggagcctcttgaattagtatcaggaaaggaccatcctcaagttcctgccatcttccgtttgacagaagagaatgaaacctggtacttggaccaaatcagaagagaacagtatgttccaaatcaagcatttgttaactcggacctccttgagaagaacaaatatagaaagatctattcttttactcttgaaccccgtactattgaggactttgagtctatgaatacctaccttcagacatcgccagcatctgtatttacaagcaaatcattttgttctttgcagaccccagaaggggttcactgtttagtgggctgcaccctcacctataggcgattcagttacaaggacaatgtagatcttgtagagttcaagagtctgaaggaggaagaaatagaagatgtgctgaaaactatatttggcatttctttagagaaaaaacttgtgcccaaacatggtgatagattttttaccatttag

SEQ ID NO: 52436 - protein, 290 aa, Mesocricetus auratus
MDIEAYFERIGYQNSRNKLDLQTLTEILQHQIRAIPFENLNIHCGESMELSLETIFDQIVRKKRGGWCLQVNHLLYWALTKMGFETTMLGGYVFNTPANKYSSGMIHLLVQVTISDRNYIVDAGFGRSLQMWEPLELVSGKDHPQVPAIFRLTEENETWYLDQIRREQYVPNQAFVNSDLLEKNKYRKIYSFTLEPRTIEDFESMNTYLQTSPASVFTSKSFCSLQTPEGVHCLVGCTLTYRRFSYKDNVDLVEFKSLKEEEIEDVLKTIFGISLEKKLVPKHGDRFFTI

SEQ ID NO: 52437 - DNA, 873 bp, Mus musculus
  CDS (1)..(873)
atggacatcgaagcgtactttgaaagaattggttatcagagcaccaggagcaaactggacttgaaaacattaaccgaaatccttcagcaccagatacgggctattccctttgagaatttgaacatccattgtggggaatccatggaactgagtttagaagccatctttgatcaaattgtgaggaagaagcggggtggatggtgtctccaggttaatcatctgctgtactgggctctgaccaaactgggctttgaaaccacaatgctgggaggatatgtctttaacactccagccaataagtacagcagtggcatgattcaccttctagttcaggtcaccatcagtggaaaggactacattgttgatgctgggtttggacgttcctaccagatgtgggagcctctggaattaacatctggaaaggatcagcctcaggtgcctgccatcttccgtttgacagaggagaatggaacctggtacttggaccaaatcagaagagagcagtatgttccaaaccaagaatttattaactcagatctccttgaaaagaacaaataccgaaaaatctattcctttactcttgagccccgaactattgaagattttgagtccatgaatacctaccttcagacatcaccagcgtctgtgtttactagcaaatcattttgttccctgcagaccccagaaggagttcattgtttggttggctccaccctcacttatagaagatttagttacaaggacaacgtcgatcttgtagagtttaagagtctgactgaggaagaaatagaagatgtactgagaactatatttggggtttctttagagagaaaacttgtgcctaaacatggtgatcgattttttaccatttag

SEQ ID NO: 52438 - protein, 290 aa, Mus musculus
MDIEAYFERIGYQSTRSKLDLKTLTEILQHQIRAIPFENLNIHCGESMELSLEAIFDQIVRKKRGGWCLQVNHLLYWALTKLGFETTMLGGYVFNTPANKYSSGMIHLLVQVTISGKDYIVDAGFGRSYQMWEPLELTSGKDQPQVPAIFRLTEENGTWYLDQIRREQYVPNQEFINSDLLEKNKYRKIYSFTLEPRTIEDFESMNTYLQTSPASVFTSKSFCSLQTPEGVHCLVGSTLTYRRFSYKDNVDLVEFKSLTEEEIEDVLRTIFGVSLERKLVPKHGDRFFTI

SEQ ID NO: 52439 - DNA, 873 bp, Oryctolagus cuniculus
  CDS (1)..(873)
atggatattgaagcatattatcaaagaattggttacaaaaacccaaggaacaaattggacttggaatcactaacagacatttttcagcaccagatccgaactgttccctatgagaaccttagcattcactgtggggagtccatggagttggacttagaggccatttttgatcaaattgtgaggaggaatagaggtggctggtgtctccaggtcaactatcttttgtactgggctttgactaccaccggttttgagaccacaatgttaggagggtttgtttatggcagtaataatgacaaatacagcactggcatgattcacctcatagtacaggtgaccatcaatggcaggaactacattgtcgatgctgggtttggacgctcctaccagatgtggcagcctgtggagttaatttctgggaaagatcagcctcaagtgccttccatattccgcttgagagaagagggagaaacctggtacctggaccaaatcagaagacagcaacatgttccagaccaagaatttcttaattctgaactcctggaaaagaaaatataccaaaaactctactgctttactcttcaacctcgaacaattgaagaatttgagtctgcaaacacatatcttcaagaatccccatcatctgtgtttttagacaaatcaatttgttccttgcagaccccagaaggtgttcactgtttggtgggcctcaccctcacctccaggacctacaattataaggaaaatacagatctggtagagtttaaagttctgactgaggaagaagtggagggagtgctgaaaactatatttaatatttccttgggaaaaaagcttgtgtccaaaaatggtcatttgtctttcactatttag

SEQ ID NO: 52440 - protein, 290 aa, Oryctolagus cuniculus
MDIEAYYQRIGYKNPRNKLDLESLTDIFQHQIRTVPYENLSIHCGESMELDLEAIFDQIVRRNRGGWCLQVNYLLYWALTTTGFETTMLGGFVYGSNNDKYSTGMIHLIVQVTINGRNYIVDAGFGRSYQMWQPVELISGKDQPQVPSIFRLREEGETWYLDQIRRQQHVPDQEFLNSELLEKKIYQKLYCFTLQPRTIEEFESANTYLQESPSSVFLDKSICSLQTPEGVHCLVGLTLTSRTYNYKENTDLVEFKVLTEEEVEGVLKTIFNISLGKKLVSKNGHLSFTI

SEQ ID NO: 52441 - DNA, 873 bp, Rattus norvegicus
  CDS (1)..(873)
atggacattgaagcatactttgaaagaattggttatcagagttccaggaacaaactggacttggaagaattaactgaaattcttcaacaccagatacgggctattccctttgaaaacttgaacatccattgcggggaatccatggagctgaatttagaagtcatctttgatcaagttgtgaggaagaagcgtggtggatggtgtctccaggttaatcatctgctgtactgggctctgaccaaaatgggctttgaagccacaatgttgggagggtatgtctttaacactccagccaataagtacagcagtggcatgattcacttactagtgcaggtgaccctcagtggaaaggactacattgttgatgctgggtttggacgttcctaccagatgtgggagcctctggaattaacatcagggaaggatcagcctcaggtgcctgccatctttcgtttgacagaagagaatggaacctggtacttggaccaaatcagaagagagcagtatgttccaaaccaagagtttgttaactcagacctccttgaaaagaacaaatatcgaaaaatctattcctttactcttgagccccgcactattgaggattttgagtccattaatacctatcttcagacatcgccagcatccttgtttacaagtaaatcattttgttccttgcagaccctagaaggggttcactgtttggttggctccaccctcacttataggagattcagttataaggacaatatagatcttgtagagtttaagagtctgactgaggaagaaatagaagacgtactgaaaactatatttggggtttctttagagagaaagcttgtgcctaaacatggtgatcgattttttaccatttag

SEQ ID NO: 52442 - protein, 290 aa, Rattus norvegicus
MDIEAYFERIGYQSSRNKLDLEELTEILQHQIRAIPFENLNIHCGESMELNLEVIFDQVVRKKRGGWCLQVNHLLYWALTKMGFEATMLGGYVFNTPANKYSSGMIHLLVQVTLSGKDYIVDAGFGRSYQMWEPLELTSGKDQPQVPAIFRLTEENGTWYLDQIRREQYVPNQEFVNSDLLEKNKYRKIYSFTLEPRTIEDFESINTYLQTSPASLFTSKSFCSLQTLEGVHCLVGSTLTYRRFSYKDNIDLVEFKSLTEEEIEDVLKTIFGVSLERKLVPKHGDRFFTI

SEQ ID NO: 52443 - DNA, 864 bp, Gallus gallus
  CDS (1)..(864)
atgaacattcaagagtatttctcaagaatttcttttgatggctcccataaggatgcagacttgcaaaccttaacagccatcttccagcatcacatccaggcgattccttttgaaaacctcagcatgcattgcggagagaccattgacctggatttgcaagctacttacaataaaattgtgaaaaagaaacgcggtggatggtgcatggaaacaaactaccttttattttgggccttgaaagaaatggggtatgacatctgtgtgcttggaggaaatagttatgagccagcaaagaaggcgtacactgatgaaataaatcacatcctactgaaggttgtgatcaagggaagttcctacatagtagatgctggttttggtggcggtccctaccaaacgtggctgccaatgttgctgatttctgggaaggatcaaccccagattccgggcatcttccgcttcatagaagacaatggcatctggtacttggagaaagtcaagaggaaacattatgttccagagggaagcgttcctctcactgataatccagaaatgggcaatatcagaaaactatattcatttactctggagccaaaacatatagatgacttccaggagctaaatgcatacctacaggtggctccagataccatacttcagaagaagtcaatctgcagcctccagaccactgatgggttttatgccttagttggatggaccttctctgagatgaagtacaagtacaaggaggacgcagacctgctgcagaccacaaccctcacagatgaagaggttgagaagacactgaaagacaagttcaacatagtgttagagaacaaactgataccagtaaatgttcgtggctag

SEQ ID NO: 52444 - protein, 287 aa, Gallus gallus
MNIQEYFSRISFDGSHKDADLQTLTAIFQHHIQAIPFENLSMHCGETIDLDLQATYNKIVKKKRGGWCMETNYLLFWALKEMGYDICVLGGNSYEPAKKAYTDEINHILLKVVIKGSSYIVDAGFGGGPYQTWLPMLLISGKDQPQIPGIFRFIEDNGIWYLEKVKRKHYVPEGSVPLTDNPEMGNIRKLYSFTLEPKHIDDFQELNAYLQVAPDTILQKKSICSLQTTDGFYALVGWTFSEMKYKYKEDADLLQTTTLTDEEVEKTLKDKFNIVLENKLIPVNVRG

SEQ ID NO: 52445 - DNA, 828 bp, Mycobacterium smegmatis
  CDS (1)..(828)
atggcgatggacctcggcggatatctcacgcggatcggcctcgacgggcggccacgtcccgatctcggcacattgcacgcgatcgtcgcggcccacaaccgctcgatcccgttcgagaacctcgacccgctgctcggcatcccggtggccgacctgagtgccgaggccctgttcgccaagctcgtggaccgccgccgtggcgggtactgctacgaacacaacggcctgctcggctacgtactggaggaactgggcttcgaggtggagcgcctgtccggacgggtggtttggatgcgggccgacgacgcaccactgcccgcccagacccacaacgtgctgtcggtcgcggtgccgggcgccgacggccggtacctggtcgacgtgggcttcggcggacagacgctgacctcgccgatccggcttgaggccggcccggtgcagcagacccgccacgagccctaccggctcacccggcacggtgacgaccacacgctggcggcccaggtccgcggtgagtggcaaccgctgtacacgttcaccaccgagccgcggccgcgcatcgacctcgaggtcggaagctggtacgtctcaacgcatccgggatcgcacttcgtgaccggactcacggtcgcggtggtcaccgacgacgcgcggtacaacctgcggggacgcaatctggcggttcaccggtccggtgcgaccgagcacatccggttcgacagcgcggcacaggtgctcgacgccatcgtcaaccggttcggcatcgacctcggcgatctggccggccgtgacgtccaggcacgtgtcgccgaggtgctcgacacctga

SEQ ID NO: 52446 - protein, 275 aa, Mycobacterium smegmatis
MAMDLGGYLTRIGLDGRPRPDLGTLHAIVAAHNRSIPFENLDPLLGIPVADLSAEALFAKLVDRRRGGYCYEHNGLLGYVLEELGFEVERLSGRVVWMRADDAPLPAQTHNVLSVAVPGADGRYLVDVGFGGQTLTSPIRLEAGPVQQTRHEPYRLTRHGDDHTLAAQVRGEWQPLYTFTTEPRPRIDLEVGSWYVSTHPGSHFVTGLTVAVVTDDARYNLRGRNLAVHRSGATEHIRFDSAAQVLDAIVNRFGIDLGDLAGRDVQARVAEVLDT

SEQ ID NO: 52447 - DNA, 783 bp, Amycolatopsis mediterranei
  CDS (1)..(783)
gtgaacgtgttcgacgtggagacctacctccagcggatcggctgcggcggggaaaccggcgtggacctcgaaacgctggcgaagctgcagaagagccacctgatggcgatcccgtacagcagcctcgcctacgaactccgggacgcggtgaacgtcgtcgacctcgacgaggacgacgtcttcgtcaccagcatcgccgaagggcagggcggcgcctgctaccacctgaaccggctgttccaccggctcctgaccgaactcggctacgacgtcacgccgctggccggcagcaccgccgaaggccgggagaccttcggcaccgacgtcgagcacatgttcaacctggtcaccctggacggcgccgactggctcgtggacgtcggctaccccggccccacctacgtcgagccactggcggtctcgcccgcggtgcagacccagtacgggagccagttccggttggtggaacaggaaaccggttatgcgctgcaacgccggggtgcggtcacccgctggagcgtcgtctacacgttcacgacgcaaccgcgtcagtggagtgactggaaggaactggaggacaacttccgggccctcgtgggggacaccacccgcaccgacacgcaggaaaccctgtgcggccgcgcgttcgcgaacggccaggtcttcctgcggcagcgccgctacctgacggtcgagaacggccgcgagcaggtgcgcacgatcaccgacgacgacgagttccgggcgctggtgtcccgcgtgctgtccggcgaccacggctga

SEQ ID NO: 52448 - protein, 260 aa, Amycolatopsis mediterranei
MNVFDVETYLQRIGCGGETGVDLETLAKLQKSHLMAIPYSSLAYELRDAVNVVDLDEDDVFVTSIAEGQGGACYHLNRLFHRLLTELGYDVTPLAGSTAEGRETFGTDVEHMFNLVTLDGADWLVDVGYPGPTYVEPLAVSPAVQTQYGSQFRLVEQETGYALQRRGAVTRWSVVYTFTTQPRQWSDWKELEDNFRALVGDTTRTDTQETLCGRAFANGQVFLRQRRYLTVENGREQVRTITDDDEFRALVSRVLSGDHG

SEQ ID NO: 52449 - DNA, 765 bp, Bacillus subtilis
  CDS (1)..(765)
gtgataaaaatgagtgactttctaaaagactgctttcagaaaatcggctgggagaaagaccatgtcagcttcggcgatcttcccctttttcttaaagcaatggcataccgttttccattcgaaaaccgtgccgtacttgcaaaagagaattataagatcacaaaagaagagctatggcgacgtctgctcaaagatcagcacggcggcctatgctacgatctaaatggtttcctttattttgtcttgcgtgaggccgggtttcatgtgaagctcattcgaggaacggtttatgcaggcgatcaagagggatgggcactagaagggacgcatgctgctgtatggctgtctgcggaaaacggcgattacctcgttgatatcggcttcggcatcaacctggcgctccagccgataccgctttccggagaaacggtacagtcaccagtcgggtcattccgaatcaaaaaggaagagacagaaaagggcagctatgttctgctgatggacaaaggagaaggctggcaaattgggtacgcctttacccttgaagagagtgatctcggtgatttagataacatgaaggacatcattcactctcatgaaaaatctccttttaacaaatccctgcttgcctcaaagctgacgccgagcggaaggatggtcatgtcagagcgccattttacgatttatgaaaacggcggtaacattcaaaaaagcgacatcggcccttcaggatttgaagagaaattaaatactcattttttgtaa

SEQ ID NO: 52450 - protein, 254 aa, Bacillus subtilis
MIKMSDFLKDCFQKIGWEKDHVSFGDLPLFLKAMAYRFPFENRAVLAKENYKITKEELWRRLLKDQHGGLCYDLNGFLYFVLREAGFHVKLIRGTVYAGDQEGWALEGTHAAVWLSAENGDYLVDIGFGINLALQPIPLSGETVQSPVGSFRIKKEETEKGSYVLLMDKGEGWQIGYAFTLEESDLGDLDNMKDIIHSHEKSPFNKSLLASKLTPSGRMVMSERHFTIYENGGNIQKSDIGPSGFEEKLNTHFL

SEQ ID NO: 52451 - DNA, 24 bp, Primer
atgacgcccattctgaatcactat

SEQ ID NO: 52452 - DNA, 22 bp, Primer
ttattttcccgcctccgggtgc

SEQ ID NO: 52453 - protein, 311 aa, consensus
  MISC_FEATURE (1)..(311): consensus for the disclosure of xaa see table XV
LXXXXXXXXXXXPXENXXXXXXXXXXXXXXXXXXXXXXXXXXXXXXXXRGGXCXXXNXXXXXXLXXXGXXXXXXXXXVXXXXXXXXXXXXXXXXXXXXXXHXXXXXXXXXXXXXXXXXXXXXXXDXGFGXXXXXXXXXXXXXXXXXXXXXXXXXXXXXXXXXXXXXXXXXXXXXXXXXXXXXXXXXXXXXXXXXXXXXXXXXYXFXXXXXXXXXXXXXXXXXXXXXXXXXSXFXXXXXXXXXXXXXXXXXXXXXXXXXXXXXXXXXXXXXXXXXXXXXXXXXXXXXXXXXXXXXXXXXXXXXXXXXLXXXF

SEQ ID NO: 52454 - protein, 129 aa, consensus
  MISC_FEATURE (1)..(129): consensus for the disclosure of xaa see table XV
XXXXXXXXXXXXPXXXXXXXXXXXXXXXXXXXXXXXXXXXXXXXXXXXXGGXCXXXNXXXXXXLXXXGXXXXXXXXXXXXXXXXXXXXXXXXXXXXXXXXHXXXXXXXXXXXXXXXXXXXXXXXXXXXX

SEQ ID NO: 52455 - DNA, 1071 bp, Escherichia coli K12
  CDS (1)..(1071)
atgatgagtcagaagtatctttttatcgatcgcgatggaaccctgattagcgaaccgccgagtgattttcaggtggaccgttttgataaactcgcctttgaaccgggcgtgatcccggaactgctgaagctgcaaaaagcgggctacaagctggtgatgatcactaatcaggatggtcttggaacacaaagtttcccacaggcggatttcgatggcccgcacaacctgatgatgcagatcttcacctcgcaaggcgtacagtttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcgcgaccgacattcaactggcggaaaacatgggcattactggtttacgctacgaccgcgaaaccctgaactggccaatgattggcgagcaactcaccagacgtgaccgttacgctcacgtagtgcgtaataccaaagagacgcagattgacgttcaggtgtggctggatcgtgaaggtggcagcaagattaacaccggcgttggcttctttgatcatatgctggatcagatcgctacccacggcggtttccgcatggaaatcaacgtcaaaggcgacctctatatcgacgatcaccacaccgtcgaagataccggcctggcgctgggcgaagcgctaaaaatcgccctcggagacaaacgcggtatttgccgctttggttttgtgctaccgatggacgaatgccttgcccgctgcgcgctggatatctctggtcgcccgcacctggaatataaagccgagtttacctaccagcgcgtgggcgatctcagcaccgaaatgatcgagcacttcttccgttcgctctcatacaccatgggcgtgacgctacacctgaaaaccaaaggtaaaaacgatcatcaccgtgtagagagtctgttcaaagcctttggtcgcaccctgcgccaggccatccgcgtggaaggcgataccctgccctcgtcgaaaggagtgctgtaa

SEQ ID NO: 52456 - protein, 356 aa, Escherichia coli K12
MMSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGITGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 52457 - DNA, 1068 bp, Yersinia pestis
  CDS (1)..(1068)
atgagccagaaatttctttttattgaccgcgacggcaccatcattgccgagccaccaactgattatcaggttgaccggttggataaactggcgctggagcctgatgtcattcccgcattactggcgttgcaaaaagcagactacaaactggtgatgatcactaatcaggatggcctcggcaccagcagtttcccgcaggaaaccttcgatccgccacataacctgatgatgcaaatcctgacgtctcaggggatcaattttgaacagatactgatttgcccacatctgccagaggataactgcacctgtcgcaaaccgaaaaccgcgctggtagaaagctatctggcagatggcgtgatgaacagcaccaatagctatgtcatcggtgaccgtgaaactgacctacaactggccgagaacatgggcatcagcgggttacgttatcagcgtgatggcttgaactggacgcaaattgccaaacaactgacccagcgcgaccgccacgcctatgttaatcgcgtgaccaaagaaaccgccattgacgttaatgtttggctggatcgcgaagggggaagcaaaattaaaaccggcgtgggcttcttcgaccatatgctggatcaaatcgccacccacggcggttttcgcatggatattcaggtcagcggcgatctgtatatcgatgatcaccacacagtggaagataccgcgctggcactgggcgaagcgatcaacatcgcactgggtgacaaacggggtattggccgctttggttttgtattgccgatggatgagtgcctggcacgctgtgccttggatatttctggtcgcccgcatttggaatacaaagctgaatttaactaccagcgtgtcggcgatctaagcaccgagatggtcgagcacttcttccgctccctttcgtatgccatggcctgtaccttgcacctgaaaaccaaaggtcgcaacgatcatcaccgagtagaaagcctgtttaaagtatttggtcgtaccttgcgtcaagccattcgcgttgaaggcaataccctgccaagttcaaaaggagtgctgtaa

SEQ ID NO: 52458 - protein, 355 aa, Yersinia pestis
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSTNSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 52459 - DNA, 1068 bp, Salmonella enterica subsp. enterica serovar Typhi
  CDS (1)..(1068)
atgagtcagaagtatcttttcatcgaccgggacggaaccttaatttccgaaccgccgagcgattttcaggtagaccactttgataaactggcctttgagccagaggtgattcccgtattgctgaagctgcaaaaagccggttttaagctggtgatgatcactaaccaggatggacttggcacgcaaagcttcccgcaggcggacttcgacggaccgcacaacctgatgatgcagattttcacttctcagggcgtatgctttgatgaggtgctgatctgccctcacctgcccgcagacgactgcgactgccgcaagcccaaagtgaagctggtggagcgttatcttgcggaacaagcgatggatagcgccaacagctatgtgattggcgatcgtgcaaccgatatccaactcgctgataatatgggcattactggtttacgctatcaccgtgaaacgttgaactggacgatgattggcgaacagctaacgaaacgcgatcgctatgcgcatgtggtccgcaacaccaaagagacacagattgatgtcagcgtctggctggatcgcgaaggcaacagcaagattaataccggcgtcggcttctttgaccatatgctcgatcaaatcgccacccacggcggctttcgcatggagattaccgttaagggcgatctctatatcgacgatcaccacacggtagaagataccgggctggcgctcggtgaggcgttaaaactggcactcggcgacaagcgcggtatctgccgttttggctttgtactaccgatggatgaatgtctggcgcgctgcgcgctggatatttccggtcgtccgcatctggaatataaagctgaatttacctaccagcgtgtgggcgatttgagcacagagatgattgaacactttttccgctcactctcttacacgatgggcgtcactctgcatctcaagactaaaggtaagaacgatcaccaccgtgtcgaaagtttgtttaaagcctttggtcggacgctacgccaggctattcgcgtggagggcgatacattaccgtcctcgaaaggagtgctgtga

SEQ ID NO: 52460 - protein, 355 aa, Salmonella enterica subsp. enterica serovar Typhi
MSQKYLFIDRDGTLISEPPSDFQVDHFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 52461 - DNA, 1074 bp, Vibrio cholerae
  CDS (1)..(1074)
atgagcaaacaacaaaaaattctttttatcgaccgcgacggcaccttaattgttgagccgccagtggattttcaagttgaccgtttggacaaactcaaacttgagccttatgtgatcccaagcctgctcaagctacaagaggcgggttatcgtttggtgatggtgaccaatcaggatggtttaggcacttcaagctacccgcaagcggatttcgatgcgccgcataacatgatgatggacatttttgaatcgcaaggcgtgaagtttaatgatgtgctgatttgcccgcactttgagcgtgataactgttcgtgccgcaaaccgaaacttggcttggtcaaagagtatctgcaaggtggcaaagtcgatttcaaatcgtcagccgtgattggcgatcgcatgaccgatctgcaactggctgaaaatatggcgattcgcggtattcaataccacccacaaaccatggggtggctggatatcgttaaagatctcaccaccaagccacgtgttgcccaagtggtgcgtaaaaccaaagagaccgatattcaggttctagtcaatcttgaccaaactggcggtaatcagattgaaactggattgggcttttttgatcacatgctagatcaaatcgcgacccacggcggtttccaactgcaactgaaagtggtgggcgatctgcacattgatgatcaccacacggtggaagataccgccttggcactagggcaagcactgcgtgaagcactgggtgacaaacgtggtattggacgctttggtttcacattgcccatggatgagtgtttggcacagtgcgcgttggatctctcgggccgcccgtatctgaaatttgatgcgagctttagccgcccgcaagtgggcgatctgtcgactgagatggtgtatcacttctttcgctcattgaccgatactttggcgtgtactctgcacctctcttccagtggcgataacgatcaccacatcattgagagcctgtttaaagcgtttggccgcacgctgcgtcaagccatcacggtgcaaggtaacgatctgccgagcagtaaaggggtgctctga

SEQ ID NO: 52462 - protein, 357 aa, Vibrio cholerae
MSKQQKILFIDRDGTLIVEPPVDFQVDRLDKLKLEPYVIPSLLKLQEAGYRLVMVTNQDGLGTSSYPQADFDAPHNMMMDIFESQGVKFNDVLICPHFERDNCSCRKPKLGLVKEYLQGGKVDFKSSAVIGDRMTDLQLAENMAIRGIQYHPQTMGWLDIVKDLTTKPRVAQVVRKTKETDIQVLVNLDQTGGNQIETGLGFFDHMLDQIATHGGFQLQLKVVGDLHIDDHHTVEDTALALGQALREALGDKRGIGRFGFTLPMDECLAQCALDLSGRPYLKFDASFSRPQVGDLSTEMVYHFFRSLTDTLACTLHLSSSGDNDHHIIESLFKAFGRTLRQAITVQGNDLPSSKGVL

SEQ ID NO: 52463 - DNA, 1128 bp, Xylella fastidiosa
  CDS (1)..(1128)
atgacccccatcgtgtttattgaccgtgacggcacgctcattgaagagccgcctgattttcagattgatgcctacgaaaaactgcgccttgtcaacggcgtgatcccggcattgctgaagctccgtgatgccggctatcactttgtgatcgtcaccaaccaagatggattgggcagccctgcgtatccccaagccagctttgatggccccaatgcgttgatgctgcagattttcagtagccaaggcatcgtcttccgcgatgtgctgatcgatcgtagctggccgaccgacaacgcgcccacccgtaaaccaggcatcggcttgatggtcgcctaccttcaagatcgcgacattgattgggcgcgctcggcaatggtgggcgaccgccccacagatctgcaatttgccgagaatctcaacattcgcggattccaattgcgtaccccgcaatttggtggtgattgggattgggacggcattgctcacaccttggccgatgcgccgcgccgcgccgtggtacagcgtcacaccaaggagacaaccatccgtgtcgagattgatttggatggcgcaccccaggcgcggatcaccaccggattaccgttttttgatcatatgctcgaacagatcgccaaacatgccggcatttccttacagatcagtgctgttggggatctgcatatcgacgaacatcacacgatagaagataccggcttggcgctaggtcaggcagtgcgccaagccttgggggacaaacgcggtattggccgctatggattcgatccgccccagctgccgtggcaggtgagcggcgcggcggcacacggtggctttaccctaccgatggatgagacccaagccagcgctgtgttggacttcagcggccgcccgtattgtgtctttgaaggaaccttcgtccgtgagcgcgtcggcgatatgcccaccgaactggtaccgcactttttccgctccctgtgcgatgcctccgggatgaacttgcacttgagcgtgcatggcgacaacgaccatcacaaagtagaagcgtgtttcaaggcgctggcgcgtgccttgcgtcaggcgttacaacgccacggccacgtgcttccttctaccaagggggcgttatga

SEQ ID NO: 52464 - protein, 375 aa, Xylella fastidiosa
MTPIVFIDRDGTLIEEPPDFQIDAYEKLRLVNGVIPALLKLRDAGYHFVIVTNQDGLGSPAYPQASFDGPNALMLQIFSSQGIVFRDVLIDRSWPTDNAPTRKPGIGLMVAYLQDRDIDWARSAMVGDRPTDLQFAENLNIRGFQLRTPQFGGDWDWDGIAHTLADAPRRAVVQRHTKETTIRVEIDLDGAPQARITTGLPFFDHMLEQIAKHAGISLQISAVGDLHIDEHHTIEDTGLALGQAVRQALGDKRGIGRYGFDPPQLPWQVSGAAAHGGFTLPMDETQASAVLDFSGRPYCVFEGTFVRERVGDMPTELVPHFFRSLCDASGMNLHLSVHGDNDHHKVEACFKALARALRQALQRHGHVLPSTKGAL

SEQ ID NO: 52465 - DNA, 1065 bp, Salmonella typhimurium
  CDS (1)..(1065)
atgagtcagaagtatcttttgatcgaccgggacggaaccttaatttccgaaccgccgagcgattttcaggtagaccgctttgataaactggcctttgagccagaggtgattcccgtattgctgaagctgcaaaaagccggttttaagctggtgatgatcactaatcaggatggacttggcacgcaaagcttcccgcaggcggacttcgacggaccgcacaacctgatgatgcagattttcacctctcagggcgtatcgtttgatgaggtgctgatctgccctcacctgcccgcagacgactgcgactgccgcaagcccaaagtgaagctggtggagcgttatcttgcggaacaagcgatggatagcgccaacagctatgtgattggcgatcgtgcgaccgatatccagctcgctgatagcatgggcattactggtttacgctatcaccgtgaaacgctgaactggacgatgattggcgaacagctaacgaaacgcgatcgttatgcgcatgtggtccgcaacaccaaagaaacacagattgatgtcagcgtctggctggatcgcgaaggcaacagcaagattaataccggcgtcggcttctttgaccatatgctcgatcaaatcgccacccacggcggctttcgcatggagattaccgttaagggcgatctctatatcgacgatcaccacacggtagaagataccggactggcgctgcgtgaggcattaaaactggcactgcgcgacaagcgcggtatctgccgttttggctttgtactaccgatggatgaatgtcttgcctgcgcgctggatatttccggtcgtccgcatctggaatataaagctgaatttacctaccagcgtgtgggcaatttgagcacagagatgattgaacactttttccgctcactctcttacacgatgggcgtcactctgcatctcaagactaaaggtaagaacgatcaccaccgtgtcgaaagtttgtttaaagcctttggtcggaccgtacgccaggctattcgcgtggagggcgatacattaccgtcctcgaaaggagtgctgtga

SEQ ID NO: 52466 - protein, 354 aa, Salmonella typhimurium
MSQKYLLIDRDGTLISEPPSDFQVDRFDKLAFEPEVIPVLLKLQKAGFKLVMITNQDGLGTQSFPQADFDGPHNLMMQIFTSQGVSFDEVLICPHLPADDCDCRKPKVKLVERYLAEQAMDSANSYVIGDRATDIQLADSMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALREALKLALRDKRGICRFGFVLPMDECLACALDISGRPHLEYKAEFTYQRVGNLSTEMIEHFFRSLSYTMGVTLHLKTKGKNDHHRVESLFKAFGRTVRQAIRVEGDTLPSSKGVL

SEQ ID NO: 52467 - DNA, 1059 bp, Campylobacter jejuni
  CDS (1)..(1059)
atgagtcaaaaaatcctttttatagatagagatggcactttaatagaggagccaaaaagcgattttcaaatcgatactcttgaaaaattgcgttttgaaaaagatgctattcccactcttttaaaactaaaaaaatttggatttaaatttgttatggtaagcaatcaagacggtcttggaacaccaagttttccaaaggaaaattttgaaatcgctcatgaaaaaatgcttgatattttaaaaagttgcggtatagaatttcaagatatttttatttgtccgcattttgaaaatgaaaattgtgcttgcagaaaacctaaaaccgctatgttagaagagtatatcaaacacgaactttatgataaggaacaaagttttgttataggagatcgtgagagtgatatgatcttggcttcaaatttaggcgtgcgtggtttaaaatacggcgaactttcttggaaagaaatagaaaatgaaattttaagttcttttagaagcgcgagttatcaaagaactactaaagaaacagatataaaagtaaaggtatgcttaaatgggggtaaggttagcattaaaacaggtattgatttttttgatcacatgttagagcaaatcgctgtacatggaggtatagggcttgaaatttcttgtaaaggagatttggaaatcgatgagcatcatagcgttgaagatgtagccttagcacttggagcttgtatcaaaaaagctttaggggataaaatcggcattgcaagatatggttttgctttacctatggatgagtgtttggcaagttgtgcaatggatttttgcaatcgtccccatttagtctataaagccaaatttaaaaaatctcatttaggggctttaagcacagaaatgatcgagcactttttttattctttaagctatgctatgggcgtgagtttgcatttaaaagttaaaggcaaaaacgatcatcataaagccgaagggctttttaaagcctttgcaaaagctttgaaaatggcagtaaaaatagaaagtgaaaatttagccagctctaaaggagtgatatga

SEQ ID NO: 52468 - protein, 352 aa, Campylobacter jejuni
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCACRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKALGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 52469 - DNA, 1089 bp, Haemophilus influenzae
  CDS (1)..(1089)
atgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacagattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcaggtttggctagatgaagctggtgtaaatgaaatcaaaaccggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccgttggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgcttcatttaaatgtcacaggtaataacgatcatcataaaatagagagcttatttaaagcctttgggagaacattaagacaggcgattcggattgaaggaaatgaaatgccaagttcaaaaggagttttatag

SEQ ID NO: 52470 - protein, 362 aa, Haemophilus influenzae
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAVGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 52471 - DNA, 1125 bp, Bacteroides fragilis
  CDS (1)..(1125)
atgaaaaagaaagtactttttattgaccgtgatggcacgcttgtcattgagccgcctgtcgactatcagctcgattcactggagaagcttgaattctatcctaaagttttccgcaatttgggctttattcgcagtaaacttgattttgagtttgtcatggtgaccaatcaggatggtttgggcacctcttctttcccggaagaaactttttggccggcgcacaatctgatgttgaaaactctggccggagaaggtattacgttcgatgatatcctgatagatcgtagtatgcccgaagattgtgcttctacgaggaagccgcgtacaggaatgttgactaagtatatttccaatccggaatatgatctggagggcagctttgtcattggagatcgtccgacagatgtagaattggccaaaaatataggttgccgtgccatttaccttcaggaatccattgatttgctgaaagaaaagggactggaaacttattgtgctcttgccactactgattgggatcgggtggctgagttcctttttgcaggagagcggagagcagaaatacgcaggacaacgaaagaaaccgatatcctagtagctctcaatctggatggtaagggtacttgtgacatttctaccgggttaggtttctttgaccatatgcttgagcagattggtaaacattccggtatggatttaacgatccgggtgaagggggacctcgaggtagacgaacatcataccatcgaagatacggctatcgcattgggtgagtgtatctatcaggcgctgggtagtaaaagaggaattgaacgttacggttatgctttgcccatggatgattgcctttgcagggtatgcctggatttcggaggacgtccgtggttggtatgggatgccgagtttaagcgtgaaaagataggagaaatgcctaccgagatgtttttacacttttttaagtctctgagtgatgcagccaagatgaacctcaatattaaggctgaggggcagaatgagcatcacaagatagagggaatattcaaagcgctggcccgtgcgttgaagatggcgttgaagagggatatctatcatttcgaattgccgtccagtaaaggagttttgtaa

SEQ ID NO: 52472 - protein, 374 aa, Bacteroides fragilis
MKKKVLFIDRDGTLVIEPPVDYQLDSLEKLEFYPKVFRNLGFIRSKLDFEFVMVTNQDGLGTSSFPEETFWPAHNLMLKTLAGEGITFDDILIDRSMPEDCASTRKPRTGMLTKYISNPEYDLEGSFVIGDRPTDVELAKNIGCRAIYLQESIDLLKEKGLETYCALATTDWDRVAEFLFAGERRAEIRRTTKETDILVALNLDGKGTCDISTGLGFFDHMLEQIGKHSGMDLTIRVKGDLEVDEHHTIEDTAIALGECIYQALGSKRGIERYGYALPMDDCLCRVCLDFGGRPWLVWDAEFKREKIGEMPTEMFLHFFKSLSDAAKMNLNIKAEGQNEHHKIEGIFKALARALKMALKRDIYHFELPSSKGVL

SEQ ID NO: 52473 - DNA, 1098 bp, Mannheimia succiniciproducens MBEL55E
  CDS (1)..(1098)
atgactcaacaaccaaccctattcatcgaccgtgacggcacgttaatcgacgagccgaaaaccgattttcaaattgacagtttagaaaagctcaaattcgaacgtaatgtgattccggcgttgctcaaattaaaaaatcgttatcgttttgtgatggtatcgaatcaagacggcctgggaacggattcatttccgcaggaagattttgataagccgcataatgccatgttagctgtttttcgttcgcaaggcattgaatttgatgatattttaatctgcccacataagccggaagacaactgtgattgccgtaaaccgaaaatcaaattgttgaaaaagtacatcgataaaaaattatttgatcccgcagacagctttgttatcggcgatcggccgacagacgttcaactggctgaaaatctgggtattcgcgcattgcagtatcatccggaaaatttagactgggatatgatcgccgaaaaattattacgggaaccggtagcggatccgaaaggtttaggtcaaccgcgtcatgccgttgtggctcgcaaaaccaaagaaaccgacatcaaagtggaagtctggttggatgaagccggggtgaatcaaattaataccggtatcggtttttttgatcatatgcttgatcaaatcgctactcatggcgggtttcgcatgaatgtcagctgcaaaggcgatttgcatattgacgatcatcataccatcgaagatgtcgcattggcactgggcgcggcgttaaaagaggctatcggcaataagcgcggtattcagcgatttggttttgtgctgcctatggacgaatgcaaagcggaatgcgccctggatttatccggtcgcccgtatttcaaattcaaagcgaaattcaatcgtgacaaagtgggcgatttcagcaccgaaatgacggagcattttttccagtctattgcctataccttgcttgcaaccttgcatttatccgttaaaggcgacaatgctcaccatcaaatcgaagccttgtttaaagctttcggcagaactttgcgccaggcgattaaaatcgaaggaaatgaaatgccgagcagtaagggcgtgttgtaa

SEQ ID NO: 52474 - protein, 365 aa, Mannheimia succiniciproducens MBEL55E
MTQQPTLFIDRDGTLIDEPKTDFQIDSLEKLKFERNVIPALLKLKNRYRFVMVSNQDGLGTDSFPQEDFDKPHNAMLAVFRSQGIEFDDILICPHKPEDNCDCRKPKIKLLKKYIDKKLFDPADSFVIGDRPTDVQLAENLGIRALQYHPENLDWDMIAEKLLREPVADPKGLGQPRHAVVARKTKETDIKVEVWLDEAGVNQINTGIGFFDHMLDQIATHGGFRMNVSCKGDLHIDDHHTIEDVALALGAALKEAIGNKRGIQRFGFVLPMDECKAECALDLSGRPYFKFKAKFNRDKVGDFSTEMTEHFFQSIAYTLLATLHLSVKGDNAHHQIEALFKAFGRTLRQAIKIEGNEMPSSKGVL

SEQ ID NO: 52475 - DNA, 1068 bp, Erwinia carotovora
  CDS (1)..(1068)
atgggccagaaatacctctttatcgaccgtgacggaacattgattgctgaaccgcctgaggattttcaggttgaccgtttggataaactggcgctggaaccagatgtcattccgtcgctgctggcactgcaaaaggccggttatacgctggtgatgattaccaatcaggatgggctaggaaccgatagctttccgcaggaaaccttcgatccaccgcacaacctgatgatgcagattctgacatcgcagggcatccattttgagcacgtgctgatctgtccgcatttaccggcagataactgcacctgtcgcaaacccaagaccgaactggtaacggcctatttgaacggcggcctgatggatgtggcaaatagctacgtcatcggcgaccgccaaaccgatattcagttggcgcaaaatatgggcattaccggcctgctctaccagcgtggcgggctgaactggcaagcaattactgaccagctaaccaagcgtaaccgccatgcacacgtcaaccgagttacgcgtgaaaccgcgattgatgtaaacgtctggctggatcaggaaggcggcagcaaaattaacaccggtgttggcttcttcgatcacatgttggatcaaatcgccacccacggcggtttccgcatgaacattgaagtgaaaggcgatctgtacattgacgatcaccacacggtggaagataccggtctggcgctgggcgaagccctgaataacgcgctgggcgacaaacgcggcattggccgttttggcttcattctgccgatggatgagtgtctggcacgctgtgcgctggatatttcagggcgtccgcatctggaatataaagccgaattcaactatcagcgcgttggcgatctgagtacggaaatggtcgaacacttcttccgctcactgtcttattccatggcctgtacgctgcacctgaaaaccaaagggcgtaacgatcatcaccgtgtggaaagcctgtttaaagtcttcggacgcacgctacgtcaggcaattcgcgtcgagggtgacacgttgccgagctcgaaaggggtgctctga

SEQ ID NO: 52476 - protein, 355 aa, Erwinia carotovora
MGQKYLFIDRDGTLIAEPPEDFQVDRLDKLALEPDVIPSLLALQKAGYTLVMITNQDGLGTDSFPQETFDPPHNLMMQILTSQGIHFEHVLICPHLPADNCTCRKPKTELVTAYLNGGLMDVANSYVIGDRQTDIQLAQNMGITGLLYQRGGLNWQAITDQLTKRNRHAHVNRVTRETAIDVNVWLDQEGGSKINTGVGFFDHMLDQIATHGGFRMNIEVKGDLYIDDHHTVEDTGLALGEALNNALGDKRGIGRFGFILPMDECLARCALDISGRPHLEYKAEFNYQRVGDLSTEMVEHFFRSLSYSMACTLHLKTKGRNDHHRVESLFKVFGRTLRQAIRVEGDTLPSSKGVL

SEQ ID NO: 52477 - DNA, 1125 bp, Bacteroides thetaiotaomicron
  CDS (1)..(1125)
atgaagaagaaaatattgtttatagatagggacgggacattggtcattgaacctcccattgattatcagcttgattcactggaaaagctggaattttatccgagagtcttccgtaatttgggctttatccgtagcaagcttgattttgaatttgtgatggttaccaatcaggacgggctgggtacatcttcgtttccggaagacactttctggcctgctcacaacttgatgctgaaaacattggccggagaaggcattacctttgatgatattctgatcgaccgtagttttccggaagataatgcgccgactcgcaaaccgcgtacaggaatgttgacgaagtatattgataatccggaatatgatcttgcggaaagctttgtaatcggtgatcgtcctactgatgtggagctggcaaagaatcttggttgccgtgctatttatctgcaagaagcaacagatgatttgaaagagaaaggtctggaagaagtttgtgcacttgcaacaacagactgggatcaggtggcagagtttctttttgccggtgagcggaaagcagaagttcgccgtacaacgaaggagactgatatttatgtgtctctcaatcttgatggaaatggaggctgtgatatttctaccggtcttggcttcttcgatcatatgcttgaacaaataggcaagcattccggaatggatctgaccattcgggtaaaaggcgacctggaagtggatgaacatcacaccattgaggatactgccatcgctttgggagaatgtatttatcaggctttgggcagtaagcgcggaatcgaacgttatggttatgctttgcctatggatgattgcctttgtcaggtttgccttgatttcggaggtcgtccttggttagtatgggatgcagagttcaatcgtgaaaaaataggggagatgccgacggagatgttcctgcatttctttaaatcattgagtgatgctgcaaaaatgaatctgaacatcaaggctgaaggacagaatgagcatcacaagatagaaggtatctttaaagcgcttgcacgtgccctgaaaatggcattgaaaagagatatctatcattttgagcttccttcgagcaaaggagtactataa

SEQ ID NO: 52478 - protein, 374 aa, Bacteroides thetaiotaomicron
MKKKILFIDRDGTLVIEPPIDYQLDSLEKLEFYPRVFRNLGFIRSKLDFEFVMVTNQDGLGTSSFPEDTFWPAHNLMLKTLAGEGITFDDILIDRSFPEDNAPTRKPRTGMLTKYIDNPEYDLAESFVIGDRPTDVELAKNLGCRAIYLQEATDDLKEKGLEEVCALATTDWDQVAEFLFAGERKAEVRRTTKETDIYVSLNLDGNGGCDISTGLGFFDHMLEQIGKHSGMDLTIRVKGDLEVDEHHTIEDTAIALGECIYQALGSKRGIERYGYALPMDDCLCQVCLDFGGRPWLVWDAEFNREKIGEMPTEMFLHFFKSLSDAAKMNLNIKAEGQNEHHKIEGIFKALARALKMALKRDIYHFELPSSKGVL

SEQ ID NO: 52479 - DNA, 1068 bp, Buchnera aphidicola
  CDS (1)..(1068)
atgaaacaaaaaatattatttattgatcgagatggaacattaattcatgaaccatctaatgattgtcaagtggatgcaattaataaacttgaatttaaaaaatatattatttcttcactatgtcaattaatgaattttggttataaatttgttatggtgacaaaccaagatggtcttggcagtaaatcatttcctcgggaaaattttaatattccacatttttttatgttaaacatttttcgttcagaaggaataatatttgaagatgttttaatttgtcctcattttttagatgataattgtgattgtcgtaaacctcaaactaaactgttaaaaccttggttgaaaaaaaataagatagataaacaacgcagttatgtaattggtgatcgagaaactgatatggaattagcaaaaaatataaatttaacaggtatacaatacaaggagaaagaatttaattggatagatattacaaaagaaattataaaaagaaatagatatagagaagtgattcgagaaacaaaagaaacttatatacatataaagttatggttggatttagaacatcatagttgtatccaaactggtattaatttttttgatcatatgttagaacaattatctattcatagcggaatttcaatgtatattttagcaaaaggagatttgcaaattgatgaccatcatactatagaagatactggaattgtcttaggagaggcattatctcaagcattaaacaataaaaatggtttatctagatatggttttgttttgcctatggatgaaagtcaagcaaaatgcattatagatttatcaaatcgtccatatttatcttttaatgctcactttaaacataaaatggttggtgatatgaatactgatatggttgaacattttttttattctctttgttgttctatgaaaatcaccttacatatagatgttaaaggaaaaaatgatcatcattgtattgaaagtttgtttaaagcatttggacgtgcactccgcaaggcagtaaaaatagaaggaaatacactgccaacatctaaagggattttataa

SEQ ID NO: 52480 - protein, 355 aa, Buchnera aphidicola
MKQKILFIDRDGTLIHEPSNDCQVDAINKLEFKKYIISSLCQLMNFGYKFVMVTNQDGLGSKSFPRENFNIPHFFMLNIFRSEGIIFEDVLICPHFLDDNCDCRKPQTKLLKPWLKKNKIDKQRSYVIGDRETDMELAKNINLTGIQYKEKEFNWIDITKEIIKRNRYREVIRETKETYIHIKLWLDLEHHSCIQTGINFFDHMLEQLSIHSGISMYILAKGDLQIDDHHTIEDTGIVLGEALSQALNNKNGLSRYGFVLPMDESQAKCIIDLSNRPYLSFNAHFKHKMVGDMNTDMVEHFFYSLCCSMKITLHIDVKGKNDHHCIESLFKAFGRALRKAVKIEGNTLPTSKGIL

SEQ ID NO: 52481 - DNA, 1074 bp, Buchnera aphidicola
  CDS (1)..(1074)
atgtctgaaaaagttttattcattgatcgtgatggtacgttaatttctgaacccttagataattttcaagtagacagttttgataaattagaatttaaacaagatgttatttcttcattaattacattaaaaaaatttaattacaaatttgttatggttactaatcaagatggtttaggatcaaaaaatttcccttataaaagttttataagacctcatgaatttatgatagatgtatttttatctcaaggtataaaatttgaagaagtgttgatttgtccacatgagttaaagagtggttgccaatgtagaaaacctaatttaggaatggttcagcattggttattgaatgatatgttagataagcagcattcttgtgttataggtgatagaaaaactgacatgattttagctaataatatggggattttgggaatacgctatggaacaaagcaaggtaattcatggagtgatattgtatttaagttaacaaaaaaacatgatagacatgccaaagtagttcgtaatactaaagaaactaatgtaagtatagaagtatggttagacaagcaaggaggtagtttaataaacactggattgaatatgtttaatcatatgttagatcaaatagcagtacatagttgtattcgaatgaaaattatttcgagtggtgatatttgtgttgatgatcatcatacagtagaagatgtaggaattgttttaggtaaagctattttaaaagctttaggtaataaactaggtattaataggtttggttttgcattgcctatggatgatagttctagttattgtttgttagatatttccggtcggccttttctaaaatttcgttcatatttcaaacatcaatatataggagatatgagttcggaaatggttagacatttttttcaatctttagcctttgctatgaaatgcactttgcatttacgaagcatgggaattaatgatcatcatcgtttagaaagtttatttaaagtttttggaaaaacgttaaaacaagcgattgttgttagtggaaaaaatttaccgagttctaagggattgctataa

SEQ ID NO: 52482 - protein, 357 aa, Buchnera aphidicola
MSEKVLFIDRDGTLISEPLDNFQVDSFDKLEFKQDVISSLITLKKFNYKFVMVTNQDGLGSKNFPYKSFIRPHEFMIDVFLSQGIKFEEVLICPHELKSGCQCRKPNLGMVQHWLLNDMLDKQHSCVIGDRKTDMILANNMGILGIRYGTKQGNSWSDIVFKLTKKHDRHAKVVRNTKETNVSIEVWLDKQGGSLINTGLNMFNHMLDQIAVHSCIRMKIISSGDICVDDHHTVEDVGIVLGKAILKALGNKLGINRFGFALPMDDSSSYCLLDISGRPFLKFRSYFKHQYIGDMSSEMVRHFFQSLAFAMKCTLHLRSMGINDHHRLESLFKVFGKTLKQAIVVSGKNLPSSKGLL

SEQ ID NO: 52483 - DNA, 1074 bp, Candidatus Blochmannia floridanus
  CDS (1)..(1074)
atgaatgacaaaattttatttatagatcgagacggtactttaattcacgaaccaaaagataattttcagattgattcattagataaattactattagaaccatatgttattcccactctcatagctctaaaaaatattaaatttaaatttattatagtaacaaatcaaaatggattaggtactgacttatttcctaaaaccaaatttaataaacctcatcagtttatgatccaaatatttaaatcacaaggaataaaatttgatcaaatactaatttgcccacacttacctgaagatcaatgtaattgtcgtaaaccaaaaactggtttaatatcctgttggttaaaaaataaatcattagatatgccgaatagctatgtcataggagatcgagatactgacatacaattcgctcacaatataggcattcaaggaataaaatatcatcaaatacattttaattggaaaaaaattcacaaatatttaatgcaaaatagtcatagagtagcgcacatccaacgtataaccaatgaaactaatgtagatgtaaaaatatggcttaatcaatgcgatcaaaataaaatcaatactggtattcatttctttgatcatatgttagaacaaatagctattcatgcaaaaattcgtatgcatatcatcacaaaaggtgatttacatattgatgatcatcatacaattgaagataccgcattatctttaggagaagcattaaatcaagcgttaggagacaaacgaggaattggtcgttttggatttactctacccatggacgaaagcattgcgcaatgtatattagatttatctggtcgtacatattttgattatcaagcagagtattctcttcaaaaaataggaaattttagtactcatatgatagaacacttttttagatcattatcttcaaaaatgcactgtacgttacatctcaaagtaataggcaataacgatcaccacaaagcagaaagtttatttaaatcttttggaaaatcattaaatcaagctatttatatacaacacaatcaaatccctagctctaaaggtattttactatga

SEQ ID NO: 52484 - protein, 357 aa, Candidatus Blochmannia floridanus
MNDKILFIDRDGTLIHEPKDNFQIDSLDKLLLEPYVIPTLIALKNIKFKFIIVTNQNGLGTDLFPKTKFNKPHQFMIQIFKSQGIKFDQILICPHLPEDQCNCRKPKTGLISCWLKNKSLDMPNSYVIGDRDTDIQFAHNIGIQGIKYHQIHFNWKKIHKYLMQNSHRVAHIQRITNETNVDVKIWLNQCDQNKINTGIHFFDHMLEQIAIHAKIRMHIITKGDLHIDDHHTIEDTALSLGEALNQALGDKRGIGRFGFTLPMDESIAQCILDLSGRTYFDYQAEYSLQKIGNFSTHMIEHFFRSLSSKMHCTLHLKVIGNNDHHKAESLFKSFGKSLNQAIYIQHNQIPSSKGILL

SEQ ID NO: 52485 - DNA, 1092 bp, Pasteurella multocida
  CDS (1)..(1092)
atgacacaacaatctattctttttatcgaccgtgacgggactttaattgatgaacccaaaaccgattttcaaattgacagtttggaaaaattacaatttgagccgaatgttatccccgcgttattaaagctcaaaccctattaccgtttcgtaatggtcagtaaccaagacgggctaggtacggcatctttcccacaggaaaattttgataaaccgcacaatgcgatgatggcgttatttaaatcacaaggtatcgagtttgatgaggtgttaatttgccctcataaacctgaagacgagtgcgattgtcgtaagccgaaaattaaattattgaaaaaatacattgataaaaaattgtttgaccctaccaccagctttgtaattggcgatcgtgccactgacgtgcaactggcagaaaatctcggtattcgagccttgcaatatgatcgtgaaaagctcaattgggatctgattgtggaaaaattgttgccaaaacagaccgcacttttagaccgtaaaccacgctatgcggaagtggttcgcaccaccaaagaaacggacattaaagtgcaagtgtggttggacgaaacagggatgaacgacatcaaaacgggtgtgggctttttcgaccatatgcttgatcaaatcgccacccacggtggctttagaatgaatgtgtactgcaaaggcgatttgtggattgacgaacatcacaccgtcgaagacactgccctcgccctcggtaccgcattaaaacaagcccttggcgataaacgaggcattcaacgctttggctttgtgttaccaatggacgaatgcaaggcagaatgtacgatggatctgtctggtcgcccgtatttcaaattcaaagccaaatttaaacgcgataaagtgggtgatttcagcaccgaaatgaccgagcattttttccaatctctcgcttataccttaatggcaaccttacatctcaaaaccaaaggcgataacgaccaccacaaaatcgaaagcctgtttaaagtgtttgggcgtacgttaagacagtgtattaaggttgaagggaatgagttgccgagtagtaagggggttttgtga

SEQ ID NO: 52486 - protein, 363 aa, Pasteurella multocida
MTQQSILFIDRDGTLIDEPKTDFQIDSLEKLQFEPNVIPALLKLKPYYRFVMVSNQDGLGTASFPQENFDKPHNAMMALFKSQGIEFDEVLICPHKPEDECDCRKPKIKLLKKYIDKKLFDPTTSFVIGDRATDVQLAENLGIRALQYDREKLNWDLIVEKLLPKQTALLDRKPRYAEVVRTTKETDIKVQVWLDETGMNDIKTGVGFFDHMLDQIATHGGFRMNVYCKGDLWIDEHHTVEDTALALGTALKQALGDKRGIQRFGFVLPMDECKAECTMDLSGRPYFKFKAKFKRDKVGDFSTEMTEHFFQSLAYTLMATLHLKTKGDNDHHKIESLFKVFGRTLRQCIKVEGNELPSSKGVL

SEQ ID NO: 52487 - DNA, 1068 bp, Photorhabdus luminescens
  CDS (1)..(1068)
atgaaccagaaactcctgtttattgatcgggacggtacgctgatcactgaaccgccaacagattttcaagttgatcgtctggataaactggcactggaaaccgaggttattcctgctctgcttgccctgcaaaaatcggggttcaggctgattatgatcactaatcaggatggtcttggcacagatagttttccattagaacaatttgaaccgccacataacctgatgatgcagattttcagttctcaaggcatccattttgatgaagttttaatctgccctcacaagccagaagagaactgtcattgccgtaagccaaaaataaaactggtggaaaaatatctaacagaaggcttgatggataccgcgaacagctatgtgattggtgaccgggaaaccgatctgcaactggccaaaaatatgggcattcaggggttacattatcatccgaaaaaccttggctggttcgctatctgtgaacaactaacccgtcaagaccgtcacgctcatgttcaacgtatcactaaagagacatccatcaacattgacgtttggcttgatcatgaaggtagcagcgatatcaataccggtgtcgggttctttgaccatatgttggatcagattgctacccacggtggtttccgcatgcatgttcaggttaaaggcgatctctgtattgatgatcaccataccgttgaggataccggtctggcattgggggaagcattgaaactggcgttgggagataaacggggcatttgccgttttggttttgtgttgccaatggatgaatgccttgcccgctgtgctctcgatatttctggtcgccctcatctggaatataaagctgaattcaaacaccagcgggtgggtgatctgagcactgaaatgattgagcacttctttcgttcactctcttatgcaatggcctgtacactacatctgaaaacgaaaggcagcaacgatcatcacagagcagaaagcctatttaaagcctttggccgaacactacgtcaggcaattcgggtagaaggcgatacattgccaagttccaaaggggttctgtga

SEQ ID NO: 52488 - protein, 355 aa, Photorhabdus luminescens
MNQKLLFIDRDGTLITEPPTDFQVDRLDKLALETEVIPALLALQKSGFRLIMITNQDGLGTDSFPLEQFEPPHNLMMQIFSSQGIHFDEVLICPHKPEENCHCRKPKIKLVEKYLTEGLMDTANSYVIGDRETDLQLAKNMGIQGLHYHPKNLGWFAICEQLTRQDRHAHVQRITKETSINIDVWLDHEGSSDINTGVGFFDHMLDQIATHGGFRMHVQVKGDLCIDDHHTVEDTGLALGEALKLALGDKRGICRFGFVLPMDECLARCALDISGRPHLEYKAEFKHQRVGDLSTEMIEHFFRSLSYAMACTLHLKTKGSNDHHRAESLFKAFGRTLRQAIRVEGDTLPSSKGVL

SEQ ID NO: 52489 - DNA, 1086 bp, Photobacterium profundum
  CDS (1)..(1086)
atgagcaaagaaaaaattctatttattgatcgtgatggcaccttaattgttgagccacccgttgattttcaagttgatcgattagataaactcaagctagaaccgtttgttatacctgcgctgttaacactgcaagatgcagggtacaagcttgtgatggtgacaaaccaagacggtttaggaacagatagctacccacaagcggatttcgatgcaccgcaaaatatgatgatggaaatcttcgagtcgcaaggcgtgaagtttgatgatgtattaatttgcccacacttcaatgaagacaactgcagctgccgaaaaccaaagttaggtttagtgaaaagttacctgcagcaaggtcgggttgatttcgcaacctcagcagtgattggtgatcgtcaaactgatcttcagttagctgaaaatatggcgattaaaggtattcaatacaatccacttcctaccgataagagcagcttgaactggcaacagattgtaaaagacctaacaacaaaccctcgcattgctgaagttgtacgtaccaccaaagaaactgacattcgcgttaaagtgaatttagatgaaacgggcggtaactctattgagacgggcttggggttctttgaccacatgctcgatcaaattgcgacacacggtggctttcaaatgcaggttaatgtgaaaggtgacttacacatcgatgatcaccacagcattgaagatacagccctcgcattaggccaagcactcaaagaagcactgggtgataagcgcggtattggtcgttttggctttagcttgccaatggatgaatgcttagcgcaatgtgcattagatttatcgggtcgcccttatttaaagtttgaagcagagtttggacgcgatcaggttggcgatctttcaactgaaatggtatcgcacttcttccgctctcttactgatacgctggcgtgtaccttgcacctttcatcgacaggccataacgatcaccacattgtagaaagcttgttcaaagcatttggtcgcacattacgccaagcaattcgtgttgacggtaatgagctaccaagcagtaaaggagtgctgtaa

SEQ ID NO: 52490 - protein, 361 aa, Photobacterium profundum
MSKEKILFIDRDGTLIVEPPVDFQVDRLDKLKLEPFVIPALLTLQDAGYKLVMVTNQDGLGTDSYPQADFDAPQNMMMEIFESQGVKFDDVLICPHFNEDNCSCRKPKLGLVKSYLQQGRVDFATSAVIGDRQTDLQLAENMAIKGIQYNPLPTDKSSLNWQQIVKDLTTNPRIAEVVRTTKETDIRVKVNLDETGGNSIETGLGFFDHMLDQIATHGGFQMQVNVKGDLHIDDHHSIEDTALALGQALKEALGDKRGIGRFGFSLPMDECLAQCALDLSGRPYLKFEAEFGRDQVGDLSTEMVSHFFRSLTDTLACTLHLSSTGHNDHHIVESLFKAFGRTLRQAIRVDGNELPSSKGVL

SEQ ID NO: 52491 - DNA, 1092 bp, Shewanella oneidensis
  CDS (1)..(1092)
atgaacccagtatttacccctaatgtcgcgcaaaaaatactttttatcgatcgcgatggcaccttgattgaagagccggttacagataagcaagtcgataaccttgccaagctggtattcgagccccaagtgatccccgccttactgcgcctgcaaaaagccggttttcgtttggtgatggtcagcaatcaggatggactcggtaccccgtccttcccgcaggaagatttcgatgcgccgcacaatatgatgatgcaaatcctctccagccaaggggttaagtttgaagatgtgctaatttgcccacactttaacgatgagaattgtagctgccgcaaacccaagctgggactggtgaaagactttttgacccaaggctttatcgattttacccagtccgcggtgattggtgacagacacacagatgtggaactgggcaatgccatggggattatcagctttcaatatcagcgaggcagtctaggttggaacgccattgccgatgcattactcaacaagggccgcagcgcgactgtggtgcgtaccaccaaggaaaccgatattcgcgtgacagtcgatctcgacaatgccagcaaaggcacgattaacactggcattggctttttcgaccatatgctggatcaaatcgccacccacgggaatttcaaaatggaggtgaatgtcgatggagatctcgagatagacgatcaccacagcgttgaagataccgcattggcgattggggatgcactgcgccaagcgcttggcgataaacgcggtattgcccgttttggttttagtttgcctatggatgaggccaagggcgaatgcttactcgatctttccggcaggccttttattaaatttgctgcccaatttgaacgggaaaaagtcggtgaaatggccaccgaaatggtgccgcactttttccgctcctttgccgatggtttgcgctgcaccctgcatgtggccgccgagggagacaacgatcaccacaaggtagaagcactctttaaggtgctgggccgcgcactgcgtcaagcagtaaaagtggaaggtgatgtattgccctcgagtaaaggcgttctctaa

SEQ ID NO: 52492 - protein, 363 aa, Shewanella oneidensis
MNPVFTPNVAQKILFIDRDGTLIEEPVTDKQVDNLAKLVFEPQVIPALLRLQKAGFRLVMVSNQDGLGTPSFPQEDFDAPHNMMMQILSSQGVKFEDVLICPHFNDENCSCRKPKLGLVKDFLTQGFIDFTQSAVIGDRHTDVELGNAMGIISFQYQRGSLGWNAIADALLNKGRSATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 52493 - DNA, 1074 bp, Vibrio vulnificus
  CDS (1)..(1074)
atgagcaaacaacaaaaaatcctttttatcgaccgtgacggcactttgatcgtggaaccacctgtcgattttcaagtagaccgtttagataagctaaaactagagccatttgttatcccaagcctgttgtcgttacaagatgcaggataccgtctagtgatggtcaccaaccaagacggccttggaacagacagctatccgcaagaagattttgatgctccacacaatatgatgatggagatctttgaatctcaaggtgtgaaatttgatgatgttctgatctgtcctcactttgaaaaagacaattgctcttgtcgcaaaccgaaattgggcttagtaaaagagtaccttcaagcgggtaaagtggatttccagaactcgttcgtgattggcgatcgtcaaaccgatcttcaacttgcagagaacatggccattcgtggcattcaatacaacccagaaatcatgggttggaaacggatcctgaaagatctgacggtgaaagcgcgtgttgctgaagtggttcgcaccacgaaagaaacggacatcaaagtattcgttaatcttgatgaacaaggcggtaacgcgatatcaaccggtcttggtttcttcgaccacatgttagatcaaatcgccactcacggtggcttccagatggtgtgcaaagtggaaggtgacttgcatattgatgatcaccacacggtagaagataccgctctcgcgctggggcaagcattgaaagaagcactgggtgacaagcgtggtattggccgctttggcttcagcctgccaatggacgagtgcttggcacaatgtgcactagacctatctggtcgtccttaccttaagtttgacgcgcagttcagccgtgagcaggtcggtgacttatccactgagatggtggttcacttcttccgttctttgacggataccctagcgtgtacgctgcacctttcttctgcgggcaacaatgatcaccacatcattgaaagtctattcaaagcgtttggtcgtactctgcgccaagcaatcaaagtagaaggcactgagctaccaagtagtaaaggcgtgctgtaa

SEQ ID NO: 52494 - protein, 357 aa, Vibrio vulnificus
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPEIMGWKRILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 52495 - DNA, 1128 bp, Xanthomonas campestris
  CDS (1)..(1128)
atgaccccgattcttttcgtcgaccgcgatggcacgctgattaccgagccggccgatttccagatcgacgcctacgaaaagctgcgctttgtcgacggcgtgattccggccatgctcaagctgcgcgatgccggctaccagttcgtcatcgtcagcaaccaggacggtctgggcagcgagagctatccgcaggcatccttcgacggccccaacaacctgatgctgcagatcttcgccagccagggcatcgtgttccgcgaagtgctgatcgactgcagctggccggccgacaacgcgccgacgcgcaagccgggcgttggcctgatggtgccgtacctgcaggaccgcaccatcgactggagccgttcggcgatggtgggcgaccgcatcaccgacatccagttcgcgcagaacctcaacatccgcgggttccagctgcgcaccgagcagttcggcggcgattgggactgggccggcatcgcacacgaactggccgatgccccgcgccgcgcggtggtccagcgcaataccaaggaaacccgcatccgcgtggagctcgacctggaccgcgtggccgaaccgcacaccgccaccgggctgccgttcttcgatcacatgctcgagcagatcggcaagcacggcgggtttgcgctggatatccgcgccgaaggcgacctgcacatcgatgagcaccacaccatcgaagacactggcttggcgctggggcaggccttgcgcgaagccttgggcgacaagcgcggtattggccgctatggctttgatccggacgacagcccatggcgcgtagcgggcgacaccacacagcacggctttaccttgccgatggacgaaaccatcgccagtgctgcgctggatttcagcggccggccatacttcgtgttcgacggcgacttcaaacgcgagcgcgttggcgacatgcccaccgagctggtgccgcacttcttccgttcggtgtgcgatgcatccggattgaatctgcatctgcacgtgcgcggcgagaacgatcaccacaaggtggaaggctgcttcaaggcattggcgcgtgcactgcgccaggcgatccgccgcgagggcaccgcgttgccatccaccaagggggcgctatga

SEQ ID NO: 52496 - protein, 375 aa, Xanthomonas campestris
MTPILFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 52497 - DNA, 27 bp, Primer
atgatgagtcagaagtatctttttatc

SEQ ID NO: 52498 - DNA, 23 bp, Primer
ttacagcactcctttcgacgagg

SEQ ID NO: 52499 - protein, 392 aa, consensus
  MISC_FEATURE (1)..(392): consensus for the disclosure of xaa see table XV
DRDGTXXXEPXXXXQXDXXXKLXXXXXXXXXXXXXXXXXXXXXXXXXNQXGLGXXXXPXXXFXXXXXXMXXXXXXXGXXFXXXXIXXXXXXXXXXXRKPXXXXXXXXXXXXXXXXXXSXXXGDRXXDXXXXXXXXXXXXXXXXXXXXXXXXXXXXXXXXXXXXWXXXXXXXXXXXXXXXXXXXXXRXXXXXRXTXETXXXXXXXLXXXXXXXXXTGXXXFXHMLXQXXXHXXXXXXXXXXGDXXXDXHHXXEDXXXXXXXXXXXAXXXKXGXXRXXXXXXXXXXXXXXXXXXXGXXLPMDXXXXXXXXDXXXRXXXXXXXXXXXXXXGXXXXXXXXHFFXSXXXXXXXXLXXXXXGXNXHHXXEXXFKXXXXXXXXXXXXXXXXXXXXXXKG

SEQ ID NO: 52500 - protein, 397 aa, consensus
  MISC_FEATURE (1)..(397): consensus for the disclosure of xaa see table XV
LFIDRDGTLIXEPXXDXQXDXXXKLXXXXXVIPXLXXLXXXXXXXXVMXXNQDGLGTXSXPXXXFXXPHXXMXXXXXSQGXXFXXXLICPHXXXXXCXCRKPXXXLXXXYXXXXXXDXXXSXVIGDRXTDXXLAXNXXIXXXXYXXXXXXXXXXXXXXXXXXXXXXWXXIXXXLXXXXXXXXXXXXXXRXAXVXRXTKETXIXVXXXLDXXXXXXIXTGXXFFDHMLXQIAXHXGXXXXXXXXGDLXIDXHHTXEDTXLALGXAXXXALGXKRGIXRXXXXXXXXXXXXXXXXXXXGFXLPMDEXXAXCXLDXSGRPXXXXXAXFXXXXXGXXXTEMXXHFFXSLXXXXXXXLHLXXXGXNDHHXXEXLFKXXXRXLXQAXXXXXXGXXLPSSKGXL

SEQ ID NO: 52501 - protein, 25 aa, consensus
  MISC_FEATURE (1)..(25): consensus for the disclosure of xaa see table XV
XXXDRDGTXXXEPXXXXQXDXXXKL

SEQ ID NO: 52502 - protein, 22 aa, consensus
  MISC_FEATURE (1)..(22): consensus for the disclosure of xaa see table XV
XXXXXXXNQXGLGXXXXPXXXF

SEQ ID NO: 52503 - protein, 42 aa, consensus
  MISC_FEATURE (1)..(42): consensus for the disclosure of xaa see table XV
RKPXXXXXXXXXXXXXXXXXXSXXXGDRXXDXXXXXXXXXXX

SEQ ID NO: 52504 - protein, 45 aa, consensus
  MISC_FEATURE (1)..(45): consensus for the disclosure of xaa see table XV
RXXXXXRXTXETXXXXXXXLXXXXXXXXXTGXXXFXHMLXQXXXH

SEQ ID NO: 52505 - protein, 61 aa, consensus
  MISC_FEATURE (1)..(61): consensus for the disclosure of xaa see table XV
GDXXXDXHHXXEDXXXXXXXXXXXAXXXKXGXXRXXXXXXXXXXXXXXXXXXXGXXLPMDX

SEQ ID NO: 52506 - protein, 68 aa, consensus
  MISC_FEATURE (1)..(68): consensus for the disclosure of xaa see table XV
XGXXXXXXXXHFFXSXXXXXXXXLXXXXXGXNXHHXXEXXFKXXXXXXXXXXXXXXXXXXXXXXKGXX

SEQ ID NO: 52507 - DNA, 1923 bp, Escherichia coli K12; identical to SEQ ID NO: 24353
  CDS (777)..(1748)

SEQ ID NO: 52508 - protein, 323 aa, Escherichia coli K12; identical to SEQ ID NO: 24354

SEQ ID NO: 52509 - DNA, 1313 bp, Capsicum annuum (pepper); identical to SEQ ID NO: 24355
  CDS (2)..(1126)

SEQ ID NO: 52510 - protein, 374 aa, Capsicum annuum (pepper); identical to SEQ ID NO: 24356

SEQ ID NO: 52511 - DNA, 1468 bp, Spinacia oleracea (spinach); identical to SEQ ID NO: 24357
  CDS (167)..(1273)

SEQ ID NO: 52512 - protein, 368 aa, Spinacia oleracea (spinach); identical to SEQ ID NO: 24358

SEQ ID NO: 52513 - DNA, 1656 bp, Homo sapiens (man); identical to SEQ ID NO: 24359
  CDS (1)..(1656)

SEQ ID NO: 52514 - protein, 551 aa, Homo sapiens (man); identical to SEQ ID NO: 24360

SEQ ID NO: 52515 - DNA, 984 bp, Aquifex aeolicus; identical to SEQ ID NO: 24361
  CDS (1)..(984)

SEQ ID NO: 52516 - protein, 327 aa, Aquifex aeolicus; identical to SEQ ID NO: 24362

SEQ ID NO: 52517 - DNA, 954 bp, Deinococcus radiodurans; identical to SEQ ID NO: 24363
  CDS (1)..(954)

SEQ ID NO: 52518 - protein, 317 aa, Deinococcus radiodurans; identical to SEQ ID NO: 24364

SEQ ID NO: 52519 - DNA, 1149 bp, Pseudomonas aeruginosa; identical to SEQ ID NO: 24365
  CDS (250)..(1149)

SEQ ID NO: 52520 - protein, 299 aa, Pseudomonas aeruginosa; identical to SEQ ID NO: 24366

SEQ ID NO: 52521 - DNA, 1210 bp, Arabidopsis thaliana (mouse-ear cress); identical to SEQ ID NO: 24367
  CDS (1)..(1179)

SEQ ID NO: 52522 - protein, 392 aa, Arabidopsis thaliana (mouse-ear cress); identical to SEQ ID NO: 24368

SEQ ID NO: 52523 - DNA, 960 bp, Nostoc sp. PCC 7120; identical to SEQ ID NO: 24369
  CDS (1)..(960)

SEQ ID NO: 52524 - protein, 319 aa, Nostoc sp. PCC 7120; identical to SEQ ID NO: 24370

SEQ ID NO: 52525 - DNA, 972 bp, Salmonella enterica subsp. enterica serovar Typhi; identical to SEQ ID NO: 24371
  CDS (1)..(972)

SEQ ID NO: 52526 - protein, 323 aa, Salmonella enterica subsp. enterica serovar Typhi; identical to SEQ ID NO: 24372

SEQ ID NO: 52527 - DNA, 1029 bp, Brucella melitensis; identical to SEQ ID NO: 24373
  CDS (1)..(1029)

SEQ ID NO: 52528 - protein, 342 aa, Brucella melitensis; identical to SEQ ID NO: 24374

SEQ ID NO: 52529 - DNA, 927 bp, Listeria innocua; identical to SEQ ID NO: 24375
  CDS (1)..(927)

SEQ ID NO: 52530 - protein, 308 aa, Listeria innocua; identical to SEQ ID NO: 24376

SEQ ID NO: 52531 - DNA, 975 bp, Nostoc sp. PCC 7120; identical to SEQ ID NO: 24377
  CDS (1)..(975)

SEQ ID NO: 52532 - protein, 324 aa, Nostoc sp. PCC 7120; identical to SEQ ID NO: 24378

SEQ ID NO: 52533 - DNA, 963 bp, Nostoc sp. PCC 7120; identical to SEQ ID NO: 24379
  CDS (1)..(963)

SEQ ID NO: 52534 - protein, 320 aa, Nostoc sp. PCC 7120; identical to SEQ ID NO: 24380

SEQ ID NO: 52535 - DNA, 1011 bp, Brucella melitensis; identical to SEQ ID NO: 24381
  CDS (1)..(1011)

SEQ ID NO: 52536 - protein, 336 aa, Brucella melitensis; identical to SEQ ID NO: 24382

SEQ ID NO: 52537 - DNA, 969 bp, Yersinia pestis; identical to SEQ ID NO: 24383
  CDS (1)..(969)

SEQ ID NO: 52538 - protein, 322 aa, Yersinia pestis; identical to SEQ ID NO: 24384

SEQ ID NO: 52539 - DNA, 942 bp, Staphylococcus aureus; identical to SEQ ID NO: 24385
  CDS (10)..(942)

SEQ ID NO: 52540 - protein, 310 aa, Staphylococcus aureus; identical to SEQ ID NO: 24386

SEQ ID NO: 52541 - DNA, 1038 bp, Agrobacterium tumefaciens; identical to SEQ ID NO: 24387
  CDS (1)..(1038)

SEQ ID NO: 52542 - protein, 345 aa, Agrobacterium tumefaciens; identical to SEQ ID NO: 24388

SEQ ID NO: 52543 - DNA, 921 bp, Helicobacter pylori; identical to SEQ ID NO: 24389
  CDS (1)..(921)

SEQ ID NO: 52544 - protein, 306 aa, Helicobacter pylori; identical to SEQ ID NO: 24390

SEQ ID NO: 52545 - DNA, 1395 bp, Mycobacterium tuberculosis; identical to SEQ ID NO: 24391
  CDS (1)..(1395)

SEQ ID NO: 52546 - protein, 464 aa, Mycobacterium tuberculosis; identical to SEQ ID NO: 24392

SEQ ID NO: 52547 - DNA, 969 bp, Vibrio cholerae; identical to SEQ ID NO: 24393
  CDS (1)..(969)

SEQ ID NO: 52548 - protein, 322 aa, Vibrio cholerae; identical to SEQ ID NO: 24394

SEQ ID NO: 52549 - DNA, 984 bp, Halobacterium sp. NRC-1; identical to SEQ ID NO: 24395
  CDS (1)..(984)

SEQ ID NO: 52550 - protein, 327 aa, Halobacterium sp. NRC-1; identical to SEQ ID NO: 24396

SEQ ID NO: 52551 - DNA, 999 bp, Caulobacter crescentus; identical to SEQ ID NO: 24397
  CDS (1)..(999)

SEQ ID NO: 52552 - protein, 332 aa, Caulobacter crescentus; identical to SEQ ID NO: 24398

SEQ ID NO: 52553 - DNA, 1014 bp, Caenorhabditis elegans; identical to SEQ ID NO: 24399
  CDS (1)..(1014)

SEQ ID NO: 52554 - protein, 337 aa, Caenorhabditis elegans; identical to SEQ ID NO: 24400

SEQ ID NO: 52555 - DNA, 972 bp, Mycobacterium tuberculosis; identical to SEQ ID NO: 24401
  CDS (1)..(972)

SEQ ID NO: 52556 - protein, 323 aa, Mycobacterium tuberculosis; identical to SEQ ID NO: 24402

SEQ ID NO: 52557 - DNA, 888 bp, Vibrio cholerae; identical to SEQ ID NO: 24403
  CDS (1)..(888)

SEQ ID NO: 52558 - protein, 295 aa, Vibrio cholerae; identical to SEQ ID NO: 24404

SEQ ID NO: 52559 - DNA, 999 bp, Xylella fastidiosa; identical to SEQ ID NO: 24405
  CDS (1)..(999)

SEQ ID NO: 52560 - protein, 332 aa, Xylella fastidiosa; identical to SEQ ID NO: 24406

SEQ ID NO: 52561 - DNA, 933 bp, Lactococcus lactis subsp. lactis; identical to SEQ ID NO: 24407
  CDS (1)..(933)

SEQ ID NO: 52562 - protein, 310 aa, Lactococcus lactis subsp. lactis; identical to SEQ ID NO: 24408

SEQ ID NO: 52563 - DNA, 921 bp, Streptococcus pneumoniae; identical to SEQ ID NO: 24409
  CDS (1)..(921)

SEQ ID NO: 52564 - protein, 306 aa, Streptococcus pneumoniae; identical to SEQ ID NO: 24410

SEQ ID NO: 52565 - DNA, 975 bp, Pseudomonas aeruginosa; identical to SEQ ID NO: 24411
  CDS (1)..(975)

SEQ ID NO: 52566 - protein, 324 aa, Pseudomonas aeruginosa; identical to SEQ ID NO: 24412

SEQ ID NO: 52567 - DNA, 1374 bp, Pseudomonas aeruginosa; identical to SEQ ID NO: 24413
  CDS (1)..(1374)

SEQ ID NO: 52568 - protein, 457 aa, Pseudomonas aeruginosa; identical to SEQ ID NO: 24414

SEQ ID NO: 52569 - DNA, 948 bp, Buchnera sp; identical to SEQ ID NO: 24415
  CDS (1)..(948)

SEQ ID NO: 52570 - protein, 315 aa, Buchnera sp; identical to SEQ ID NO: 24416

SEQ ID NO: 52571 - DNA, 906 bp, Staphylococcus aureus; identical to SEQ ID NO: 24417
  CDS (1)..(906)

SEQ ID NO: 52572 - protein, 301 aa, Staphylococcus aureus; identical to SEQ ID NO: 24418

SEQ ID NO: 52573 - DNA, 930 bp, Clostridium acetobutylicum; identical to SEQ ID NO: 24419
  CDS (1)..(930)

SEQ ID NO: 52574 - protein, 309 aa, Clostridium acetobutylicum; identical to SEQ ID NO: 24420

SEQ ID NO: 52575 - DNA, 951 bp, Haemophilus influenzae; identical to SEQ ID NO: 24421
  CDS (1)..(951)

SEQ ID NO: 52576 - protein, 316 aa, Haemophilus influenzae; identical to SEQ ID NO: 24422

SEQ ID NO: 52577 - DNA, 876 bp, Thermotoga maritima; identical to SEQ ID NO: 24423
  CDS (1)..(876)

SEQ ID NO: 52578 - protein, 291 aa, Thermotoga maritima; identical to SEQ ID NO: 24424

SEQ ID NO: 52579 - DNA, 1182 bp, Aeropyrum pernix; identical to SEQ ID NO: 24425
  CDS (1)..(1182)

SEQ ID NO: 52580 - protein, 393 aa, Aeropyrum pernix; identical to SEQ ID NO: 24426

SEQ ID NO: 52581 - DNA, 921 bp, Lactococcus lactis subsp. lactis; identical to SEQ ID NO: 24427
  CDS (1)..(921)

SEQ ID NO: 52582 - protein, 306 aa, Lactococcus lactis subsp. lactis; identical to SEQ ID NO: 24428

SEQ ID NO: 52583 - DNA, 933 bp, Mycobacterium tuberculosis; identical to SEQ ID NO: 24429
  CDS (1)..(933)

SEQ ID NO: 52584 - protein, 310 aa, Mycobacterium tuberculosis; identical to SEQ ID NO: 24430

SEQ ID NO: 52585 - DNA, 900 bp, Campylobacter jejuni; identical to SEQ ID NO: 24431
  CDS (1)..(900)

SEQ ID NO: 52586 - protein, 299 aa, Campylobacter jejuni; identical to SEQ ID NO: 24432

SEQ ID NO: 52587 - DNA, 1371 bp, Xylella fastidiosa; identical to SEQ ID NO: 24433
  CDS (1)..(1371)

SEQ ID NO: 52588 - protein, 456 aa, Xylella fastidiosa; identical to SEQ ID NO: 24434

SEQ ID NO: 52589 - DNA, 918 bp, Pseudomonas aeruginosa; identical to SEQ ID NO: 24435
  CDS (1)..(918)

SEQ ID NO: 52590 - protein, 305 aa, Pseudomonas aeruginosa; identical to SEQ ID NO: 24436

SEQ ID NO: 52591 - DNA, 939 bp, Bacillus halodurans; identical to SEQ ID NO: 24437
  CDS (1)..(939)

SEQ ID NO: 52592 - protein, 312 aa, Bacillus halodurans; identical to SEQ ID NO: 24438

SEQ ID NO: 52593 - DNA, 825 bp, Halobacterium sp. NRC-1; identical to SEQ ID NO: 24439
  CDS (1)..(825)

SEQ ID NO: 52594 - protein, 274 aa, Halobacterium sp. NRC-1; identical to SEQ ID NO: 24440

SEQ ID NO: 52595 - DNA, 987 bp, Caulobacter crescentus; identical to SEQ ID NO: 24441
  CDS (1)..(987)

SEQ ID NO: 52596 - protein, 328 aa, Caulobacter crescentus; identical to SEQ ID NO: 24442

SEQ ID NO: 52597 - DNA, 969 bp, Agrobacterium tumefaciens; identical to SEQ ID NO: 24443
  CDS (1)..(969)

SEQ ID NO: 52598 - protein, 322 aa, Agrobacterium tumefaciens; identical to SEQ ID NO: 24444

SEQ ID NO: 52599 - DNA, 924 bp, Bacillus subtilis; identical to SEQ ID NO: 24445
  CDS (1)..(924)

SEQ ID NO: 52600 - protein, 307 aa, Bacillus subtilis; identical to SEQ ID NO: 24446

SEQ ID NO: 52601 - DNA, 936 bp, Bacillus subtilis; identical to SEQ ID NO: 24447
  CDS (1)..(936)

SEQ ID NO: 52602 - protein, 311 aa, Bacillus subtilis; identical to SEQ ID NO: 24448

SEQ ID NO: 52603 - DNA, 933 bp, Neisseria meningitidis; identical to SEQ ID NO: 24449
  CDS (1)..(933)

SEQ ID NO: 52604 - protein, 310 aa, Neisseria meningitidis; identical to SEQ ID NO: 24450

SEQ ID NO: 52605 - DNA, 924 bp, Bacillus halodurans; identical to SEQ ID NO: 24451
  CDS (1)..(924)

SEQ ID NO: 52606 - protein, 307 aa, Bacillus halodurans; identical to SEQ ID NO: 24452

SEQ ID NO: 52607 - DNA, 1014 bp, Caenorhabditis elegans; identical to SEQ ID NO: 24453
  CDS (1)..(1014)

SEQ ID NO: 52608 - protein, 337 aa, Caenorhabditis elegans; identical to SEQ ID NO: 24454

SEQ ID NO: 52609 - DNA, 912 bp, Clostridium acetobutylicum; identical to SEQ ID NO: 24455
  CDS (1)..(912)

SEQ ID NO: 52610 - protein, 303 aa, Clostridium acetobutylicum; identical to SEQ ID NO: 24456

SEQ ID NO: 52611 - DNA, 1128 bp, Campylobacter jejuni; identical to SEQ ID NO: 24457
  CDS (105)..(1004)

SEQ ID NO: 52612 - protein, 299 aa, Campylobacter jejuni; identical to SEQ ID NO: 24458

SEQ ID NO: 52613 - DNA, 1371 bp, Triticum aestivum (common wheat); identical to SEQ ID NO: 24459
  CDS (72)..(1049)

SEQ ID NO: 52614 - protein, 325 aa, Triticum aestivum (common wheat); identical to SEQ ID NO: 24460

SEQ ID NO: 52615 - DNA, 1351 bp, Salmonella typhimurium; identical to SEQ ID NO: 24461
  CDS (423)..(1334)

SEQ ID NO: 52616 - protein, 303 aa, Salmonella typhimurium; identical to SEQ ID NO: 24462

SEQ ID NO: 52617 - DNA, 1432 bp, Spinacia oleracea (spinach); identical to SEQ ID NO: 24463
  CDS (54)..(1205)

SEQ ID NO: 52618 - protein, 383 aa, Spinacia oleracea (spinach); identical to SEQ ID NO: 24464

SEQ ID NO: 52619 - DNA, 1281 bp, Spinacia oleracea (spinach); identical to SEQ ID NO: 24465
  CDS (52)..(1029)

SEQ ID NO: 52620 - protein, 325 aa, Spinacia oleracea (spinach) [sequence omitted]

SEQ ID NO: 52621 - DNA, 1855 bp, Citrullus lanatus (watermelon); identical to SEQ ID NO: 24467
  CDS (564)..(1541)

SEQ ID NO: 52622 - protein, 325 aa, Citrullus lanatus (watermelon); identical to SEQ ID NO: 24468

SEQ ID NO: 52623 - DNA, 1278 bp, Arabidopsis thaliana (mouse-ear cress); identical to SEQ ID NO: 24469
  CDS (87)..(1061)

SEQ ID NO: 52624 - protein, 324 aa, Arabidopsis thaliana (mouse-ear cress); identical to SEQ ID NO: 24470

SEQ ID NO: 52625 - DNA, 1319 bp, Zea mays (maize); identical to SEQ ID NO: 24471
  CDS (73)..(1050)

SEQ ID NO: 52626 - protein, 325 aa, Zea mays (maize); identical to SEQ ID NO: 24472

SEQ ID NO: 52627 - DNA, 990 bp, Synechococcus sp; identical to SEQ ID NO: 24473
  CDS (1)..(990)

SEQ ID NO: 52628 - protein, 329 aa, Synechococcus sp; identical to SEQ ID NO: 24474

SEQ ID NO: 52629 - DNA, 1775 bp, Flavobacterium sp; identical to SEQ ID NO: 24475
  CDS (509)..(1432)

SEQ ID NO: 52630 - protein, 307 aa, Flavobacterium sp; identical to SEQ ID NO: 24476

SEQ ID NO: 52631 - DNA, 927 bp, Bacillus subtilis; identical to SEQ ID NO: 24477
  CDS (1)..(927)

SEQ ID NO: 52632 - protein, 308 aa, Bacillus subtilis; identical to SEQ ID NO: 24478

SEQ ID NO: 52633 - DNA, 978 bp, Synechocystis sp; identical to SEQ ID NO: 24479
  CDS (1)..(978)

SEQ ID NO: 52634 - protein, 325 aa, Synechocystis sp; identical to SEQ ID NO: 24480

SEQ ID NO: 52635 - DNA, 996 bp, Synechocystis sp; identical to SEQ ID NO: 24481
  CDS (1)..(996)

SEQ ID NO: 52636 - protein, 331 aa, Synechocystis sp; identical to SEQ ID NO: 24482

SEQ ID NO: 52637 - DNA, 912 bp, Escherichia coli; identical to SEQ ID NO: 24483
  CDS (1)..(912)

SEQ ID NO: 52638 - protein, 303 aa, Escherichia coli; identical to SEQ ID NO: 24484

SEQ ID NO: 52639 - DNA, 1308 bp, Solanum tuberosum (potato); identical to SEQ ID NO: 24485
  CDS (35)..(1012)

SEQ ID NO: 52640 - protein, 325 aa, Solanum tuberosum (potato); identical to SEQ ID NO: 24486

SEQ ID NO: 52641 - DNA, 1404 bp, Solanum tuberosum (potato); identical to SEQ ID NO: 24487
  CDS (21)..(1181)

SEQ ID NO: 52642 - protein, 386 aa, Solanum tuberosum (potato); identical to SEQ ID NO: 24488

SEQ ID NO: 52643 - DNA, 1492 bp, Chlamydomonas reinhardtii; identical to SEQ ID NO: 24489
  CDS (73)..(1131)

SEQ ID NO: 52644 - protein, 352 aa, Chlamydomonas reinhardtii; identical to SEQ ID NO: 24490

SEQ ID NO: 52645 - DNA, 1446 bp, chloroplast Spinacia oleracea (spinach); identical to SEQ ID NO: 24491
  CDS (43)..(1215)

SEQ ID NO: 52646 - protein, 390 aa, chloroplast Spinacia oleracea (spinach); identical to SEQ ID NO: 24492

SEQ ID NO: 52647 - DNA, 1035 bp, Caenorhabditis elegans; identical to SEQ ID NO: 24493
  CDS (1)..(1035)

SEQ ID NO: 52648 - protein, 344 aa, Caenorhabditis elegans; identical to SEQ ID NO: 24494

SEQ ID NO: 52649 - DNA, 1014 bp, Caenorhabditis elegans; identical to SEQ ID NO: 24495
  CDS (1)..(1014)

SEQ ID NO: 52650 - protein, 337 aa, Caenorhabditis elegans; identical to SEQ ID NO: 24496

SEQ ID NO: 52651 - DNA, 951 bp, Streptomyces coelicolor; identical to SEQ ID NO: 24497
  CDS (1)..(951)

SEQ ID NO: 52652 - protein, 316 aa, Streptomyces coelicolor; identical to SEQ ID NO: 24498

SEQ ID NO: 52653 - DNA, 1056 bp, Schizosaccharomyces pombe; identical to SEQ ID NO: 24499
  CDS (1)..(1056)

SEQ ID NO: 52654 - protein, 351 aa, Schizosaccharomyces pombe; identical to SEQ ID NO: 24500

SEQ ID NO: 52655 - DNA, 909 bp, Clostridium perfringens; identical to SEQ ID NO: 24501
  CDS (1)..(909)

SEQ ID NO: 52656 - protein, 302 aa, Clostridium perfringens; identical to SEQ ID NO: 24502

SEQ ID NO: 52657 - DNA, 927 bp, Methanosarcina barkeri; identical to SEQ ID NO: 24503
  CDS (1)..(927)

SEQ ID NO: 52658 - protein, 308 aa, Methanosarcina barkeri; identical to SEQ ID NO: 24504

SEQ ID NO: 52659 - DNA, 933 bp, Mycobacterium leprae; identical to SEQ ID NO: 24505
  CDS (1)..(933)

SEQ ID NO: 52660 - protein, 310 aa, Mycobacterium leprae; identical to SEQ ID NO: 24506

SEQ ID NO: 52661 - DNA, 1329 bp, Arabidopsis thaliana (mouse-ear cress); identical to SEQ ID NO: 24507
  CDS (1)..(1329)

SEQ ID NO: 52662 - protein, 442 aa, Arabidopsis thaliana (mouse-ear cress); identical to SEQ ID NO: 24508

SEQ ID NO: 52663 - DNA, 1142 bp, Arabidopsis thaliana (mouse-ear cress); identical to SEQ ID NO: 24509
  CDS (1)..(1107)

SEQ ID NO: 52664 - protein, 368 aa, Arabidopsis thaliana (mouse-ear cress); identical to SEQ ID NO: 24510

SEQ ID NO: 52665 - DNA, 1056 bp, Corynebacterium glutamicum; identical to SEQ ID NO: 24511
  CDS (101)..(1036)

SEQ ID NO: 52666 - protein, 311 aa, Corynebacterium glutamicum; identical to SEQ ID NO: 24512

SEQ ID NO: 52667 - DNA, 1035 bp, Rhodobacter sphaeroides; identical to SEQ ID NO: 24513
  CDS (1)..(1035)

SEQ ID NO: 52668 - protein, 344 aa, Rhodobacter sphaeroides; identical to SEQ ID NO: 24514

SEQ ID NO: 52669 - DNA, 1200 bp, Entamoeba histolytica; identical to SEQ ID NO: 24515
  CDS (83)..(1096)

SEQ ID NO: 52670 - protein, 337 aa, Entamoeba histolytica; identical to SEQ ID NO: 24516

SEQ ID NO: 52671 - DNA, 1524 bp, Saccharomyces cerevisiae; identical to SEQ ID NO: 24517
  CDS (1)..(1524)

SEQ ID NO: 52672 - protein, 507 aa, Saccharomyces cerevisiae; identical to SEQ ID NO: 24518

SEQ ID NO: 52673 - DNA, 894 bp, Yersinia pseudotuberculosis IP 32953; identical to SEQ ID NO: 24519
  CDS (1)..(894)

SEQ ID NO: 52674 - protein, 297 aa, Yersinia pseudotuberculosis IP 32953; identical to SEQ ID NO: 24520

SEQ ID NO: 52675 - DNA, 936 bp, Symbiobacterium thermophilum; identical to SEQ ID NO: 24521
  CDS (1)..(936)

SEQ ID NO: 52676 - protein, 311 aa, Symbiobacterium thermophilum; identical to SEQ ID NO: 24522

SEQ ID NO: 52677 - DNA, 936 bp, Propionibacterium acnes; identical to SEQ ID NO: 24523
  CDS (1)..(936)

SEQ ID NO: 52678 - protein, 311 aa, Propionibacterium acnes; identical to SEQ ID NO: 24524

SEQ ID NO: 52679 - DNA, 921 bp, Desulfotalea psychrophila; identical to SEQ ID NO: 24525
  CDS (1)..(921)

SEQ ID NO: 52680 - protein, 306 aa, Desulfotalea psychrophila; identical to SEQ ID NO: 24526

SEQ ID NO: 52681 - DNA, 1095 bp, Debaryomyces hansenii CBS767; identical to SEQ ID NO: 24527
  CDS (1)..(1095)

SEQ ID NO: 52682 - protein, 364 aa, Debaryomyces hansenii CBS767; identical to SEQ ID NO: 24528

SEQ ID NO: 52683 - DNA, 1476 bp, Debaryomyces hansenii CBS767; identical to SEQ ID NO: 24529
  CDS (1)..(1476)

SEQ ID NO: 52684 - protein, 491 aa, Debaryomyces hansenii CBS767; identical to SEQ ID NO: 24530

SEQ ID NO: 52685 - DNA, 1134 bp, Yarrowia lipolytica CLIB99; identical to SEQ ID NO: 24531
  CDS (1)..(1134)

SEQ ID NO: 52686 - protein, 377 aa, Yarrowia lipolytica CLIB99; identical to SEQ ID NO: 24532

SEQ ID NO: 52687 - DNA, 1617 bp, Yarrowia lipolytica CLIB99; identical to SEQ ID NO: 24533
  CDS (1)..(1617)

SEQ ID NO: 52688 - protein, 538 aa, Yarrowia lipolytica CLIB99; identical to SEQ ID NO: 24534

SEQ ID NO: 52689 - DNA, 1482 bp, Kluyveromyces lactis NRRL Y; identical to SEQ ID NO: 24535
  CDS (1)..(1482)

SEQ ID NO: 52690 - protein, 493 aa, Kluyveromyces lactis NRRL Y; identical to SEQ ID NO: 24536

SEQ ID NO: 52691 - DNA, 969 bp, Erwinia carotovora; identical to SEQ ID NO: 24537
  CDS (1)..(969)

SEQ ID NO: 52692 - protein, 322 aa, Erwinia carotovora; identical to SEQ ID NO: 24538

SEQ ID NO: 52693 - DNA, 2098 bp, Xenopus laevis; identical to SEQ ID NO: 24539
  CDS (30)..(1718)

SEQ ID NO: 52694 - protein, 562 aa, Xenopus laevis; identical to SEQ ID NO: 24540

SEQ ID NO: 52695 - DNA, 924 bp, Acinetobacter sp; identical to SEQ ID NO: 24541
  CDS (1)..(924)

SEQ ID NO: 52696 - protein, 307 aa, Acinetobacter sp; identical to SEQ ID NO: 24542

SEQ ID NO: 52697 - DNA, 999 bp, Acinetobacter sp; identical to SEQ ID NO: 24543
  CDS (1)..(999)

SEQ ID NO: 52698 - protein, 332 aa, Acinetobacter sp; identical to SEQ ID NO: 24544

SEQ ID NO: 52699 - DNA, 1506 bp, Candida glabrata CBS138; identical to SEQ ID NO: 24545
  CDS (1)..(1506)

SEQ ID NO: 52700 - protein, 501 aa, Candida glabrata CBS138; identical to SEQ ID NO: 24546

SEQ ID NO: 52701 - DNA, 918 bp, Bacillus thuringiensis; identical to SEQ ID NO: 24547
  CDS (1)..(918)

SEQ ID NO: 52702 - protein, 305 aa, Bacillus thuringiensis; identical to SEQ ID NO: 24548

SEQ ID NO: 52703 - DNA, 924 bp, Bacillus thuringiensis; identical to SEQ ID NO: 24549
  CDS (1)..(924)

SEQ ID NO: 52704 - protein, 307 aa, Bacillus thuringiensis; identical to SEQ ID NO: 24550

SEQ ID NO: 52705 - DNA, 951 bp, Picrophilus torridus; identical to SEQ ID NO: 24551
  CDS (1)..(951)

SEQ ID NO: 52706 - protein, 316 aa, Picrophilus torridus; identical to SEQ ID NO: 24552

SEQ ID NO: 52707 - DNA, 969 bp, Photobacterium profundum; identical to SEQ ID NO: 24553
  CDS (1)..(969)

SEQ ID NO: 52708 - protein, 322 aa, Photobacterium profundum; identical to SEQ ID NO: 24554

SEQ ID NO: 52709 - DNA, 936 bp, Corynebacterium glutamicum; identical to SEQ ID NO: 24555
  CDS (1)..(936)

SEQ ID NO: 52710 - protein, 311 aa, Corynebacterium glutamicum; identical to SEQ ID NO: 24556

SEQ ID NO: 52711 - DNA, 1047 bp, Bdellovibrio bacteriovorus; identical to SEQ ID NO: 24557
  CDS (1)..(1047)

SEQ ID NO: 52712 - protein, 348 aa, Bdellovibrio bacteriovorus; identical to SEQ ID NO: 24558

SEQ ID NO: 52713 - DNA, 990 bp, Bdellovibrio bacteriovorus; identical to SEQ ID NO: 24559
  CDS (1)..(990)

SEQ ID NO: 52714 - protein, 329 aa, Bdellovibrio bacteriovorus; identical to SEQ ID NO: 24560

SEQ ID NO: 52715 - DNA, 990 bp, Bdellovibrio bacteriovorus; identical to SEQ ID NO: 24561
  CDS (1)..(990)

SEQ ID NO: 52716 - protein, 329 aa, Bdellovibrio bacteriovorus; identical to SEQ ID NO: 24562

SEQ ID NO: 52717 - DNA, 1038 bp, Rhodopseudomonas palustris; identical to SEQ ID NO: 24563
  CDS (1)..(1038)

SEQ ID NO: 52718 - protein, 345 aa, Rhodopseudomonas palustris; identical to SEQ ID NO: 24564

SEQ ID NO: 52719 - DNA, 1398 bp, Rhodopseudomonas palustris; identical to SEQ ID NO: 24565
  CDS (1)..(1398)

SEQ ID NO: 52720 - protein, 465 aa, Rhodopseudomonas palustris; identical to SEQ ID NO: 24566

SEQ ID NO: 52721 - DNA, 999 bp, Rhodopseudomonas palustris; identical to SEQ ID NO: 24567
  CDS (1)..(999)

SEQ ID NO: 52722 - protein, 332 aa, Rhodopseudomonas palustris; identical to SEQ ID NO: 24568

SEQ ID NO: 52723 - DNA, 936 bp, Corynebacterium diphtheriae; identical to SEQ ID NO: 24569
  CDS (1)..(936)

SEQ ID NO: 52724 - protein, 311 aa, Corynebacterium diphtheriae; identical to SEQ ID NO: 24570

SEQ ID NO: 52725 - DNA, 906 bp, uncultured bacterium 561; identical to SEQ ID NO: 24571
  CDS (1)..(906)

SEQ ID NO: 52726 - protein, 301 aa, uncultured bacterium 561; identical to SEQ ID NO: 24572

SEQ ID NO: 52727 - DNA, 927 bp, Desulfovibrio vulgaris; identical to SEQ ID NO: 24573
  CDS (1)..(927)

SEQ ID NO: 52728 - protein, 308 aa, Desulfovibrio vulgaris; identical to SEQ ID NO: 24574

SEQ ID NO: 52729 - DNA, 915 bp, Thermus thermophilus; identical to SEQ ID NO: 24575
  CDS (1)..(915)

SEQ ID NO: 52730 - protein, 304 aa, Thermus thermophilus; identical to SEQ ID NO: 24576

SEQ ID NO: 52731 - DNA, 924 bp, Bacillus cereus; identical to SEQ ID NO: 24577
  CDS (1)..(924)

SEQ ID NO: 52732 - protein, 307 aa, Bacillus cereus; identical to SEQ ID NO: 24578

SEQ ID NO: 52733 - DNA, 933 bp, Mycobacterium paratuberculosis; identical to SEQ ID NO: 24579
  CDS (1)..(933)

SEQ ID NO: 52734 - protein, 310 aa, Mycobacterium paratuberculosis; identical to SEQ ID NO: 24580

SEQ ID NO: 52735 - DNA, 1407 bp, Mycobacterium paratuberculosis; identical to SEQ ID NO: 24581
  CDS (1)..(1407)

SEQ ID NO: 52736 - protein, 468 aa, Mycobacterium paratuberculosis; identical to SEQ ID NO: 24582

SEQ ID NO: 52737 - DNA, 927 bp, Geobacter sulfurreducens; identical to SEQ ID NO: 24583
  CDS (1)..(927)

SEQ ID NO: 52738 - protein, 308 aa, Geobacter sulfurreducens; identical to SEQ ID NO: 24584

SEQ ID NO: 52739 - DNA, 924 bp, Geobacter sulfurreducens; identical to SEQ ID NO: 24585
  CDS (1)..(924)

SEQ ID NO: 52740 - protein, 307 aa, Geobacter sulfurreducens; identical to SEQ ID NO: 24586

SEQ ID NO: 52741 - DNA, 1479 bp, Ashbya gossypii; identical to SEQ ID NO: 24587
  CDS (1)..(1479)

SEQ ID NO: 52742 - protein, 492 aa, Ashbya gossypii; identical to SEQ ID NO: 24588

SEQ ID NO: 52743 - DNA, 1098 bp, Spinacia oleracea; identical to SEQ ID NO: 24589
  CDS (78)..(1076)

SEQ ID NO: 52744 - protein, 332 aa, Spinacia oleracea; identical to SEQ ID NO: 24590

SEQ ID NO: 52745 - DNA, 1221 bp, Penicillium chrysogenum; identical to SEQ ID NO: 24591
  CDS (45)..(1160)

SEQ ID NO: 52746 - protein, 371 aa, Penicillium chrysogenum; identical to SEQ ID NO: 24592

SEQ ID NO: 52747 - DNA, 1206 bp, Solanum tuberosum; identical to SEQ ID NO: 24593
  CDS (35)..(1090)

SEQ ID NO: 52748 - protein, 351 aa, Solanum tuberosum; identical to SEQ ID NO: 24594

SEQ ID NO: 52749 - DNA, 999 bp, Wolinella succinogenes; identical to SEQ ID NO: 24595
  CDS (1)..(999)

SEQ ID NO: 52750 - protein, 332 aa, Wolinella succinogenes; identical to SEQ ID NO: 24596

SEQ ID NO: 52751 - DNA, 969 bp, Vibrio vulnificus; identical to SEQ ID NO: 24597
  CDS (1)..(969)

SEQ ID NO: 52752 - protein, 322 aa, Vibrio vulnificus; identical to SEQ ID NO: 24598

SEQ ID NO: 52753 - DNA, 1029 bp, Photorhabdus luminescens; identical to SEQ ID NO: 24599
  CDS (1)..(1029)

SEQ ID NO: 52754 - protein, 342 aa, Photorhabdus luminescens; identical to SEQ ID NO: 24600

SEQ ID NO: 52755 - DNA, 954 bp, Photorhabdus luminescens; identical to SEQ ID NO: 24601
  CDS (1)..(954)

SEQ ID NO: 52756 - protein, 317 aa, Photorhabdus luminescens; identical to SEQ ID NO: 24602

SEQ ID NO: 52757 - DNA, 882 bp, Photorhabdus luminescens; identical to SEQ ID NO: 24603
  CDS (1)..(882)

SEQ ID NO: 52758 - protein, 293 aa, Photorhabdus luminescens; identical to SEQ ID NO: 24604

SEQ ID NO: 52759 - DNA, 1368 bp, Photorhabdus luminescens; identical to SEQ ID NO: 24605
  CDS (1)..(1368)

SEQ ID NO: 52760 - protein, 455 aa, Photorhabdus luminescens; identical to SEQ ID NO: 24606

SEQ ID NO: 52761 - DNA, 963 bp, Gloeobacter violaceus; identical to SEQ ID NO: 24607
  CDS (1)..(963)

SEQ ID NO: 52762 - protein, 320 aa, Gloeobacter violaceus; identical to SEQ ID NO: 24608

SEQ ID NO: 52763 - DNA, 963 bp, Gloeobacter violaceus; identical to SEQ ID NO: 24609
  CDS (1)..(963)

SEQ ID NO: 52764 - protein, 320 aa, Gloeobacter violaceus; identical to SEQ ID NO: 24610

SEQ ID NO: 52765 - DNA, 933 bp, Chromobacterium violaceum; identical to SEQ ID NO: 24611
  CDS (1)..(933)

SEQ ID NO: 52766 - protein, 310 aa, Chromobacterium violaceum; identical to SEQ ID NO: 24612

SEQ ID NO: 52767 - DNA, 1371 bp, Chromobacterium violaceum; identical to SEQ ID NO: 24613
  CDS (1)..(1371)

SEQ ID NO: 52768 - protein, 456 aa, Chromobacterium violaceum; identical to SEQ ID NO: 24614

SEQ ID NO: 52769 - DNA, 891 bp, Chromobacterium violaceum; identical to SEQ ID NO: 24615
  CDS (1)..(891)

SEQ ID NO: 52770 - protein, 296 aa, Chromobacterium violaceum; identical to SEQ ID NO: 24616

SEQ ID NO: 52771 - DNA, 1131 bp, Neurospora crassa; identical to SEQ ID NO: 24617
  CDS (1)..(1131)

SEQ ID NO: 52772 - protein, 376 aa, Neurospora crassa; identical to SEQ ID NO: 24618

SEQ ID NO: 52773 - DNA, 1587 bp, Neurospora crassa; identical to SEQ ID NO: 24619
  CDS (1)..(1587)

SEQ ID NO: 52774 - protein, 528 aa, Neurospora crassa; identical to SEQ ID NO: 24620

SEQ ID NO: 52775 - DNA, 1371 bp, Neurospora crassa; identical to SEQ ID NO: 24621
  CDS (1)..(1371)

SEQ ID NO: 52776 - protein, 456 aa, Neurospora crassa; identical to SEQ ID NO: 24622

SEQ ID NO: 52777 - DNA, 969 bp, Synechococcus sp; identical to SEQ ID NO: 24623
  CDS (1)..(969)

SEQ ID NO: 52778 - protein, 322 aa, Synechococcus sp; identical to SEQ ID NO: 24624

SEQ ID NO: 52779 - DNA, 987 bp, Synechococcus sp; identical to SEQ ID NO: 24625
  CDS (1)..(987)

SEQ ID NO: 52780 - protein, 328 aa, Synechococcus sp; identical to SEQ ID NO: 24626

SEQ ID NO: 52781 - DNA, 960 bp, Rhodopirellula baltica; identical to SEQ ID NO: 24627
  CDS (1)..(960)

SEQ ID NO: 52782 - protein, 319 aa, Rhodopirellula baltica; identical to SEQ ID NO: 24628

SEQ ID NO: 52783 - DNA, 987 bp, Prochlorococcus marinus subsp; identical to SEQ ID NO: 24629
  CDS (1)..(987)

SEQ ID NO: 52784 - protein, 328 aa, Prochlorococcus marinus subsp; identical to SEQ ID NO: 24630

SEQ ID NO: 52785 - DNA, 969 bp, Prochlorococcus marinus subsp; identical to SEQ ID NO: 24631
  CDS (1)..(969)

SEQ ID NO: 52786 - protein, 322 aa, Prochlorococcus marinus subsp; identical to SEQ ID NO: 24632

SEQ ID NO: 52787 - DNA, 969 bp, Prochlorococcus marinus; identical to SEQ ID NO: 24633
  CDS (1)..(969)

SEQ ID NO: 52788 - protein, 322 aa, Prochlorococcus marinus; identical to SEQ ID NO: 24634

SEQ ID NO: 52789 - DNA, 987 bp, Prochlorococcus marinus; identical to SEQ ID NO: 24635
  CDS (1)..(987)

SEQ ID NO: 52790 - protein, 328 aa, Prochlorococcus marinus; identical to SEQ ID NO: 24636

SEQ ID NO: 52791 - DNA, 987 bp, Prochlorococcus marinus; identical to SEQ ID NO: 24637
  CDS (1)..(987)

SEQ ID NO: 52792 - protein, 328 aa, Prochlorococcus marinus; identical to SEQ ID NO: 24638

SEQ ID NO: 52793 - DNA, 969 bp, Prochlorococcus marinus; identical to SEQ ID NO: 24639
  CDS (1)..(969)

SEQ ID NO: 52794 - protein, 322 aa, Prochlorococcus marinus; identical to SEQ ID NO: 24640

SEQ ID NO: 52795 - DNA, 903 bp, Helicobacter hepaticus; identical to SEQ ID NO: 24641
  CDS (1)..(903)

SEQ ID NO: 52796 - protein, 300 aa, Helicobacter hepaticus; identical to SEQ ID NO: 24642

SEQ ID NO: 52797 - DNA, 942 bp, Helicobacter hepaticus; identical to SEQ ID NO: 24643
  CDS (1)..(942)

SEQ ID NO: 52798 - protein, 313 aa, Helicobacter hepaticus; identical to SEQ ID NO: 24644

SEQ ID NO: 52799 - DNA, 951 bp, Haemophilus ducreyi; identical to SEQ ID NO: 24645
  CDS (1)..(951)

SEQ ID NO: 52800 - protein, 316 aa, Haemophilus ducreyi; identical to SEQ ID NO: 24646

SEQ ID NO: 52801 - DNA, 945 bp, Candidatus Blochmannia floridanus; identical to SEQ ID NO: 24647
  CDS (1)..(945)

SEQ ID NO: 52802 - protein, 314 aa, Candidatus Blochmannia floridanus; identical to SEQ ID NO: 24648

SEQ ID NO: 52803 - DNA, 912 bp, Bordetella parapertussis; identical to SEQ ID NO: 24649
  CDS (1)..(912)

SEQ ID NO: 52804 - protein, 303 aa, Bordetella parapertussis; identical to SEQ ID NO: 24650

SEQ ID NO: 52805 - DNA, 969 bp, Propionibacterium freudenreichii shermanii; identical to SEQ ID NO: 24651
  CDS (1)..(969)

SEQ ID NO: 52806 - protein, 322 aa, Propionibacterium freudenreichii shermanii; identical to SEQ ID NO: 24652

SEQ ID NO: 52807 - DNA, 927 bp, Propionibacterium freudenreichii shermanii; identical to SEQ ID NO: 24653
  CDS (1)..(927)

SEQ ID NO: 52808 - protein, 308 aa, Propionibacterium freudenreichii shermanii; identical to SEQ ID NO: 24654

SEQ ID NO: 52809 - DNA, 1466 bp, Porphyra purpurea; identical to SEQ ID NO: 24655
  CDS (149)..(1282)

SEQ ID NO: 52810 - protein, 377 aa, Porphyra purpurea; identical to SEQ ID NO: 24656

SEQ ID NO: 52811 - DNA, 1436 bp, Oryza sativa; identical to SEQ ID NO: 24657
  CDS (57)..(1190)

SEQ ID NO: 52812 - protein, 377 aa, Oryza sativa; identical to SEQ ID NO: 24658

SEQ ID NO: 52813 - DNA, 1059 bp, Betula verrucosa; identical to SEQ ID NO: 24659
  CDS (1)..(1059)

SEQ ID NO: 52814 - protein, 352 aa, Betula verrucosa; identical to SEQ ID NO: 24660

SEQ ID NO: 52815 - DNA, 1990 bp, Xenopus laevis; identical to SEQ ID NO: 24661
  CDS (68)..(1765)

SEQ ID NO: 52816 - protein, 565 aa, Xenopus laevis; identical to SEQ ID NO: 24662

SEQ ID NO: 52817 - DNA, 924 bp, Bacillus cereus; identical to SEQ ID NO: 24663
  CDS (1)..(924)

SEQ ID NO: 52818 - protein, 307 aa, Bacillus cereus; identical to SEQ ID NO: 24664

SEQ ID NO: 52819 - DNA, 924 bp, Bacillus cereus; identical to SEQ ID NO: 24665
  CDS (1)..(924)

SEQ ID NO: 52820 - protein, 307 aa, Bacillus cereus; identical to SEQ ID NO: 24666

SEQ ID NO: 52821 - DNA, 951 bp, Streptomyces avermitilis; identical to SEQ ID NO: 24667
  CDS (1)..(951)

SEQ ID NO: 52822 - protein, 316 aa, Streptomyces avermitilis; identical to SEQ ID NO: 24668

SEQ ID NO: 52823 - DNA, 1395 bp, Streptomyces avermitilis; identical to SEQ ID NO: 24669
  CDS (1)..(1395)

SEQ ID NO: 52824 - protein, 464 aa, Streptomyces avermitilis; identical to SEQ ID NO: 24670

SEQ ID NO: 52825 - DNA, 888 bp, Nitrosomonas europaea; identical to SEQ ID NO: 24671
  CDS (1)..(888)

SEQ ID NO: 52826 - protein, 295 aa, Nitrosomonas europaea; identical to SEQ ID NO: 24672

SEQ ID NO: 52827 - DNA, 933 bp, Enterococcus faecalis; identical to SEQ ID NO: 24673
  CDS (1)..(933)

SEQ ID NO: 52828 - protein, 310 aa, Enterococcus faecalis; identical to SEQ ID NO: 24674

SEQ ID NO: 52829 - DNA, 918 bp, Enterococcus faecalis; identical to SEQ ID NO: 24675
  CDS (1)..(918)

SEQ ID NO: 52830 - protein, 305 aa, Enterococcus faecalis; identical to SEQ ID NO: 24676

SEQ ID NO: 52831 - DNA, 951 bp, Coxiella burnetii; identical to SEQ ID NO: 24677
  CDS (1)..(951)

SEQ ID NO: 52832 - protein, 316 aa, Coxiella burnetii; identical to SEQ ID NO: 24678

SEQ ID NO: 52833 - DNA, 990 bp, Shigella flexneri; identical to SEQ ID NO: 24679
  CDS (1)..(990)

SEQ ID NO: 52834 - protein, 329 aa, Shigella flexneri; identical to SEQ ID NO: 24680

SEQ ID NO: 52835 - DNA, 927 bp, Bacillus stearothermophilus; identical to SEQ ID NO: 24681
  CDS (1)..(927)

SEQ ID NO: 52836 - protein, 308 aa, Bacillus stearothermophilus [sequence omitted]

SEQ ID NO: 52837 - DNA, 1230 bp, Oryza sativa; identical to SEQ ID NO: 24683
  CDS (1)..(1230)

SEQ ID NO: 52838 - protein, 409 aa, Oryza sativa; identical to SEQ ID NO: 24684

SEQ ID NO: 52839 - DNA, 1371 bp, Xylella fastidiosa; identical to SEQ ID NO: 24685
  CDS (1)..(1371)

SEQ ID NO: 52840 - protein, 456 aa, Xylella fastidiosa; identical to SEQ ID NO: 24686

SEQ ID NO: 52841 - DNA, 969 bp, Vibrio parahaemolyticus; identical to SEQ ID NO: 24687
  CDS (1)..(969)

SEQ ID NO: 52842 - protein, 322 aa, Vibrio parahaemolyticus; identical to SEQ ID NO: 24688

SEQ ID NO: 52843 - DNA, 975 bp, Pseudomonas syringae; identical to SEQ ID NO: 24689
  CDS (1)..(975)

SEQ ID NO: 52844 - protein, 324 aa, Pseudomonas syringae; identical to SEQ ID NO: 24690

SEQ ID NO: 52845 - DNA, 984 bp, Pseudomonas syringae; identical to SEQ ID NO: 24691
  CDS (1)..(984)

SEQ ID NO: 52846 - protein, 327 aa, Pseudomonas syringae; identical to SEQ ID NO: 24692

SEQ ID NO: 52847 - DNA, 903 bp, Pseudomonas syringae; identical to SEQ ID NO: 24693
  CDS (1)..(903)

SEQ ID NO: 52848 - protein, 300 aa, Pseudomonas syringae; identical to SEQ ID NO: 24694

SEQ ID NO: 52849 - DNA, 975 bp, Pseudomonas putida; identical to SEQ ID NO: 24695
  CDS (1)..(975)

SEQ ID NO: 52850 - protein, 324 aa, Pseudomonas putida; identical to SEQ ID NO: 24696

SEQ ID NO: 52851 - DNA, 900 bp, Pseudomonas putida; identical to SEQ ID NO: 24697
  CDS (1)..(900)

SEQ ID NO: 52852 - protein, 299 aa, Pseudomonas putida; identical to SEQ ID NO: 24698

SEQ ID NO: 52853 - DNA, 912 bp, Lactobacillus plantarum; identical to SEQ ID NO: 24699
  CDS (1)..(912)

SEQ ID NO: 52854 - protein, 303 aa, Lactobacillus plantarum; identical to SEQ ID NO: 24700

SEQ ID NO: 52855 - DNA, 918 bp, Clostridium tetani; identical to SEQ ID NO: 24701
  CDS (1)..(918)

SEQ ID NO: 52856 - protein, 305 aa, Clostridium tetani; identical to SEQ ID NO: 24702

SEQ ID NO: 52857 - DNA, 978 bp, Bradyrhizobium japonicum; identical to SEQ ID NO: 24703
  CDS (1)..(978)

SEQ ID NO: 52858 - protein, 325 aa, Bradyrhizobium japonicum; identical to SEQ ID NO: 24704

SEQ ID NO: 52859 - DNA, 1035 bp, Bradyrhizobium japonicum; identical to SEQ ID NO: 24705
  CDS (1)..(1035)

SEQ ID NO: 52860 - protein, 344 aa, Bradyrhizobium japonicum; identical to SEQ ID NO: 24706

SEQ ID NO: 52861 - DNA, 948 bp, Bacteroides thetaiotaomicron; identical to SEQ ID NO: 24707
  CDS (1)..(948)

SEQ ID NO: 52862 - protein, 315 aa, Bacteroides thetaiotaomicron; identical to SEQ ID NO: 24708

SEQ ID NO: 52863 - DNA, 954 bp, Bacteroides thetaiotaomicron; identical to SEQ ID NO: 24709
  CDS (1)..(954)

SEQ ID NO: 52864 - protein, 317 aa, Bacteroides thetaiotaomicron; identical to SEQ ID NO: 24710

SEQ ID NO: 52865 - DNA, 909 bp, Staphylococcus epidermidis; identical to SEQ ID NO: 24711
  CDS (1)..(909)

SEQ ID NO: 52866 - protein, 302 aa, Staphylococcus epidermidis; identical to SEQ ID NO: 24712

SEQ ID NO: 52867 - DNA, 930 bp, Oceanobacillus iheyensis; identical to SEQ ID NO: 24713
  CDS (1)..(930)

SEQ ID NO: 52868 - protein, 309 aa, Oceanobacillus iheyensis; identical to SEQ ID NO: 24714

SEQ ID NO: 52869 - DNA, 1089 bp, Synechococcus elongatus; identical to SEQ ID NO: 24715
  CDS (1)..(1089)

SEQ ID NO: 52870 - protein, 362 aa, Synechococcus elongatus; identical to SEQ ID NO: 24716

SEQ ID NO: 52871 - DNA, 966 bp, Synechococcus elongatus; identical to SEQ ID NO: 24717
  CDS (1)..(966)

SEQ ID NO: 52872 - protein, 321 aa, Synechococcus elongatus; identical to SEQ ID NO: 24718

SEQ ID NO: 52873 - DNA, 927 bp, Streptococcus mutans; identical to SEQ ID NO: 24719
  CDS (1)..(927)

SEQ ID NO: 52874 - protein, 308 aa, Streptococcus mutans; identical to SEQ ID NO: 24720

SEQ ID NO: 52875 - DNA, 927 bp, Streptococcus agalactiae; identical to SEQ ID NO: 24721
  CDS (1)..(927)

SEQ ID NO: 52876 - protein, 308 aa, Streptococcus agalactiae; identical to SEQ ID NO: 24722

SEQ ID NO: 52877 - DNA, 969 bp, Shewanella oneidensis; identical to SEQ ID NO: 24723
  CDS (1)..(969)

SEQ ID NO: 52878 - protein, 322 aa, Shewanella oneidensis; identical to SEQ ID NO: 24724

SEQ ID NO: 52879 - DNA, 924 bp, Oceanobacillus iheyensis; identical to SEQ ID NO: 24725
  CDS (1)..(924)

SEQ ID NO: 52880 - protein, 307 aa, Oceanobacillus iheyensis; identical to SEQ ID NO: 24726

SEQ ID NO: 52881 - DNA, 927 bp, Oceanobacillus iheyensis; identical to SEQ ID NO: 24727
  CDS (1)..(927)

SEQ ID NO: 52882 - protein, 308 aa, Oceanobacillus iheyensis; identical to SEQ ID NO: 24728

SEQ ID NO: 52883 - DNA, 930 bp, Leptospira interrogans; identical to SEQ ID NO: 24729
  CDS (1)..(930)

SEQ ID NO: 52884 - protein, 309 aa, Leptospira interrogans; identical to SEQ ID NO: 24730

SEQ ID NO: 52885 - DNA, 936 bp, Corynebacterium efficiens; identical to SEQ ID NO: 24731
  CDS (1)..(936)

SEQ ID NO: 52886 - protein, 311 aa, Corynebacterium efficiens; identical to SEQ ID NO: 24732

SEQ ID NO: 52887 - DNA, 1227 bp, Bifidobacterium longum; identical to SEQ ID NO: 24733
  CDS (1)..(1227)

SEQ ID NO: 52888 - protein, 408 aa, Bifidobacterium longum; identical to SEQ ID NO: 24734

SEQ ID NO: 52889 - DNA, 1572 bp, Phytophthora infestans; identical to SEQ ID NO: 24735
  CDS (5)..(1474)

SEQ ID NO: 52890 - protein, 489 aa, Phytophthora infestans; identical to SEQ ID NO: 24736

SEQ ID NO: 52891 - DNA, 942 bp, Streptococcus pyogenes; identical to SEQ ID NO: 24737
  CDS (1)..(942)

SEQ ID NO: 52892 - protein, 313 aa, Streptococcus pyogenes; identical to SEQ ID NO: 24738

SEQ ID NO: 52893 - DNA, 1371 bp, Chlorobium tepidum; identical to SEQ ID NO: 24739
  CDS (1)..(1371)

SEQ ID NO: 52894 - protein, 456 aa, Chlorobium tepidum; identical to SEQ ID NO: 24740

SEQ ID NO: 52895 - DNA, 933 bp, Chlorobium tepidum; identical to SEQ ID NO: 24741
  CDS (1)..(933)

SEQ ID NO: 52896 - protein, 310 aa, Chlorobium tepidum; identical to SEQ ID NO: 24742

SEQ ID NO: 52897 - DNA, 1075 bp, Fusobacterium nucleatum; identical to SEQ ID NO: 24743
  CDS (135)..(1055)

SEQ ID NO: 52898 - protein, 306 aa, Fusobacterium nucleatum; identical to SEQ ID NO: 24744

SEQ ID NO: 52899 - DNA, 1386 bp, Rhodococcus erythropolis; identical to SEQ ID NO: 24745
  CDS (1)..(1386)

SEQ ID NO: 52900 - protein, 461 aa, Rhodococcus erythropolis; identical to SEQ ID NO: 24746

SEQ ID NO: 52901 - DNA, 1303 bp, Arabidopsis thaliana; identical to SEQ ID NO: 24747
  CDS (93)..(1067)

SEQ ID NO: 52902 - protein, 324 aa, Arabidopsis thaliana; identical to SEQ ID NO: 24748

SEQ ID NO: 52903 - DNA, 1422 bp, Arabidopsis thaliana; identical to SEQ ID NO: 24749
  CDS (239)..(1210)

SEQ ID NO: 52904 - protein, 323 aa, Arabidopsis thaliana; identical to SEQ ID NO: 24750

SEQ ID NO: 52905 - DNA, 1602 bp, Magnaporthe grisea; identical to SEQ ID NO: 24751
  CDS (1)..(1602)

SEQ ID NO: 52906 - protein, 533 aa, Magnaporthe grisea; identical to SEQ ID NO: 24752

SEQ ID NO: 52907 - DNA, 960 bp, Xanthomonas campestris; identical to SEQ ID NO: 24753
  CDS (1)..(960)

SEQ ID NO: 52908 - protein, 319 aa, Xanthomonas campestris; identical to SEQ ID NO: 24754

SEQ ID NO: 52909 - DNA, 1371 bp, Xanthomonas campestris; identical to SEQ ID NO: 24755
  CDS (1)..(1371)

SEQ ID NO: 52910 - protein, 456 aa, Xanthomonas campestris; identical to SEQ ID NO: 24756

SEQ ID NO: 52911 - DNA, 1371 bp, Xanthomonas axonopodis; identical to SEQ ID NO: 24757
  CDS (1)..(1371)

SEQ ID NO: 52912 - protein, 456 aa, Xanthomonas axonopodis; identical to SEQ ID NO: 24758

SEQ ID NO: 52913 - DNA, 960 bp, Xanthomonas axonopodis; identical to SEQ ID NO: 24759
  CDS (1)..(960)

SEQ ID NO: 52914 - protein, 319 aa, Xanthomonas axonopodis; identical to SEQ ID NO: 24760

SEQ ID NO: 52915 - DNA, 939 bp, Thermoanaerobacter tengcongensis; identical to SEQ ID NO: 24761
  CDS (1)..(939)

SEQ ID NO: 52916 - protein, 312 aa, Thermoanaerobacter tengcongensis; identical to SEQ ID NO: 24762

SEQ ID NO: 52917 - DNA, 921 bp, Thermoanaerobacter tengcongensis; identical to SEQ ID NO: 24763
  CDS (1)..(921)

SEQ ID NO: 52918 - protein, 306 aa, Thermoanaerobacter tengcongensis; identical to SEQ ID NO: 24764

SEQ ID NO: 52919 - DNA, 951 bp, Fusobacterium nucleatum; identical to SEQ ID NO: 24765
  CDS (1)..(951)

SEQ ID NO: 52920 - protein, 316 aa, Fusobacterium nucleatum; identical to SEQ ID NO: 24766

SEQ ID NO: 52921 - DNA, 927 bp, Methanosarcina acetivorans; identical to SEQ ID NO: 24767
  CDS (1)..(927)

SEQ ID NO: 52922 - protein, 308 aa, Methanosarcina acetivorans; identical to SEQ ID NO: 24768

SEQ ID NO: 52923 - DNA, 1267 bp, Glycine max; identical to SEQ ID NO: 24769
  CDS (82)..(1059)

SEQ ID NO: 52924 - protein, 325 aa, Glycine max; identical to SEQ ID NO: 24770

SEQ ID NO: 52925 - DNA, 903 bp, Clostridium perfringens; identical to SEQ ID NO: 24771
  CDS (1)..(903)

SEQ ID NO: 52926 - protein, 300 aa, Clostridium perfringens; identical to SEQ ID NO: 24772

SEQ ID NO: 52927 - DNA, 975 bp, Ralstonia solanacearum; identical to SEQ ID NO: 24773
  CDS (1)..(975)

SEQ ID NO: 52928 - protein, 324 aa, Ralstonia solanacearum; identical to SEQ ID NO: 24774

SEQ ID NO: 52929 - DNA, 903 bp, Ralstonia solanacearum; identical to SEQ ID NO: 24775
  CDS (1)..(903)

SEQ ID NO: 52930 - protein, 300 aa, Ralstonia solanacearum; identical to SEQ ID NO: 24776

SEQ ID NO: 52931 - DNA, 2433 bp, Mus musculus; identical to SEQ ID NO: 24777
  CDS (187)..(1872)

SEQ ID NO: 52932 - protein, 561 aa, Mus musculus; identical to SEQ ID NO: 24778

SEQ ID NO: 52933 - DNA, 969 bp, Rhizobium meliloti; identical to SEQ ID NO: 24779
  CDS (1)..(969)

SEQ ID NO: 52934 - protein, 322 aa, Rhizobium meliloti; identical to SEQ ID NO: 24780

SEQ ID NO: 52935 - DNA, 1601 bp, Pichia pastoris; identical to SEQ ID NO: 24781
  CDS (14)..(1519)

SEQ ID NO: 52936 - protein, 501 aa, Pichia pastoris; identical to SEQ ID NO: 24782

SEQ ID NO: 52937 - DNA, 1089 bp, Rhizobium loti; identical to SEQ ID NO: 24783
  CDS (1)..(1089)

SEQ ID NO: 52938 - protein, 362 aa, Rhizobium loti; identical to SEQ ID NO: 24784

SEQ ID NO: 52939 - DNA, 1440 bp, Rhizobium loti; identical to SEQ ID NO: 24785
  CDS (1)..(1440)

SEQ ID NO: 52940 - protein, 479 aa, Rhizobium loti; identical to SEQ ID NO: 24786

SEQ ID NO: 52941 - DNA, 1035 bp, Rhizobium loti; identical to SEQ ID NO: 24787
  CDS (1)..(1035)

SEQ ID NO: 52942 - protein, 344 aa, Rhizobium loti; identical to SEQ ID NO: 24788

SEQ ID NO: 52943 - DNA, 1370 bp, Trypanosoma cruzi; identical to SEQ ID NO: 24789
  CDS (15)..(1169)

SEQ ID NO: 52944 - protein, 384 aa, Trypanosoma cruzi; identical to SEQ ID NO: 24790

SEQ ID NO: 52945 - DNA, 1200 bp, Arabidopsis thaliana; identical to SEQ ID NO: 24791
  CDS (1)..(1200)

SEQ ID NO: 52946 - protein, 399 aa, Arabidopsis thaliana; identical to SEQ ID NO: 24792

SEQ ID NO: 52947 - DNA, 948 bp, Pasteurella multocida; identical to SEQ ID NO: 24793
  CDS (1)..(948)

SEQ ID NO: 52948 - protein, 315 aa, Pasteurella multocida; identical to SEQ ID NO: 24794

SEQ ID NO: 52949 - DNA, 1392 bp, Streptomyces venezuelae; identical to SEQ ID NO: 24795
  CDS (1)..(1392)

SEQ ID NO: 52950 - protein, 463 aa, Streptomyces venezuelae; identical to SEQ ID NO: 24796

SEQ ID NO: 52951 - DNA, 927 bp, Bacillus stearothermophilus; identical to SEQ ID NO: 24797
  CDS (1)..(927)

SEQ ID NO: 52952 - protein, 308 aa, Bacillus stearothermophilus; identical to SEQ ID NO: 24798

SEQ ID NO: 52953 - DNA, 951 bp, Selenomonas ruminantium; identical to SEQ ID NO: 24799
  CDS (19)..(951)

SEQ ID NO: 52954 - protein, 310 aa, Selenomonas ruminantium; identical to SEQ ID NO: 24800

SEQ ID NO: 52955 - DNA, 1378 bp, Solanum tuberosum; identical to SEQ ID NO: 24801
  CDS (55)..(1215)

SEQ ID NO: 52956 - protein, 386 aa, Solanum tuberosum; identical to SEQ ID NO: 24802

SEQ ID NO: 52957 - DNA, 1354 bp, Solanum tuberosum; identical to SEQ ID NO: 24803
  CDS (85)..(1062)

SEQ ID NO: 52958 - protein, 325 aa, Solanum tuberosum; identical to SEQ ID NO: 24804

SEQ ID NO: 52959 - DNA, 1250 bp, Solanum tuberosum; identical to SEQ ID NO: 24805
  CDS (96)..(1139)

SEQ ID NO: 52960 - protein, 347 aa, Solanum tuberosum; identical to SEQ ID NO: 24806

SEQ ID NO: 52961 - DNA, 1493 bp, Nicotiana tabacum; identical to SEQ ID NO: 24807
  CDS (88)..(1062)

SEQ ID NO: 52962 - protein, 324 aa, Nicotiana tabacum; identical to SEQ ID NO: 24808

SEQ ID NO: 52963 - DNA, 927 bp, Methanosarcina thermophila; identical to SEQ ID NO: 24809
  CDS (1)..(927)

SEQ ID NO: 52964 - protein, 308 aa, Methanosarcina thermophila; identical to SEQ ID NO: 24810

SEQ ID NO: 52965 - DNA, 1269 bp, Salmonella enterica subsp; identical to SEQ ID NO: 24811
  CDS (205)..(1176)

SEQ ID NO: 52966 - protein, 323 aa, Salmonella enterica subsp; identical to SEQ ID NO: 24812

SEQ ID NO: 52967 - DNA, 1386 bp, Streptomyces coelicolor; identical to SEQ ID NO: 24813
  CDS (1)..(1386)

SEQ ID NO: 52968 - protein, 461 aa, Streptomyces coelicolor; identical to SEQ ID NO: 24814

SEQ ID NO: 52969 - DNA, 915 bp, Clostridium sticklandii; identical to SEQ ID NO: 24815
  CDS (1)..(915)

SEQ ID NO: 52970 - protein, 304 aa, Clostridium sticklandii; identical to SEQ ID NO: 24816

SEQ ID NO: 52971 - DNA, 1671 bp, Allium tuberosum; identical to SEQ ID NO: 24817
  CDS (417)..(1394)

SEQ ID NO: 52972 - protein, 325 aa, Allium tuberosum; identical to SEQ ID NO: 24818

SEQ ID NO: 52973 - DNA, 1868 bp, Oryctolagus cuniculus; identical to SEQ ID NO: 24819
  CDS (71)..(1726)

SEQ ID NO: 52974 - protein, 551 aa, Oryctolagus cuniculus; identical to SEQ ID NO: 24820

SEQ ID NO: 52975 - DNA, 1077 bp, Leishmania tarentolae; identical to SEQ ID NO: 24821
  CDS (1)..(1077)

SEQ ID NO: 52976 - protein, 358 aa, Leishmania tarentolae; identical to SEQ ID NO: 24822

SEQ ID NO: 52977 - DNA, 990 bp, Synechococcus sp; identical to SEQ ID NO: 24823
  CDS (1)..(990)

SEQ ID NO: 52978 - protein, 329 aa, Synechococcus sp; identical to SEQ ID NO: 24824

SEQ ID NO: 52979 - DNA, 921 bp, Lactococcus lactis; identical to SEQ ID NO: 24825
  CDS (1)..(921)

SEQ ID NO: 52980 - protein, 306 aa, Lactococcus lactis; identical to SEQ ID NO: 24826

SEQ ID NO: 52981 - DNA, 1014 bp, Zymomonas mobilis; identical to SEQ ID NO: 24827
  CDS (1)..(1014)

SEQ ID NO: 52982 - protein, 337 aa, Zymomonas mobilis; identical to SEQ ID NO: 24828

SEQ ID NO: 52983 - DNA, 927 bp, Streptococcus suis; identical to SEQ ID NO: 24829
  CDS (1)..(927)

SEQ ID NO: 52984 - protein, 308 aa, Streptococcus suis; identical to SEQ ID NO: 24830

SEQ ID NO: 52985 - DNA, 1173 bp, Cyanidioschyzon merolae; identical to SEQ ID NO: 24831
  CDS (1)..(1173)

SEQ ID NO: 52986 - protein, 390 aa, Cyanidioschyzon merolae; identical to SEQ ID NO: 24832

SEQ ID NO: 52987 - DNA, 1170 bp, Cyanidioschyzon merolae; identical to SEQ ID NO: 24833
  CDS (1)..(1170)

SEQ ID NO: 52988 - protein, 389 aa, Cyanidioschyzon merolae; identical to SEQ ID NO: 24834

SEQ ID NO: 52989 - DNA, 972 bp, Arabidopsis thaliana; identical to SEQ ID NO: 24835
  CDS (1)..(972)

SEQ ID NO: 52990 - protein, 323 aa, Arabidopsis thaliana; identical to SEQ ID NO: 24836

SEQ ID NO: 52991 - DNA, 1068 bp, Entamoeba dispar; identical to SEQ ID NO: 24837
  CDS (26)..(1036)

SEQ ID NO: 52992 - protein, 336 aa, Entamoeba dispar; identical to SEQ ID NO: 24838

SEQ ID NO: 52993 - DNA, 1151 bp, Entamoeba dispar; identical to SEQ ID NO: 24839
  CDS (100)..(1110)

SEQ ID NO: 52994 - protein, 336 aa, Entamoeba dispar; identical to SEQ ID NO: 24840

SEQ ID NO: 52995 - DNA, 1780 bp, Drosophila melanogaster; identical to SEQ ID NO: 24841
  CDS (66)..(1634)

SEQ ID NO: 52996 - protein, 522 aa, Drosophila melanogaster; identical to SEQ ID NO: 24842

SEQ ID NO: 52997 - DNA, 1020 bp, Oryza sativa; identical to SEQ ID NO: 24843
  CDS (1)..(1020)

SEQ ID NO: 52998 - protein, 339 aa, Oryza sativa; identical to SEQ ID NO: 24844

SEQ ID NO: 52999 - DNA, 1758 bp, Fugu rubripes; identical to SEQ ID NO: 24845
  CDS (1)..(1758)

SEQ ID NO: 53000 - protein, 585 aa, Fugu rubripes; identical to SEQ ID NO: 24846

SEQ ID NO: 53001 - DNA, 1511 bp, Dictyostelium discoideum; identical to SEQ ID NO: 24847
  CDS (1)..(1494)

SEQ ID NO: 53002 - protein, 497 aa, Dictyostelium discoideum; identical to SEQ ID NO: 24848

SEQ ID NO: 53003 - DNA, 1280 bp, Brassica juncea; identical to SEQ ID NO: 24849
  CDS (74)..(1042)

SEQ ID NO: 53004 - protein, 322 aa, Brassica juncea; identical to SEQ ID NO: 24850

SEQ ID NO: 53005 - DNA, 1290 bp, Oryza sativa; identical to SEQ ID NO: 24851
  CDS (74)..(1039)

SEQ ID NO: 53006 - protein, 321 aa, Oryza sativa; identical to SEQ ID NO: 24852

SEQ ID NO: 53007 - DNA, 1238 bp, Brassica juncea; identical to SEQ ID NO: 24853
  CDS (18)..(992)

SEQ ID NO: 53008 - protein, 324 aa, Brassica juncea; identical to SEQ ID NO: 24854

SEQ ID NO: 53009 - DNA, 1363 bp, Oryza sativa; identical to SEQ ID NO: 24855
  CDS (139)..(1116)

SEQ ID NO: 53010 - protein, 325 aa, Oryza sativa; identical to SEQ ID NO: 24856

SEQ ID NO: 53011 - DNA, 969 bp, Buchnera aphidicola; identical to SEQ ID NO: 24857
  CDS (1)..(969)

SEQ ID NO: 53012 - protein, 322 aa, Buchnera aphidicola; identical to SEQ ID NO: 24858

SEQ ID NO: 53013 - DNA, 942 bp, Staphylococcus epidermidis; identical to SEQ ID NO: 24859
  CDS (10)..(942)

SEQ ID NO: 53014 - protein, 310 aa, Staphylococcus epidermidis; identical to SEQ ID NO: 24860

SEQ ID NO: 53015 - DNA, 1459 bp, Arabidopsis thaliana; identical to SEQ ID NO: 24861
  CDS (1)..(1215)

SEQ ID NO: 53016 - protein, 404 aa, Arabidopsis thaliana; identical to SEQ ID NO: 24862

SEQ ID NO: 53017 - DNA, 24 bp, Primer
atgagtaagatttttgaagataac

SEQ ID NO: 53018 - DNA, 25 bp, Primer
ttactgttgcaattctttctcagtg

SEQ ID NO: 53019 - protein, 420 aa, consensus; identical to SEQ ID NO: 25512
  MISC_FEATURE (1)..(420): consensus for the disclosure of xaa see table XV

SEQ ID NO: 53020 - protein, 56 aa, consensus; identical to SEQ ID NO: 25508
  MISC_FEATURE (1)..(56): consensus for the disclosure of xaa see table XV

SEQ ID NO: 53021 - protein, 53 aa, consensus; identical to SEQ ID NO: 25509
  MISC_FEATURE (1)..(53): consensus for the disclosure of xaa see table XV

SEQ ID NO: 53022 - protein, 74 aa, consensus; identical to SEQ ID NO: 25510
  MISC_FEATURE (1)..(74): consensus for the disclosure of xaa see table XV

SEQ ID NO: 53023 - protein, 32 aa, consensus; identical to SEQ ID NO: 25511
  MISC_FEATURE (1)..(32): consensus for the disclosure of xaa see table XV

SEQ ID NO: 53024 - DNA, 681 bp, Escherichia coli K12; identical to SEQ ID NO: 30948
  CDS (1)..(681)

SEQ ID NO: 53025 - protein, 226 aa, Escherichia coli K12; identical to SEQ ID NO: 30949

SEQ ID NO: 53026 - DNA, 738 bp, Pseudomonas sp; identical to SEQ ID NO: 30950
  CDS (1)..(738)

SEQ ID NO: 53027 - protein, 245 aa, Pseudomonas sp; identical to SEQ ID NO: 30951

SEQ ID NO: 53028 - DNA, 678 bp, Salmonella enterica subsp. enterica serovar Typhi; identical to SEQ ID NO: 30952
  CDS (1)..(678)

SEQ ID NO: 53029 - protein, 225 aa, Salmonella enterica subsp. enterica serovar Typhi; identical to SEQ ID NO: 30953

SEQ ID NO: 53030 - DNA, 675 bp, Sinorhizobium meliloti; identical to SEQ ID NO: 30954
  CDS (1)..(675)

SEQ ID NO: 53031 - protein, 224 aa, Sinorhizobium meliloti; identical to SEQ ID NO: 30955

SEQ ID NO: 53032 - DNA, 923 bp, Pseudomonas pseudoalcaligenes; identical to SEQ ID NO: 30956
  CDS (95)..(832)

SEQ ID NO: 53033 - protein, 245 aa, Pseudomonas pseudoalcaligenes; identical to SEQ ID NO: 30957

SEQ ID NO: 53034 - DNA, 681 bp, Bacillus licheniformis DSM 13; identical to SEQ ID NO: 30958
  CDS (1)..(681)

SEQ ID NO: 53035 - protein, 226 aa, Bacillus licheniformis DSM 13; identical to SEQ ID NO: 30959

SEQ ID NO: 53036 - DNA, 654 bp, Photobacterium profundum; identical to SEQ ID NO: 30960
  CDS (1)..(654)

SEQ ID NO: 53037 - protein, 217 aa, Photobacterium profundum; identical to SEQ ID NO: 30961

SEQ ID NO: 53038 - DNA, 732 bp, Rhodopseudomonas palustris; identical to SEQ ID NO: 30962
  CDS (1)..(732)

SEQ ID NO: 53039 - protein, 243 aa, Rhodopseudomonas palustris; identical to SEQ ID NO: 30963

SEQ ID NO: 53040 - DNA, 711 bp, Rhodopseudomonas palustris; identical to SEQ ID NO: 30964
  CDS (1)..(711)

SEQ ID NO: 53041 - protein, 236 aa, Rhodopseudomonas palustris; identical to SEQ ID NO: 30965

SEQ ID NO: 53042 - DNA, 666 bp, Rhodopseudomonas palustris; identical to SEQ ID NO: 30966
  CDS (1)..(666)

SEQ ID NO: 53043 - protein, 221 aa, Rhodopseudomonas palustris; identical to SEQ ID NO: 30967

SEQ ID NO: 53044 - DNA, 738 bp, Rhizobium sp; identical to SEQ ID NO: 30968
  CDS (1)..(738)

SEQ ID NO: 53045 - protein, 245 aa, Rhizobium sp; identical to SEQ ID NO: 30969

SEQ ID NO: 53046 - DNA, 720 bp, Rhizobium sp; identical to SEQ ID NO: 30970
  CDS (1)..(720)

SEQ ID NO: 53047 - protein, 239 aa, Rhizobium sp; identical to SEQ ID NO: 30971

SEQ ID NO: 53048 - DNA, 675 bp, Chromobacterium violaceum; identical to SEQ ID NO: 30972
  CDS (1)..(675)

SEQ ID NO: 53049 - protein, 224 aa, Chromobacterium violaceum; identical to SEQ ID NO: 30973

SEQ ID NO: 53050 - DNA, 663 bp, Bordetella parapertussis; identical to SEQ ID NO: 30974
  CDS (1)..(663)

SEQ ID NO: 53051 - protein, 220 aa, Bordetella parapertussis; identical to SEQ ID NO: 30975

SEQ ID NO: 53052 - DNA, 711 bp, Bordetella parapertussis; identical to SEQ ID NO: 30976
  CDS (1)..(711)

SEQ ID NO: 53053 - protein, 236 aa, Bordetella parapertussis; identical to SEQ ID NO: 30977

SEQ ID NO: 53054 - DNA, 741 bp, Bordetella parapertussis; identical to SEQ ID NO: 30978
  CDS (1)..(741)

SEQ ID NO: 53055 - protein, 246 aa, Bordetella parapertussis; identical to SEQ ID NO: 30979

SEQ ID NO: 53056 - DNA, 657 bp, Bordetella bronchiseptica; identical to SEQ ID NO: 30980
  CDS (1)..(657)

SEQ ID NO: 53057 - protein, 218 aa, Bordetella bronchiseptica; identical to SEQ ID NO: 30981

SEQ ID NO: 53058 - DNA, 945 bp, Wautersia oxalatica; identical to SEQ ID NO: 30982
  CDS (1)..(945)

SEQ ID NO: 53059 - protein, 314 aa, Wautersia oxalatica; identical to SEQ ID NO: 30983

SEQ ID NO: 53060 - DNA, 699 bp, Ralstonia sp; identical to SEQ ID NO: 30984
  CDS (1)..(699)

SEQ ID NO: 53061 - protein, 232 aa, Ralstonia sp; identical to SEQ ID NO: 30985

SEQ ID NO: 53062 - DNA, 675 bp, Vibrio parahaemolyticus; identical to SEQ ID NO: 30986
  CDS (1)..(675)

SEQ ID NO: 53063 - protein, 224 aa, Vibrio parahaemolyticus; identical to SEQ ID NO: 30987

SEQ ID NO: 53064 - DNA, 669 bp, Vibrio parahaemolyticus; identical to SEQ ID NO: 30988
  CDS (1)..(669)

SEQ ID NO: 53065 - protein, 222 aa, Vibrio parahaemolyticus; identical to SEQ ID NO: 30989

SEQ ID NO: 53066 - DNA, 729 bp, Pseudomonas syringae; identical to SEQ ID NO: 30990
  CDS (31)..(729)

SEQ ID NO: 53067 - protein, 232 aa, Pseudomonas syringae; identical to SEQ ID NO: 30991

SEQ ID NO: 53068 - DNA, 696 bp, Pseudomonas putida; identical to SEQ ID NO: 30992
  CDS (1)..(696)

SEQ ID NO: 53069 - protein, 231 aa, Pseudomonas putida; identical to SEQ ID NO: 30993

SEQ ID NO: 53070 - DNA, 717 bp, Pseudomonas putida; identical to SEQ ID NO: 30994
  CDS (1)..(717)

SEQ ID NO: 53071 - protein, 238 aa, Pseudomonas putida; identical to SEQ ID NO: 30995

SEQ ID NO: 53072 - DNA, 774 bp, Bradyrhizobium japonicum; identical to SEQ ID NO: 30996
  CDS (1)..(774)

SEQ ID NO: 53073 - protein, 257 aa, Bradyrhizobium japonicum; identical to SEQ ID NO: 30997

SEQ ID NO: 53074 - DNA, 693 bp, Bradyrhizobium japonicum; identical to SEQ ID NO: 30998
  CDS (1)..(693)

SEQ ID NO: 53075 - protein, 230 aa, Bradyrhizobium japonicum; identical to SEQ ID NO: 30999

SEQ ID NO: 53076 - DNA, 924 bp, Bradyrhizobium japonicum; identical to SEQ ID NO: 31000
  CDS (1)..(924)

SEQ ID NO: 53077 - protein, 307 aa, Bradyrhizobium japonicum; identical to SEQ ID NO: 31001

SEQ ID NO: 53078 - DNA, 720 bp, Bradyrhizobium japonicum; identical to SEQ ID NO: 31002
  CDS (1)..(720)

SEQ ID NO: 53079 - protein, 239 aa, Bradyrhizobium japonicum; identical to SEQ ID NO: 31003

SEQ ID NO: 53080 - DNA, 627 bp, Vibrio vulnificus; identical to SEQ ID NO: 31004
  CDS (1)..(627)

SEQ ID NO: 53081 - protein, 208 aa, Vibrio vulnificus; identical to SEQ ID NO: 31005

SEQ ID NO: 53082 - DNA, 672 bp, Shewanella oneidensis; identical to SEQ ID NO: 31006
  CDS (1)..(672)

SEQ ID NO: 53083 - protein, 223 aa, Shewanella oneidensis; identical to SEQ ID NO: 31007

SEQ ID NO: 53084 - DNA, 675 bp, Xanthomonas campestris; identical to SEQ ID NO: 31008
  CDS (1)..(675)

SEQ ID NO: 53085 - protein, 224 aa, Xanthomonas campestris; identical to SEQ ID NO: 31009

SEQ ID NO: 53086 - DNA, 675 bp, Xanthomonas axonopodis; identical to SEQ ID NO: 31010
  CDS (1)..(675)

SEQ ID NO: 53087 - protein, 224 aa, Xanthomonas axonopodis; identical to SEQ ID NO: 31011

SEQ ID NO: 53088 - DNA, 765 bp, Pseudomonas sp; identical to SEQ ID NO: 31012
  CDS (1)..(765)

SEQ ID NO: 53089 - protein, 254 aa, Pseudomonas sp; identical to SEQ ID NO: 31013

SEQ ID NO: 53090 - DNA, 762 bp, Rhizobium loti; identical to SEQ ID NO: 31014
  CDS (1)..(762)

SEQ ID NO: 53091 - protein, 253 aa, Rhizobium loti; identical to SEQ ID NO: 31015

SEQ ID NO: 53092 - DNA, 663 bp, Rhizobium loti; identical to SEQ ID NO: 31016
  CDS (1)..(663)

SEQ ID NO: 53093 - protein, 220 aa, Rhizobium loti; identical to SEQ ID NO: 31017

SEQ ID NO: 53094 - DNA, 744 bp, Rhizobium loti; identical to SEQ ID NO: 31018
  CDS (1)..(744)

SEQ ID NO: 53095 - protein, 247 aa, Rhizobium loti; identical to SEQ ID NO: 31019

SEQ ID NO: 53096 - DNA, 780 bp, Rhizobium loti; identical to SEQ ID NO: 31020
  CDS (1)..(780)

SEQ ID NO: 53097 - protein, 259 aa, Rhizobium loti; identical to SEQ ID NO: 31021

SEQ ID NO: 53098 - DNA, 693 bp, Streptomyces coelicolor; identical to SEQ ID NO: 31022
  CDS (1)..(693)

SEQ ID NO: 53099 - protein, 230 aa, Streptomyces coelicolor; identical to SEQ ID NO: 31023

SEQ ID NO: 53100 - DNA, 732 bp, Alcaligenes eutrophus; identical to SEQ ID NO: 31024
  CDS (1)..(732)

SEQ ID NO: 53101 - protein, 243 aa, Alcaligenes eutrophus; identical to SEQ ID NO: 31025

SEQ ID NO: 53102 - DNA, 741 bp, Rhodococcus sp; identical to SEQ ID NO: 31026
  CDS (1)..(741)

SEQ ID NO: 53103 - protein, 246 aa, Rhodococcus sp; identical to SEQ ID NO: 31027

SEQ ID NO: 53104 - DNA, 780 bp, Comamonas testosteroni; identical to SEQ ID NO: 31028
  CDS (25)..(744)

SEQ ID NO: 53105 - protein, 239 aa, Comamonas testosteroni; identical to SEQ ID NO: 31029

SEQ ID NO: 53106 - DNA, 666 bp, Photobacterium leiognathi; identical to SEQ ID NO: 31030
  CDS (1)..(666)

SEQ ID NO: 53107 - protein, 221 aa, Photobacterium leiognathi; identical to SEQ ID NO: 31031

SEQ ID NO: 53108 - DNA, 22 bp, Primer
atgatcaggagtcacaccatga

SEQ ID NO: 53109 - DNA, 21 bp, Primer
ttaattgccagccatcgcctg

SEQ ID NO: 53110 - protein, 178 aa, consensus; identical to SEQ ID NO: 31034
  MISC_FEATURE (1)..(178): consensus for the disclosure of xaa see table XV

SEQ ID NO: 53111 - protein, 81 aa, consensus; identical to SEQ ID NO: 31035
  MISC_FEATURE (1)..(81): consensus for the disclosure of xaa see table XV

SEQ ID NO: 53112 - protein, 12 aa, consensus
  MISC_FEATURE (1)..(12): consensus for the disclosure of xaa see table XV
XXXXXXXXXXXX

SEQ ID NO: 53113 - DNA, 990 bp, Escherichia coli
  CDS (1)..(990)
atgcatattacatacgatctgccggttgctattgatgacattattgaagcgaaacaacgactggctgggcgaatttataaaacaggcatgcctcgctccaactattttagtgaacgttgcaaaggtgaaatattcctgaagtttgaaaatatgcagcgtacgggttcatttaaaattcgtggcgcatttaataaattaagttcactgactgatgcggaaaaacgcaaaggcgtggtggcctgttctgcgggcaaccatgcgcaaggggtttcgctctcctgcgcgatgctgggtatcgacggtaaagtggtgatgccaaaaggcgcgccgaaatccaaagtagcggcaacgtgcgactactccgcagaagtcgttctgcatggtgataacttcaacgacactatcgctaaagtgagcgaaattgtcgaaatggaaggccgtatttttatcccaccttacgatgatccgaaagtgattgctggtcagggaacgattggcctggaaattatggaagatctctatgatgtcgataacgtgattgtgccaattggtggtggcggtttaattgctggtattgcggtggcaattaaatctattaacccgaccattcgtgttattggcgtacagtctgaaaacgttcacggcatggcggcttctttccactccggagaaataaccacgcaccgaactaccggcaccctggcggatggttgtgatgtctcccgcccgggtaatttaacttacgaaatcgttcgtgaattagtcgatgacatcgtgctggtcagcgaagacgaaatcagaaacagtatgattgccttaattcagcgcaataaagtcgtcaccgaaggcgcaggcgctctggcatgtgctgcattattaagcggtaaattagaccaatatattcaaaacagaaaaaccgtcagtattatttccggcggcaatatcgatctttctcgcgtctctcaaatcaccggtttcgttgacgcttaa

SEQ ID NO: 53114 - protein, 329 aa, Escherichia coli
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 53115 - DNA, 978 bp, Xenopus tropicalis
  CDS (1)..(978)
atggatttcacagagcaagctccttttcatattgtcacccctctgaaagagagccatgctttatccaaattggctgggaccacagttctcatgaagctggaaaatgttcagcccgcagggtcattcaagatacgtgggattggacactattgtcagaagcttgcgaagaaaggctgcacgaggtttgtctgttcctcagggggtaatgctgggcttgcagcagcttatgcttgcagaagattggccctgccagccaccattgttgttccacagaccactggagcagatattgtacagaagctgcaggatctgggagctgacgttgtggtgactggaaaggtctgggacgatgctgatgcacatgctcaccagctgactgaaactcctggcagtgtgtatatctctccgtttaaccatcctctcgtctgggaaggccatgccagccttgtgtgtgaactaaaggcttctttgggttctcagaagccaggtgcacttgtggtttctgtagggggtggcgggctccttgcggggctggctgaagggatgaagaaggtgggctggtctgatattcccataattgcaatggagactaaaggtgcccactgtttgaatgcagcgcttgaagcaggcaaacccatcagccttccagacattaccagtgttgccaagtgtcttggcgcaaagacagtatgtgacagagcctatgagtgtacaagggagcacaaagttatctccattactgttgatgacagagaagccattcgagctgtggaaatgtttttggatgatgagctaatgtttgtggaacctgcatgtggagctgcccttgctgctgtctattcaggacatatccaacgcctgcagcaggagggaagcttgaagacaccccttgaccccatagtgatggtagtgtgtggcggcagtgggatcagcatttctcagcttcaacactttaaatcccaactgaatataaactga

SEQ ID NO: 53116 - protein, 325 aa, Xenopus tropicalis
MDFTEQAPFHIVTPLKESHALSKLAGTTVLMKLENVQPAGSFKIRGIGHYCQKLAKKGCTRFVCSSGGNAGLAAAYACRRLALPATIVVPQTTGADIVQKLQDLGADVVVTGKVWDDADAHAHQLTETPGSVYISPFNHPLVWEGHASLVCELKASLGSQKPGALVVSVGGGGLLAGLAEGMKKVGWSDIPIIAMETKGAHCLNAALEAGKPISLPDITSVAKCLGAKTVCDRAYECTREHKVISITVDDREAIRAVEMFLDDELMFVEPACGAALAAVYSGHIQRLQQEGSLKTPLDPIVMVVCGGSGISISQLQHFKSQLNIN

SEQ ID NO: 53117 - DNA, 1773 bp, Cryptococcus neoformans var. neoformans JEC21
  CDS (1)..(1773)
atggcgcccacacccatccccgtccccgccgcccgcccggccgccagccacctctccaagtcgccgccgacgaccaacgagtacacctccaccgcgcccatccccgccctcccgccgcagcacacggacgagggcgtcccctcccacctctaccaaggcctgcccgcccatctcctgatcgacgatgcccagggacaaaaggtccccgactatctcaggatgatcctgatgtccaaggtctacgccgcgcccctcaacctcaaggaaacccctctcacatatgcagccaacctctccgcccggctcggcaacgagatctggatcaagcgggaggacctccagcccgtgttctcattcaagatccgcggcgcctacaacatgatggccagtctgtccgacgaagaaaagaaaaagggcgtcatcacgtgctccgccggcaaccacgcccagggcgtcgccctctccggccacgcactcaacatccccgccatcgtcgtcatgcccgtctccaccccgtccatcaagtggcgcaacgtccagcgtctcggcgccaccgtcctcctccacggccgcgactttgacgaggccaaggccgagtgtctccgcctcgaaaaggaaaagggcctgacctttgtgcccccgtacgataacccctacgtcgtcgccggccagggaactgtcgccatggaaatctgccgccaagtcacagatgccgaccagatcgatggcatattcgcttccgtcggcggaggcggccttgcggccggtatcgcggcgtacatgaagcgagtcgccaagcccagtgtcggaatctacggtgtcgagaccgttgacggtgatgccatggaccgctcactcaaggccggcaagagggtcctcctcgatgaagtcggcccgtttgcagacggtaccgcggtaaggcttgtcggcgaagaaccttttcgcgtatgcaaaaactttttggacgacgtcgtgcttgtcaacaatgacgagatttgcgccgccatcaaggatgtctttgaagaaacccgatctgtccccgaaccgtccggtgccctcgcactcgcaggcctgaaagcccacattatccgaaacaacctccaaggcgccggtaaacgctttgtcgccgtcatctccggcggtaacatgaactttggccgactccgattcgtcgctgagcgagcggatgtcggcgaacgacgagaagtgctgatgagtgtccgagtgcccgaaaagcctggcagctttttgaaattccactccctcctcggttcacgcgcagtcaccgagttctcctaccgccactccaacaattccaccggctacatcatctgctccttcctcctctcctcctcatcctcttcgtcctccgggccctcacccgaagcgcgcgcaaacgagattcacgagatggtcgaatcgtttaaacagcatgggatcgaagccgtcgatttgagcgaggatgagtttgcaaagagtcatgtgaggcatctggtcggtggacgcagtgccgtggagcacgaaaggatctttaggtttgagttcccggaaagacctggggcacttggaaactttttaaaaggtatgaaggtcgaatggaatatctccatgttccattacagaaaccacggtgccgacgtcggcaaagtcctcatcggcgtccaagtcccgtcccaggacaaccccgcatttgacgagtttttggaaaagctgggatatccatatgtcgaagagacccataatgaggtttacaccatgttcctcaggtcgtaa

SEQ ID NO: 53118 - protein, 590 aa, Cryptococcus neoformans var. neoformans JEC21
MAPTPIPVPAARPAASHLSKSPPTTNEYTSTAPIPALPPQHTDEGVPSHLYQGLPAHLLIDDAQGQKVPDYLRMILMSKVYAAPLNLKETPLTYAANLSARLGNEIWIKREDLQPVFSFKIRGAYNMMASLSDEEKKKGVITCSAGNHAQGVALSGHALNIPAIVVMPVSTPSIKWRNVQRLGATVLLHGRDFDEAKAECLRLEKEKGLTFVPPYDNPYVVAGQGTVAMEICRQVTDADQIDGIFASVGGGGLAAGIAAYMKRVAKPSVGIYGVETVDGDAMDRSLKAGKRVLLDEVGPFADGTAVRLVGEEPFRVCKNFLDDVVLVNNDEICAAIKDVFEETRSVPEPSGALALAGLKAHIIRNNLQGAGKRFVAVISGGNMNFGRLRFVAERADVGERREVLMSVRVPEKPGSFLKFHSLLGSRAVTEFSYRHSNNSTGYIICSFLLSSSSSSSSGPSPEARANEIHEMVESFKQHGIEAVDLSEDEFAKSHVRHLVGGRSAVEHERIFRFEFPERPGALGNFLKGMKVEWNISMFHYRNHGADVGKVLIGVQVPSQDNPAFDEFLEKLGYPYVEETHNEVYTMFLRS

SEQ ID NO: 53119 - DNA, 996 bp, Cryptococcus neoformans var. neoformans JEC21
  CDS (1)..(996)
atggctgccgtcaactacacaatcgaagatccaaacactgtgccatggatcaagacccccctcgtgcgctcagctgcactttcaaagcttgccggctgtgaaatcttactcaagctggaaaatatccagccgagtgggtcgttcaaatctagagggataggtaatctggtccttcagtctgtcaactcagctccaccagacactccgcttcacttctactcttcatcaggaggcaatgctggtctcgcttgcgttaacgcagcatctactctgggctatccttcctctgttatcgtgcctctcagcaccaaaccttttatgattgataagcttcgtaccgctggcgctacagaagtgatccagactggccaaacatggtttgaggcagataagcaccttcaggaagagatacttgcaagagatccgaacggcatctacctcccgccctttgatcactccgacatctggcaaggagcagctactatggtcgacgagattgtgcaagaattaacacacgtcccagatgcgatagtgtgctcagtaggaggaggaggactaatgattggtgtttgtaaaggactggagagactggataaggaaaagaaagcgaaagttgtggcggtcgaaactttaggggcagagtcactacacaagtcggtaaaggcgggacagttgatcactttgccgggtatcgcatcacttgctacttcactaggtgcgacgaccgtcgctgccaaagcactagagtatgctctacagcctcaggttcgtagtacggtagtatcagataaggaagctttagaagcctgtatccggtttcttgatgacgaaagaatcttggttgagccagcctgcggcgcgactttggcaatggtgtattcaggaaagctcaaagatgtgctgaaactcgacgccaaaagcaaagtggtgctcgtggtttgtgggggatcaaatatctcattagaattgatagaaggctataaaaagatgttttga

SEQ ID NO: 53120 - protein, 331 aa, Cryptococcus neoformans var. neoformans JEC21
MAAVNYTIEDPNTVPWIKTPLVRSAALSKLAGCEILLKLENIQPSGSFKSRGIGNLVLQSVNSAPPDTPLHFYSSSGGNAGLACVNAASTLGYPSSVIVPLSTKPFMIDKLRTAGATEVIQTGQTWFEADKHLQEEILARDPNGIYLPPFDHSDIWQGAATMVDEIVQELTHVPDAIVCSVGGGGLMIGVCKGLERLDKEKKAKVVAVETLGAESLHKSVKAGQLITLPGIASLATSLGATTVAAKALEYALQPQVRSTVVSDKEALEACIRFLDDERILVEPACGATLAMVYSGKLKDVLKLDAKSKVVLVVCGGSNISLELIEGYKKMF

SEQ ID NO: 53121 - DNA, 1146 bp, Thermococcus kodakaraensis
  CDS (1)..(1146)
atgaagcttaaatgtccaatatgtggaaaaacttacgatgagcccgtccagaggtgcgagtgcggtgaaccagttgagtttgaagccttcaatgcagagccttaccttggaaagaccgtctgggagagattctgggacttctggccaatagaaccagcaatggatctctcgctcggcgagggggatactcccctcgtgaagtccaaacttggaaaagagctcggggtaaagctctacctgaagaatgagaccgcaaacccgacctggagcttcaaggacaggggaacgtttctggcggtgagctacgcggtcaaagcgggatacaaggccattggaacggtttccactggcaacatggcggccagtgtagctgcttacgccgcgagggctggcctaaaggccaaaattctcgtctcagagagcgcgagcgaggagaagctcaaaactgtgagcgtttacggtgcggacgtgataagggttaggggagattacggaaggctctacttcgagagcctggagctgggtgagaagcttgggatatacttcatcaattccgacaacccattccgcgtcgagggctacaaggggattgccttcgagatggcggaggagcttactcctgactacgtcttaatccccacgagctcaggcggtctgttcaggggaattgccaagggcttcatcgagctgaaggagagcgggctcatcgaaaaactcccaacgctgatagcagtccaggctgaaggctgttcgccgatatgcagggcctttaacgaagggaacgagagaataaagcgcttcgaaaacccaaacacgatagcgaaggccatagcaaatccgtacccgccgagcggaaacgccgtccttaagttgctccgcgacttaggctggaagtgcaccaccgtgagcgacgaagaaatcctcgaagcgcagagagagcttgcaaaggaaggcctcttcgtccagccagcgagcgcaacggggattgctgttctcaaaaagctcgtcgagagtgaaaaaatcgatgaaggggcaaaagttgtgtctattctcacggggtcaggattaaaagtgctcgcacatatgccctccggcaaaatagtaaattgtccgctggaaggactggagaactgtgtgtcattttag

SEQ ID NO: 53122 - protein, 381 aa, Thermococcus kodakaraensis
MKLKCPICGKTYDEPVQRCECGEPVEFEAFNAEPYLGKTVWERFWDFWPIEPAMDLSLGEGDTPLVKSKLGKELGVKLYLKNETANPTWSFKDRGTFLAVSYAVKAGYKAIGTVSTGNMAASVAAYAARAGLKAKILVSESASEEKLKTVSVYGADVIRVRGDYGRLYFESLELGEKLGIYFINSDNPFRVEGYKGIAFEMAEELTPDYVLIPTSSGGLFRGIAKGFIELKESGLIEKLPTLIAVQAEGCSPICRAFNEGNERIKRFENPNTIAKAIANPYPPSGNAVLKLLRDLGWKCTTVSDEEILEAQRELAKEGLFVQPASATGIAVLKKLVESEKIDEGAKVVSILTGSGLKVLAHMPSGKIVNCPLEGLENCVSF

SEQ ID NO: 53123 - DNA, 1269 bp, Staphylococcus aureus subsp. aureus COL
  CDS (1)..(1269)
atgacagtcaaaacaacagtttctacgaaagatatcgatgaggcatttttaagacttaaagatattgtcaaagaaacacctttacaattagaccattacttatctcaaaagtatgattgtaaagtctatttaaaacgagaagatttacaatgggtacgttcttttaaattaagaggtgcttacaacgctatttctgttttatcagatgaagctaaaagtaaaggtattacatgtgcaagtgcaggtaatcatgctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgaaaattataggtgttgaaccttcaggtgcaagtagtatgtatgaatctgttgtggtaaataatcaggtagtcacattgcctaatatcgataaatttgtggacggtgcatctgtagctagagttggcgatattacatttgaaattgcaaaagaaaatgtagatgattacgttcaagtagatgaaggtgcagtttgttctacgattttagatatgtattcaaaacaagcaattgtagcagaacctgctggcgcattaagtgtaagtgcgcttgaaaactataaagatcatattaaaggtaaaacagtggtttgtgtcattagtggtggtaataatgatattaatcgaatgaaagaaattgaagaacgttcattactatacgaagaaatgaagcattactttatcttaaatttccctcaacgtccaggtgcattgagagaatttgtaaatgacgtattaggacctcaagacgatattactaaatttgaatacttaaaaaaatcttctcaaaatacaggtactgtcattattggtattcaacttaaagatcatgatgatttaatacaactcaaacaacgtgtaaatcatttcgatccttccaatatttatattaatgaaaataagatgttatattcattgttaatttaa

SEQ ID NO: 53124 - protein, 422 aa, Staphylococcus aureus subsp. aureus COL
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQAKSDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 53125 - DNA, 1104 bp, Staphylococcus epidermidis RP62A
  CDS (40)..(1104)
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 53126 - protein, 354 aa, Staphylococcus epidermidis RP62A
MKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVIDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 53127 - DNA, 1269 bp, Staphylococcus epidermidis RP62A
  CDS (1)..(1269)
atgacagtaagaactaaagtttcgacaaaagatatagatgaagcatatttacgtctaaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgccaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggcactttagctaaggaaatattaaatcaagctgaaaaagaggataaaacatttgattatgtatttgctgctataggtggtggcggtcttatttcaggagtgagcacatattttaaagcacattccccccatactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggatgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgtcaatgatgtcctcggacctcaagacgatattacaaaatttgaatatttaaagaaaacatcacaaaacactggaactgttattataggtatacagctgaaacatcatgatgatctcattcagttaaaagatcgcgtatgtcaatttgatccttctaatatttatatcaatgaaaataaaatgttatattcattacttatttaa

SEQ ID NO: 53128 - protein, 422 aa, Staphylococcus epidermidis RP62A
MTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 53129 - DNA, 1227 bp, Gluconobacter oxydans 621H
  CDS (1)..(1227)
atgtctgacgtcctgacgtccaccacccctgtcgtgaccatcgcggacatcgagagcgcccatgagcgcatcgcgtccacggtggtccgcacgccgaccatcgcctgcccggccctttcccggctgacaggcgcggagattacgctcaagctcgaaaaccttcaggcgatcggctccttcaaggagcgcggagcggccaacaagatggccctcctgacgccggaagagcgggcgcgcggcgtcattaccgtctcggcaggcaaccacgcacagggtgtggcccgtcaggccagtcttcttggtattgatgcgaccatcgtcatgccgcgcttcacgccggccaccaaggtcgcggcaacgcaggcctggggcgcgaatgtcgtgctcgcaggggacgatttcgcacaggccagcgagaccgctgccgagctccagaagcaggacggccgcgttctcgtccacccgttcaatgatccggccgtcatcgccggtcagggcactgcggcgctggagcttctggaagatgctccggacatcgatacggtcgtcgtgcccgtgggcggcggtggcctgatcggtgggtttgcgaccgtcatggcggcgctgcgtccggatgtcgaggtcattggggtacaggtcgaggcctatgcctcgctgtcaaactacccgcaggaagacggcccgactcagggcggctcaaccatcgcggaaggtatcgccgtcacaaggctcggcgatcactgcctgaacgcctttcgcaacaagatctcgaagatcctcgttgtcagcgagcttcaggtcgaaagctccatcacgacgctggctgaaaaggccaagcaggtctgtgaaggtgcgggcgccacgggccttgctgcagttctggcctatccggagctgttcaagggacgccgcgttgccctgcccctgtctggcggcaacatcaacgcccgtatccttgccaacacaatcctgcgctcccttctccgggacggacggatcctgcggctgatcttccagatccccgaccgtccaggcatgctggcggatatttcggcccgcatcggcaattatggcggaaacatcatcgaagtctcccatcaccgcctgttcgcctccccgtccgttcagacggccgaactgctggtgatggtggaagcccgcgacaccgaacatgcccaccagatcgagaccgatctggcacggcattacatcgtccggcgcgactga

SEQ ID NO: 53130 - protein, 408 aa, Gluconobacter oxydans 621H
MSDVLTSTTPVVTIADIESAHERIASTVVRTPTIACPALSRLTGAEITLKLENLQAIGSFKERGAANKMALLTPEERARGVITVSAGNHAQGVARQASLLGIDATIVMPRFTPATKVAATQAWGANVVLAGDDFAQASETAAELQKQDGRVLVHPFNDPAVIAGQGTAALELLEDAPDIDTVVVPVGGGGLIGGFATVMAALRPDVEVIGVQVEAYASLSNYPQEDGPTQGGSTIAEGIAVTRLGDHCLNAFRNKISKILVVSELQVESSITTLAEKAKQVCEGAGATGLAAVLAYPELFKGRRVALPLSGGNINARILANTILRSLLRDGRILRLIFQIPDRPGMLADISARIGNYGGNIIEVSHHRLFASPSVQTAELLVMVEARDTEHAHQIETDLARHYIVRRD

SEQ ID NO: 53131 - DNA, 1071 bp, Xanthomonas oryzae pv. oryzae KACC10331
  CDS (1)..(1071)
atgaatcggtccttcattgtgcagcaacgcggcgctttgtcatcgatccagcccgcgcggcggcagtgcgtgcgacccgtgaagagggagcgatacgttaatcttgcaggcatgatcgagacggtccctcttgcccattccgacgttctgcaagccgctgcgcggatcgcgccgcactgcgcgccgacaccattgctgacatcgcacagcctggatgcgctcagcggtgcacggttgttcttcaaggccgaacatctgcaacgcagcggggccttcaagttccgcggggcgtgcaatgccgtgtggtcgctgccggacgagcggactgcacatggggtagtgacgcattcatccggcaaccacggcgcggcgctggcgctggccgcacgcacgcgtggcatgggttgccatgtggtggtgcccgaaggcgcggtggcggccaagctggccaatatttcccggcatggcgccaccttgtggcgctgcgcaccgaccatcgcagcgcgtgaacagctatgcgccgaggtgcaggccagcagcggtgccacgctggtgcacccgtataccgatgtcgcggtcatcgccggccaggggacggccacgctggagctgctgcatcaaagcggtggcctggacgtgctggtggcgccggtcggcggtggcgggttggcggccggtgccgcgctggcgctgcgctgcgcacccggctgcgagctggtgctggccgagccggccggcgcagccgataccgcgcgttcgttggcggcaggccagcggctggtcgattttgtgccggacactgtgtgcgatggtctgcgcggcaccttgggcgcgcccaatttcgcgctgctgcagcacgccggcgcgcaggtgatcacagtcgacgatgccgcggtcgtccaggcgatgcggctgatctggcagttgctcaaacaagtggtcgagccgtcttcggtgatcaccctggccgcggtgctggccgagccggcacggtttgccgggcgccgggtgggcttgatcctgtctggtggcaatgtcgatctggatgccttgccatgggccgcggcgtga

SEQ ID NO: 53132 - protein, 356 aa, Xanthomonas oryzae pv. oryzae KACC10331
MNRSFIVQQRGALSSIQPARRQCVRPVKRERYVNLAGMIETVPLAHSDVLQAAARIAPHCAPTPLLTSHSLDALSGARLFFKAEHLQRSGAFKFRGACNAVWSLPDERTAHGVVTHSSGNHGAALALAARTRGMGCHVVVPEGAVAAKLANISRHGATLWRCAPTIAAREQLCAEVQASSGATLVHPYTDVAVIAGQGTATLELLHQSGGLDVLVAPVGGGGLAAGAALALRCAPGCELVLAEPAGAADTARSLAAGQRLVDFVPDTVCDGLRGTLGAPNFALLQHAGAQVITVDDAAVVQAMRLIWQLLKQVVEPSSVITLAAVLAEPARFAGRRVGLILSGGNVDLDALPWAAA

SEQ ID NO: 53133 - DNA, 897 bp, Xanthomonas oryzae pv. oryzae KACC10331
  CDS (1)..(897)
atgcctgattccggccgcccttccgcttccgcacaggagccagaggtaggcgacgtggccgtcagcgtggccgacgtgctggcggcacaggcacgcctgcgcaagtacctgtcgcccacgccgctgcattacgccgaacgcttcggtgtgtggctgaagcttgagaatttgcagcgcaccggctcctacaaggtgcgcggcgcattgaatgcattgctggccgggctggagcgcggcgatgagcgtccggtgatctgtgcctcggccggcaatcatgcgcaaggcgtggcgtggtcggcgtatcggctgggtgtgcaggccatcacggtgatgccctacggcgcgccgcagaccaagatcgccggtgtcgcgcattggggcgccaccgtgcgccagcatggcaacagctacgacgaagcattcgcgtttgcgcgcgagctggccgaccagaacggttatcgctttttgtctgccttcgacgacccggatgtgattgccggccagggcacggtcggcatcgaactggctgcgcatgcgccggacgtggtgatcgtgccgattggcggcggcggggctggcgtctggggtagcgctggcgttgaaatcgcaaggcgtgcgtgtggtcggcgcgcaggtggaaggcgtcgattcgatggcgcgcgccgtgcgcggcgacctgcgcgaaattaccccggttgcaacgctggccgacggcgtgaaggtcaagattccgggctttctcacgcgccgcctgtgctcgagcctgctcgacgatgtggtgatcgtgcgcgaggccgaattacgcgaaacattggtgcgtctggcgctggaagaacacgtgatcgccgaaggcgccggcgcgctggcgctggccgccggacgccgcgtttccggtaa

SEQ ID NO: 53134 - protein, 298 aa, Xanthomonas oryzae pv. oryzae KACC10331
MPDSGRPSASAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGAGVWGSAGVEIARRACGRRAGGRRRFDGARRARRPARNYPGCNAGRRREGQDSGLSHAPPVLEPARRCGDRARGRITRNIGASGAGRTRDRRRRRRAGAGRRTPRFR

SEQ ID NO: 53135 - DNA, 1131 bp, Vibrio fischeri ES114
  CDS (1)..(1131)
atgaaatacctctgtatggcgtgtaataaagaatacgcaccgaaacctgaactcattaaatgtgaatgtggctccgccctatgggttaaacctcaaacgtcatttagtaaaaaagatctcatagaaaatgaattcacacctagacgctattctagtgctttcccagtaaaaaaagacgatatcaatatcactttcaatgaagccatcacacctctttgccaagctgaaatatcaggaactccaatactggttaaactcgattcgctacaaccaacaggctcatttaaagaccgaggtgcctctcttgtaatcaattaccttaacaaccatggaataacaagcattgcagaagactcaagcggtaatggaggaagtgcttatgccggttatgccgctaaaggaaacatgcaatgcaacatatttgtgcctgctggaacatccaaaggaaagacaacacaaacccgattatacggcgctaactgtattgaagtagaaggaacaagagaagatgttgctctagctgcaatagagagcagcgtcactcatggaagtcattatgttgggcataactggcatcccctatttatcgaaggcgtcaaatccatcgcttatgaaatatgggaacagtgtggatataaagcccctgataattttgttgttcccgcaggaaatggaagtttactcgctggagcatatatcggtttctctgaattattaaaaggcggagaaataagcaaactccctcgcctttttggtattcaaagtgaaagcattcagccgtttgtacaaacctttaacaataaagaaatcaacattacttcagaagataccattgctgagggtattaagattaagcgttcatcacgaatgaatgagatcgttcaatttgtaaaagaaacgaatgggaattttattagtgttaatgaacaacaaatccaatcagcattaaaagagatgggagcacaaggatactttatcgaaccaacatcagcgacggcatttgcaggaatcgctcagcttataaaaacgcaagaaatcaaacctgacgagcttaccgttggagtcgtaaccggaaatggactcaaagcaacaaactcaattgaacatttaatcaatgatatgagaggttaa

SEQ ID NO: 53136 - protein, 376 aa, Vibrio fischeri ES114
MKYLCMACNKEYAPKPELIKCECGSALWVKPQTSFSKKDLIENEFTPRRYSSAFPVKKDDINITFNEAITPLCQAEISGTPILVKLDSLQPTGSFKDRGASLVINYLNNHGITSIAEDSSGNGGSAYAGYAAKGNMQCNIFVPAGTSKGKTTQTRLYGANCIEVEGTREDVALAAIESSVTHGSHYVGHNWHPLFIEGVKSIAYEIWEQCGYKAPDNFVVPAGNGSLLAGAYIGFSELLKGGEISKLPRLFGIQSESIQPFVQTFNNKEINITSEDTIAEGIKIKRSSRMNEIVQFVKETNGNFISVNEQQIQSALKEMGAQGYFIEPTSATAFAGIAQLIKTQEIKPDELTVGVVTGNGLKATNSIEHLINDMRG

SEQ ID NO: 53137 - DNA, 1527 bp, Neisseria gonorrhoeae FA 1090
  CDS (1)..(1527)
atgaacacgccccttccttattccgattacctcatccgcatcctgacggcatctgtctatgatgtagcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcacgcacaaggcgtggcgttgtccgcacagcgtttgggctgccgtgccgttatcgtcatgccggagactacgccgaaaattaaagtggatgcggttaaaagccgtggcggcgaggtggttttgcggggtgtttcatacaacgatgcctacgattatgcgatggagctggcggaacaggaagggctgacctatatcgcgccgtttgacgatcccgatgtgattgcgggacaggggacggtggggatggaaattgtcagccagcatcccgatccaatccgcgccgtattcgtaccgatagggggcggcggtttggcggcgggcgtggcggcatttatcaaacaggttcgtcccgaaattaaagttatcggcgtacagaccaacgattcctgctgtatgaagcagtcggtcgaagcaggcgaaatcgtccatttgaaagatgtcgggctgttttcagacggtacggcggtcaaagtcgtcggaaacggaaccttccgcctctgcaaagaacttttggatgaaatcattacagtcgataccgatgcggtttgcggcgcggtcaaggatattttcgatgacacgcgcagcattaccgagccggccggcgcgttggcgttggcgggtctgaaagcctatattgcccgagaaggtgcggaaaaccaaaccctgattgccgttaccagcggtgcgaatatgaattttcaccgtttgcgccacgtttcggaacggagcgaattgggcgagggcaacgaaggtatttttgccgttaccatccccgaagaacgcggcagcttccttaagtttgtcaatatattgggaaataggaatattaccgagttcaactaccgctacggcggcgatgaaaaagcgcatatctttgtcggacttcaagcggcaggcccgcaggatttggcggttatcggcagccggttggatgaggcgggattgcccaatgtcgatttgaccaataatgagattgccaaaatccatatccgctatatggtcggagggcggacggacaaagtagggcacgagcgtctggtcagttttgagtttccggagcgtccgggcgcgttggcgcgctttttgaaccatatgcagggcggttggaacattacgctcttccattaccgcaaccacggtgcggattacgggcggattttggtcggtatcgacgtgccgccgcacgatgccgccgcatttgacggtttcttggaaagtctgggatacagctatcacgaggaaacgcaaaatgccgcgtacaagctgtttcttgcctga

SEQ ID NO: 53138 - protein, 508 aa, Neisseria gonorrhoeae FA 1090
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNGTFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGGDEKAHIFVGLQAAGPQDLAVIGSRLDEAGLPNVDLTNNEIAKIHIRYMVGGRTDKVGHERLVSFEFPERPGALARFLNHMQGGWNITLFHYRNHGADYGRILVGIDVPPHDAAAFDGFLESLGYSYHEETQNAAYKLFLA

SEQ ID NO: 53139 - DNA, 1302 bp, Mesorhizobium loti MAFF303099
  CDS (1)..(1302)
atgacaggggggccgcgcagacatgcggcacaaggtggctttccgatgaacagtttttcctcccgcgtcgccaccgctgcggcggcgatccgccagatctttccggaaacgccgctgcaggaaaacgactatctgtcgaagaagaccggcgcgcgggtgctgctgaagcgggaggacctgtcgccggtgcgctcctacaagatccgtggcgccttcaacttcttccgcaaggcgctcggcgagggcaaccaggcagagctgttcgtctgtgcgtccgccggcaaccatgcccagggttttgccttcgtctgccgccatttcggcaaaaagggcgtggtgttcatgccggtgacaacgccgcagcagaagatcgacaagaccaggctgttcggcggtgatttcgtcgagatcaggctggtcggcgactttttcgacgactgctatcgcgccgccttcgaattcaccgaaaggtcgggtgcccacatggtgccgcccttcgaccacaaggacattatcgagggccaggcgacggtcgcctatgagatcgcggcccagatggcgggtgcgcgcatgcctgacatcgtcatgctgccggtcggcggtggcgggctcgccgccggcgtcacgcactatttcgccgatcagggccgcgaggcgcgttttgtcttctgcgagccggccggcgcgccgagcctgcacgacagcctcgcggccggaaaacggctgaagctcgccaaggtcgacaacttcgtcgacggcgcggcggtggccgaaatcggccgcgaacccttgcggtttctcaaggaattcgctgctgacaccgtgcggctgatcccggaaaaccggctctgcgccaccatgatcgagatgctcaatgtcgaaggcgtcgtgctcgagccggccggcgcattggccatcgacgcattgaaggatttttccaggaaggagatccgtggcaagaccattgtcgccgtggtctcaggcggcaatttcgatttcgagcggctgccggatgtcaaggaacgggcgctgcgcttcgaaggcctgaagaaatatttcatcatccgcttcccgcagcggccgggcgcgctgcgcgacttcctcgaaatgctgggacccgacgacgacattgcccgcttcgagtatctgaagaagtccgcgcgcaatttcggctcggtgctgatcggcatcgaaaccaaggaccgtcgcaatttcgacctgctcaaggcaaatttcgaggccgagggcgtccagtatcaggacatcaccgacaacgagacattggcgggcttcatcatatga

SEQ ID NO: 53140 - protein, 433 aa, Mesorhizobium loti MAFF303099
MTGGPRRHAAQGGFPMNSFSSRVATAAAAIRQIFPETPLQENDYLSKKTGARVLLKREDLSPVRSYKIRGAFNFFRKALGEGNQAELFVCASAGNHAQGFAFVCRHFGKKGVVFMPVTTPQQKIDKTRLFGGDFVEIRLVGDFFDDCYRAAFEFTERSGAHMVPPFDHKDIIEGQATVAYEIAAQMAGARMPDIVMLPVGGGGLAAGVTHYFADQGREARFVFCEPAGAPSLHDSLAAGKRLKLAKVDNFVDGAAVAEIGREPLRFLKEFAADTVRLIPENRLCATMIEMLNVEGVVLEPAGALAIDALKDFSRKEIRGKTIVAVVSGGNFDFERLPDVKERALRFEGLKKYFIIRFPQRPGALRDFLEMLGPDDDIARFEYLKKSARNFGSVLIGIETKDRRNFDLLKANFEAEGVQYQDITDNETLAGFII

SEQ ID NO: 53141 - DNA, 942 bp, Mesorhizobium loti MAFF303099
  CDS (1)..(942)
atggcgcagggcaataccgtcacacgcgaacgcattgccgcgatggaaccgcgcatccggccctatatcaggcacacgccggtgctgcacgtcgacatgaccgacttcgaccggccaccgctggctctcgacctcaaactcgaatgcctgcagcattccggctcgttcaaggcgcgcggcgccttcaccaatcttctggaaaggccggttcccaaggccggcgttgtcgccgcatcgggcggcaaccatggcgccgccgtagcctatgccgccatgcggctcggccacaaggcgaccatcttcgttcccgaagtgagcccacaggccaagctggaccgcattcgttcctatggcgccgacctggtcgtcggaggcgcccgctatgccgaggcgctgggcgccagcgaacgtttcgcgcaggaaactggcgccttgcagatccatgccttcaaccaggaggaaacgctggtcggccagggcacgctcgggctcgaaatcgagaacgacttgcctcagatcgacacgctgctggtcgccgtcggcggtggcggcctgatcggcggcatcgccgcctggtatgccggccgcatccgcatcatcgccatcgagcccgaaggcgcgccgacgctttatcgcgccttcgaggccggccatcccgtcgacgcaccggcggaaggcatcgccgccgattcgctggcgccgaagcgcgtcggcgagatgatgttcccgatcgcggaagccttcgtcgagcgctccatcctggtcagtgacgacgacatcatcgccgcgcagaaggcgttgtggaaccgggtgcgcatcatctccgaaccgggcggggctgcggccttcgccgcgatcctgtccggccgctacacgccggcacccggcgaacgcgtcgccgtgctggtctgtggcgccaacgcaaaccccgccaatttctga

SEQ ID NO: 53142 - protein, 313 aa, Mesorhizobium loti MAFF303099
MAQGNTVTRERIAAMEPRIRPYIRHTPVLHVDMTDFDRPPLALDLKLECLQHSGSFKARGAFTNLLERPVPKAGVVAASGGNHGAAVAYAAMRLGHKATIFVPEVSPQAKLDRIRSYGADLVVGGARYAEALGASERFAQETGALQIHAFNQEETLVGQGTLGLEIENDLPQIDTLLVAVGGGGLIGGIAAWYAGRIRIIAIEPEGAPTLYRAFEAGHPVDAPAEGIAADSLAPKRVGEMMFPIAEAFVERSILVSDDDIIAAQKALWNRVRIISEPGGAAAFAAILSGRYTPAPGERVAVLVCGANANPANF

SEQ ID NO: 53143 - DNA, 984 bp, Mesorhizobium loti MAFF303099
  CDS (1)..(984)
atgaccgccaccacccctcccggcatcgccgacatccgtgccgccgccgcccgcctctccggcctgatcgtcgaaacgccattgatcgaatcggccgagctgaacaagcgcttcggcggccgtatcctgttcaagccggagacgttgcagcgcaccggctcgttcaagttccgcggcgcctacaacaagctgtcgtcgctgagcgaggaagagcgcagccgtggcgtcgtcgccttctcctccggcaatcatgcgcaaggggttgccgcttcggccgccatgttcggcgtcaaggcggtcatcgccatgccggcggacgcgccggcgatgaagatcggcaatgtccgcaagatgggcgcggaggtggtgccgttcgaccgctttcgcgatgaccgcatgaccgtggttcgcccctatatcgacaagggcatggtgctggtgccgcccttcgacgatccggccatcattgccgggcaaggcacgatcggccttgaactgatgcggcagggcagggcgctcggcgtcagcctcgacaccgtcgtcatcccctgcgggggcggcggcctgtcgagcggcatttcggtggcggtcaaggatgcctcgccgggcacggcggtctgggcggtagagcccgagcatttcgacgacacgcgccgctcgctcgccgcaggcgcgcgggtttcgaacgagcccggccacagctcgatctgcgacgcgatcctgaccgccgagccgggcgccatcaccttcgaaatcaaccgcaggaacctcactggggccattgccgtctccgacaaggcgaccgcacaggcgatgcgcgatgccatggcctatctgaagctggtggtcgagccgggcggctgcgtggcgctggcggcgctgtcgtcgggcgagatcgaactgtccggcaaatgcgtcgccgtggtgctgtccggcggcaatgtcgatttcggcacctatgccgggatcatggcggccgcctga

SEQ ID NO: 53144 - protein, 327 aa, Mesorhizobium loti MAFF303099
MTATTPPGIADIRAAAARLSGLIVETPLIESAELNKRFGGRILFKPETLQRTGSFKFRGAYNKLSSLSEEERSRGVVAFSSGNHAQGVAASAAMFGVKAVIAMPADAPAMKIGNVRKMGAEVVPFDRFRDDRMTVVRPYIDKGMVLVPPFDDPAIIAGQGTIGLELMRQGRALGVSLDTVVIPCGGGGLSSGISVAVKDASPGTAVWAVEPEHFDDTRRSLAAGARVSNEPGHSSICDAILTAEPGAITFEINRRNLTGAIAVSDKATAQAMRDAMAYLKLVVEPGGCVALAALSSGEIELSGKCVAVVLSGGNVDFGTYAGIMAAA

SEQ ID NO: 53145 - DNA, 1059 bp, Mesorhizobium loti MAFF303099
  CDS (1)..(1059)
gtgtggcgacgagacgccgcgccccgaatttgggcagctgatgacgcttcctctgccgcgcgattgatgatcatgacgaccgtctcccttaacgatatccgcgccgcgcgtgagcgtattgccagcaaggtcgagtacacgccgactgttttatcctcgagcctttcggaacgtctcggtgtccccgtccatctcaagctcgagcatcgccagactaccggcagcttcaagctccgcggcgccacgaatgccgtctcttcgctgagcgcggaagaaaaggcaggcggtgtggtcgcggcctcgaccggcaaccatggccgggcgctggcacatgctgcgaagctcgaaggcatgcgcgcggtgatctgcatgtcgcggctggtgccccagaacaagctcgacgaaatccgccggctcggcgccgaggtccacatcgtcggcaacagccaggacgatgcccagcaggaggttgagcggctggtggcgcagcaggggctggtgatgctgccgcctttcgacaatcccgccatcatcgccgggcaaggcacgctcgggctggagatgatcgagcaggtcccggatgccgctctggtgcttgtgcaactctccggcggtggcctggcttccggcgtcgccacagccgtcaagggcatcaggcccgggacagaagtcatcggcgtttcgatggcgcggggtgctgcgatgaaggcgagcctcgatgccggccggcctgtcctggtggaggaactgccgacgttggcggactcgctgggtggcggcatcggcctcgacaacaggctgaccttcgccatgtgccgcgacctgctcgacgaaatcatcttgctcagcgaggacgagatcgccgcaggtatctgccatgcctatgcgcaggagcgcgagatcgtcgagggcgccggcgcggtcggcatcgcagcgcttctcgccggcaaggtcaaggcgaaagggccgatggtcgtacttctctccggccgcaacatcgacatgaatgcgcaccgccggatcatctgcggcgaggcaatcggggagcgcgccgcatga

SEQ ID NO: 53146 - protein, 352 aa, Mesorhizobium loti MAFF303099
MWRRDAAPRIWAADDASSAARLMIMTTVSLNDIRAARERIASKVEYTPTVLSSSLSERLGVPVHLKLEHRQTTGSFKLRGATNAVSSLSAEEKAGGVVAASTGNHGRALAHAAKLEGMRAVICMSRLVPQNKLDEIRRLGAEVHIVGNSQDDAQQEVERLVAQQGLVMLPPFDNPAIIAGQGTLGLEMIEQVPDAALVLVQLSGGGLASGVATAVKGIRPGTEVIGVSMARGAAMKASLDAGRPVLVEELPTLADSLGGGIGLDNRLTFAMCRDLLDEIILLSEDEIAAGICHAYAQEREIVEGAGAVGIAALLAGKVKAKGPMVVLLSGRNIDMNAHRRIICGEAIGERAA

SEQ ID NO: 53147 - DNA, 1005 bp, Mesorhizobium loti MAFF303099
  CDS (1)..(1005)
atgatggcagaccttctcgtcccctcgctggcccatctcaaacaggcctatgccgtcacctccagggcgacgcagatcacgccgctgctggaatcgaccgcactcgccagggagaccggtgctgcccgtgtcttcatcaagccggaatcgctgcaatgggccggatcgttcaagatccgcggcgcctattggcggttgaagcggctgtcggccgacgaagcgaggaaaggagtcgtcgcctactcctccggcaatttcgcgcaaggcctggcggcagccggccaagcgctcggcattcccgtcaccatcgtcatgccgatcgacgcacccgccgccaagcgtgacgcgacggcgggctatggcgcgcgtgtcgtgttgaccgaccatggcgagcgcgcgcgagaagaggttgccgctgccaaggcgcgcgagatcgccgagacggaagggctggccctgctgcatcccttcgacgatccggagatcgtcgccggccaggctggcgccgggctcgaagcgctcgaccagcttgaggccaaggacgccagcgccgacctgttgttctgctcggtcggcggcggcgggctgatcggcggcgtttcgctcgccttccactatctgtcgccggcgacggagatcatcggcgtcgagccggaaggcttcaatggcatgggctcgtcgctggcgcatggcagcatcgagaccatgccgatcgggccgaaatcgatttgcgacgggctgatgtcgcggcggccgggcgatgcgccgttcgcggcggtcaagaccgctggcgttcgcggaatcaccgtcgatgatcaatcggtgcggcgtgccatgcggatcgccttcgagcggatgaagctggtgctggagccgtccggggctgcgtcgctggcagcattgctcggtggcaaggtggatgtgactgataaaaccgtccttgttgtggctaccggcggcaatgtctcgctcgccgattttatggcgcatatgaaccatgcttga

SEQ ID NO: 53148 - protein, 334 aa, Mesorhizobium loti MAFF303099
MMADLLVPSLAHLKQAYAVTSRATQITPLLESTALARETGAARVFIKPESLQWAGSFKIRGAYWRLKRLSADEARKGVVAYSSGNFAQGLAAAGQALGIPVTIVMPIDAPAAKRDATAGYGARVVLTDHGERAREEVAAAKAREIAETEGLALLHPFDDPEIVAGQAGAGLEALDQLEAKDASADLLFCSVGGGGLIGGVSLAFHYLSPATEIIGVEPEGFNGMGSSLAHGSIETMPIGPKSICDGLMSRRPGDAPFAAVKTAGVRGITVDDQSVRRAMRIAFERMKLVLEPSGAASLAALLGGKVDVTDKTVLVVATGGNVSLADFMAHMNHA

SEQ ID NO: 53149 - DNA, 1221 bp, Thermoplasma volcanium GSS1
  CDS (1)..(1221)
atggaaaacctcgaaataccttcatttgatgagataatagaggcacagagatacctcgaaggcaaagtcaacaggactcctctcataagatcgactactatcggaaaagaatatggagcagatatttatttcaaacttgaaaattttcagaagacaggttcttttaagtcgaggggtgctatatttaggttttcaaagctatctgaagatgaaaaaaggcatggtgtaataactgccagtgcaggaaaccatgcacaaggggtagcctacgcagctatgataaacggcatagatgccaagatagttatgccagaatacacgataccgcaaaaagtaaacgcagttataagctacggggcccacgtcattttaaaaggatccgattatgatgaagcgcataggtacgcggacgagattgcaaaacaggagggtaggatcttcatagaggcattcaacgaccgttgggttatttcagggcaaggcacaataggcctggagataatggaggatttgccagatgttgatataatactcgttccggtaggtggcggcggcctcatctccggaatagcactggcagcaaagcatgcaagcaacaaggtcaaagtaataggaatagaatcagagctgtccgattctatgaaagcatcactccgggaaggaaagatagtggcacatactagcggagtcagcatatgcgacggcatctccgtcaagtatccaggagtcctcacatttgacatagcaagaaagtacgttgatgacatagtaacagtaactgaagaatatgtttctaaggctatctacaaactcttcgagagaaacaagatcgtagccgagccttcaggggcagtaggtctcgccgccataatggagggcaaggtagatgttaagggaaagaaggtcgctatagttgtttccggaggaaacataaacccgctgctcatgtcaaagataatatataaagaattggaaaaccttggccaacttgtacgcatagagtgtactataccagatcggcctgggaacctttacaggatagctatggctatagcagaaaacggcggtaatatataccatgccgaagtagataaccttaggaaggagacgccgccaggattccagtcagttacatttacggtaaatgtcagaggccaagatcacttggatcgtataataggaagcttgagggagatgggctatttatttaggataacatga

SEQ ID NO: 53150 - protein, 406 aa, Thermoplasma volcanium GSS1
MENLEIPSFDEIIEAQRYLEGKVNRTPLIRSTTIGKEYGADIYFKLENFQKTGSFKSRGAIFRFSKLSEDEKRHGVITASAGNHAQGVAYAAMINGIDAKIVMPEYTIPQKVNAVISYGAHVILKGSDYDEAHRYADEIAKQEGRIFIEAFNDRWVISGQGTIGLEIMEDLPDVDIILVPVGGGGLISGIALAAKHASNKVKVIGIESELSDSMKASLREGKIVAHTSGVSICDGISVKYPGVLTFDIARKYVDDIVTVTEEYVSKAIYKLFERNKIVAEPSGAVGLAAIMEGKVDVKGKKVAIVVSGGNINPLLMSKIIYKELENLGQLVRIECTIPDRPGNLYRIAMAIAENGGNIYHAEVDNLRKETPPGFQSVTFTVNVRGQDHLDRIIGSLREMGYLFRIT

SEQ ID NO: 53151 - DNA, 1320 bp, Pyrococcus abyssi GE5
  CDS (1)..(1320)
atgaagtgccctaaatgtgggcgagagtacaaagcagaaattccaccattctgtatttgtggtgaggagttagaaataacttacgactactcctctgttgatacgaggaaatggaagaatagacggcctggagtgtggcgatataaggagttattgcctaaggtaaagaagatagtaagtttgcaagaaggtggaaccccactaataaaggcaagaataagcgagcaacttaacgtagatgtttttattaaagacgagaccagaaacccaacgggatcttttagggacagacttgcaacggttgcaatttcatatggtttaccttatgcaaagaacggtttcatagtggcaagcgacgggaatgctgctgcttcggtagcagcgtattctgctagggccgagaaggaatgcttcgttgtcattccaaggaaggtagataagggaaagctaattcaaatgatagcctttggggcgaggataataaggtacggtgaaagcgttgatgatgctatagaatacgctaaagagcttgcaaagctaaacggattatacaatgtaactcctgaagagaatatagtagggctagagggccaaaagaccatagcatttgagctttgggaagaaattaacccaacccatgttatagtgccaactggaagtggaagttacctttactccatctacaaaggatttaaggagttaattgagattggagcccttgaagagatgcccaagctaatagcagttcaaacagatagatgcaatccaatagcttccgaaatattaggaattaaaggtgagtgcaaggaaactaaagctcttggtctttacgtaagggaacctcttatgaaacccaaagttatcagggccataagggaaagcagtggaacggctgttctagttagtgaagaagagatagagaaaggcgagaggttacttgcgaatgaaggaatttttgccgaattatcgtcggcggtagtcatgccagccttaattaagctcgtaaatgacggattcattgagaaaggggatagggtagttctagttgtaactggttctggattaaagacaggagaaggaggaagagagaaatttgggattggcggaactaagcttgaaattttgaagatactcaaggatggagaaaaatatgcctatgagatatggcaagccttaggaaaacccgttaagtatcaagccattcaccagcacataaaagagcttcaagagctaggactaattgaagaggcatatagaaggggaaagagaatttattataagcttactgaaaaagggattaggttagttgacaacctttaa

SEQ ID NO: 53152 - protein, 439 aa, Pyrococcus abyssi GE5
MKCPKCGREYKAEIPPFCICGEELEITYDYSSVDTRKWKNRRPGVWRYKELLPKVKKIVSLQEGGTPLIKARISEQLNVDVFIKDETRNPTGSFRDRLATVAISYGLPYAKNGFIVASDGNAAASVAAYSARAEKECFVVIPRKVDKGKLIQMIAFGARIIRYGESVDDAIEYAKELAKLNGLYNVTPEENIVGLEGQKTIAFELWEEINPTHVIVPTGSGSYLYSIYKGFKELIEIGALEEMPKLIAVQTDRCNPIASEILGIKGECKETKALGLYVREPLMKPKVIRAIRESSGTAVLVSEEEIEKGERLLANEGIFAELSSAVVMPALIKLVNDGFIEKGDRVVLVVTGSGLKTGEGGREKFGIGGTKLEILKILKDGEKYAYEIWQALGKPVKYQAIHQHIKELQELGLIEEAYRRGKRIYYKLTEKGIRLVDNL

SEQ ID NO: 53153 - DNA, 1185 bp, Pyrococcus abyssi GE5
  CDS (1)..(1185)
atggtattgagatgtataaggtgtggaagggagtatcccgaggatgagataaggtacaggtgtgagtgtggaggattgctggaagttgttgtagatcttgataaggtagatacaaaaatatttgatgggaataacattacgctgtggaagtacgagagctggctacctgtgaagaagattgtttctctaaatgagggaggaacccccctgtacagattaaataacttagaaaagattctcggagtgaaggagctgtatgccaagaacgagggtgcaaatccaactggttcgtttaaggatagaggaatgacggttggagtttcaaaggctcttgaactcggaatgaagagagttgcgtgtgcctcaactggaaacacctctgcatctttggctgcatatgcggctaaggctggaatagaggcatacgtccttgtgcctagtggaaagatagcacttggaaaacttgctcaagcgataatatatggggcaaaggttattccaataaagggaaatttcgatgatgcacttcgcgtggtaattgaagcaagcgaggaacttgggatatacatgttaaactcgataaatccatttagattagaaggacagaaaactatagcctatgaaatctatgatcaactacagaaggttccagataatgtagtcttgccagtgggaaacgctggaaatatctcggcgatatggaagggattcaaggagctgtatgaggctggagtcatagataagttacccagaatgataggtatacaagcagagggagcctcacctttagctaaagcatggaaagagaaaaggaaattcaagccagaaaagaatccggaaacccttgcaacggcaataaggattgggaatcctgcaaactgggagaaggcatggagagctgttgaagaatcaggaggtatgtttgagattgttagcgatgaagaaatattgaaggcccagaggatactcgcctcaaaggaaggtctcttcgttgaacccgcttcagcggcttctcttgccgggttaattaagctgttaaatgaggagaaggttgatagagatgaaagcttcgttttggtaacaaccggtcatggacttaaggatcccgacattgttcttaggaatttcaagttgcccgaacctatagaaccgacattagatgcatttaggagggtgattgaatga

SEQ ID NO: 53154 - protein, 394 aa, Pyrococcus abyssi GE5
MVLRCIRCGREYPEDEIRYRCECGGLLEVVVDLDKVDTKIFDGNNITLWKYESWLPVKKIVSLNEGGTPLYRLNNLEKILGVKELYAKNEGANPTGSFKDRGMTVGVSKALELGMKRVACASTGNTSASLAAYAAKAGIEAYVLVPSGKIALGKLAQAIIYGAKVIPIKGNFDDALRVVIEASEELGIYMLNSINPFRLEGQKTIAYEIYDQLQKVPDNVVLPVGNAGNISAIWKGFKELYEAGVIDKLPRMIGIQAEGASPLAKAWKEKRKFKPEKNPETLATAIRIGNPANWEKAWRAVEESGGMFEIVSDEEILKAQRILASKEGLFVEPASAASLAGLIKLLNEEKVDRDESFVLVTTGHGLKDPDIVLRNFKLPEPIEPTLDAFRRVIE

SEQ ID NO: 53155 - DNA, 1185 bp, Pyrococcus horikoshii OT3
  CDS (1)..(1185)
atggtattgagatgtgtagtttgcggaagagaataccctgaggacgaagttaggtataggtgtgattgcggaggattgctggaggtagttattgaccttgataaggttgatacctccattttcaacggtagggatataaagttatggaagtatgagagctggcttcccgtaaaaaagagggtaagcctagaggagggtggaactcccctttataggttgtcaaacctcgaaaatgagctaaaagtgaaggagctttatgcaaaaaatgaaggagcaaatccaactggttcctttaaggatcgtggaatgaccgtcggagtttcaaaggctctcgaactgggaatggataaggttatatgtgcatccacgggcaatacttcagcatcactagcagcttacgctgcaaaggcaggaataaaagcgtacgttctaatacccagcggaaagatagcattaggaaaacttgctcaggcgataatccatggagccaaggtaatcccaatcaagggaaacttcgacgatgcccttaggatagttgttgaggcaagtagagagcttgggatatacatgttgaactcgataaatccatttaggcttgaaggacagaagacaatagcatatgagatatacgatcaactagggaaagttccagacaacattatcctcccagttggaaacgctgggaacatttccgcgatatggaaggggttcaaggaaatgtatgaggctggagttatagatgagcttcccaggatgattggaattcaagctgaaggtgcctctcctttagtgaaagcttggaaggagaagaaaaagtttcaacctgaagagaacccagagactgttgcctctgcaataagaatagggaatccagcaaactggataaaggcatggaaagctgttgaagagtctggaggattgtttgaaagcgtgagtgatgaagagatactaagggcccaaaggctcctagcatctagagagggattattcgttgagcctgcctctgcagcatctttggctggcttgattaagctacttgaaagtggtgaaataagcagaaatgagagttacatcttaataacaactggacatgggttgaaggatccgaacatcgttataaagaactttcagatcccagaacctatagaaccaacattagaagcttttaaggaggtaattaaatga

SEQ ID NO: 53156 - protein, 394 aa, Pyrococcus horikoshii OT3
MVLRCVVCGREYPEDEVRYRCDCGGLLEVVIDLDKVDTSIFNGRDIKLWKYESWLPVKKRVSLEEGGTPLYRLSNLENELKVKELYAKNEGANPTGSFKDRGMTVGVSKALELGMDKVICASTGNTSASLAAYAAKAGIKAYVLIPSGKIALGKLAQAIIHGAKVIPIKGNFDDALRIVVEASRELGIYMLNSINPFRLEGQKTIAYEIYDQLGKVPDNIILPVGNAGNISAIWKGFKEMYEAGVIDELPRMIGIQAEGASPLVKAWKEKKKFQPEENPETVASAIRIGNPANWIKAWKAVEESGGLFESVSDEEILRAQRLLASREGLFVEPASAASLAGLIKLLESGEISRNESYILITTGHGLKDPNIVIKNFQIPEPIEPTLEAFKEVIK

SEQ ID NO: 53157 - DNA, 1323 bp, Pyrococcus horikoshii OT3
  CDS (1)..(1323)
atgaagtgcccaagatgtggtagggaatacatatcttcaatcccacctttttgtatctgtggggaagagctcgagataacttatgattattcctctgtagacgtgagaaaatggaaaagaagaaatcctggggtatggagatataaagagcttctgccagaagttaagaagatcataaccctacaagagggaggaacaccactaataaaggctaggataagcgagaaaatcaacgttgatgtttatataaaagatgaaaccagaaatccaaccggctcctttagggataggttagccacagttgcaatctcctatggtttaccttacgcatcaaatggatttatagttgcgagtgatggaaatgcagctgcttcagtcgctgcttactcggcaagagctgaaaaggagtgcttcgtagttgttcccaggaaagttgataaaggaaagctaattcaaatgatagcctttggagcgaggataatacgctatggtgacagcgttgatgaagcaatagaatatgcaagagagctttcaaaacttaacggcttatacaatgtcacacccgaggataatataatcggacttgagggtcagaagacgatagcattcgaactttgggaggaaattaatccaacgcatgtaatagtcccgacgggaagcgggagttacatatactcgatatacaaggggttcaaggaactcatcaaaattggagtgctagagaagatgccaagattaattgccgttcaaacggagagatgcaatcctatagccgctgaaattttgggattaaaaaaagaatgtaaagaaactaaagctctcggattatatgtgaagaacccggtaatgaagtctagagttataagggctataaaggaaagtggaggaacagcagttgttgtaaatgaaaacgacataattaccggggaaaagttgctagccaatgaagggatatttgcggagctttcctcggccgttgtaatgcccgccctattaagcctagttgaaaagggaataattgaaaaaggagataaagtagttttggttgttaccggttcaggactcaaaattggtgaagggggaagagagaaattctccattggtggaactaagcttgagattcttaaaatcctcgaggaaagagagatgtacgcctatgaaatttggcaagcactaggaaaacccctaaagtatcaagccgttcatcagcatataaaggaattacaagagttaggcctcataaaggaggcatatagaaaggggaagaggatatattacaagctgactgagagaggtagaaggcttattgaaaatcttgagtag

SEQ ID NO: 53158 - protein, 440 aa, Pyrococcus horikoshii OT3
MKCPRCGREYISSIPPFCICGEELEITYDYSSVDVRKWKRRNPGVWRYKELLPEVKKIITLQEGGTPLIKARISEKINVDVYIKDETRNPTGSFRDRLATVAISYGLPYASNGFIVASDGNAAASVAAYSARAEKECFVVVPRKVDKGKLIQMIAFGARIIRYGDSVDEAIEYARELSKLNGLYNVTPEDNIIGLEGQKTIAFELWEEINPTHVIVPTGSGSYIYSIYKGFKELIKIGVLEKMPRLIAVQTERCNPIAAEILGLKKECKETKALGLYVKNPVMKSRVIRAIKESGGTAVVVNENDIITGEKLLANEGIFAELSSAVVMPALLSLVEKGIIEKGDKVVLVVTGSGLKIGEGGREKFSIGGTKLEILKILEEREMYAYEIWQALGKPLKYQAVHQHIKELQELGLIKEAYRKGKRIYYKLTERGRRLIENLE

SEQ ID NO: 53159 - DNA, 1050 bp, Aeropyrum pernix K1
  CDS (1)..(1050)
gtgagaggacctcttttcaagctgggcagggcgctggagaagggcagtgtggagggagtggtcgccgcctcagccgggaaccatgcccagggtgttgcgtacgccgctagcttctacgggctcaagagcgttatagtcatgcccgagctggccccgccagccaaggttaaggctaccaggtcgtacggggctgaggtagtgctgcacggccgggttgtggacgaggcgtttaagctcgccgagaagatagcggaggagaggggatacatgcttgtccaccccttcgacgatcccgagataatggctggaaacgggactatagcgtgggaggcctacgagcaggggggtaagttcgacacggtgatagtgcctgtaggcgggggcggtttgatctctggtgtagtctcggttgtgcggaagctgatgcccggcgtcaaggtcataggtgttgaggcggaggctgcgcccaagttcgtagagagcttcaaggaggggaagccgatagaggttgaagtcacccatagcctggccgacgggcttgtgaccaagaagccgggtaggctcacctaccccatagtgaagcatcttgtcgacaaggttgtggctgtggacgagcatgagatagcgagcgccatgtacctcctcctcgagaggtctaagattctggctgagggtgccggagccgcgggcgtggcagcccttcttgccagggtggtgaagcccaagggtaagacccttgtaatagttagcggggggaacgcggaccttacaagcatagagaaggttatactggttggcctcgccagggagggtaggatagctaggataacgggtgtgatacccgacatcccgggccagctatacaaggttctggaggtgatagcggagaagaggtgcaatgttgtagacattatacatgacaggctccaccccaggataagccctggtatggcgagggttacaatcgtgctcgaagtgccagagcgcatgctcctcttcgagcttctagaggacctcagagacatgggttacaagttcgtcatagactga

SEQ ID NO: 53160 - protein, 349 aa, Aeropyrum pernix K1
MRGPLFKLGRALEKGSVEGVVAASAGNHAQGVAYAASFYGLKSVIVMPELAPPAKVKATRSYGAEVVLHGRVVDEAFKLAEKIAEERGYMLVHPFDDPEIMAGNGTIAWEAYEQGGKFDTVIVPVGGGGLISGVVSVVRKLMPGVKVIGVEAEAAPKFVESFKEGKPIEVEVTHSLADGLVTKKPGRLTYPIVKHLVDKVVAVDEHEIASAMYLLLERSKILAEGAGAAGVAALLARVVKPKGKTLVIVSGGNADLTSIEKVILVGLAREGRIARITGVIPDIPGQLYKVLEVIAEKRCNVVDIIHDRLHPRISPGMARVTIVLEVPERMLLFELLEDLRDMGYKFVID

SEQ ID NO: 53161 - DNA, 1182 bp, Aeropyrum pernix K1
  CDS (1)..(1182)
gtggcctgcggctccaaatatccgtcctcccctcgtctattcacctgccctaagtgcggggggcttctggagcccttctacattgacggaggatcgcccaggggcaggggggtgtggaggtatagggacctcctgccgaggccacgcaggatcgtgaccatgggggagggttctacgccgctggtcaagctggagaacctttctagggctatgggggttgaagtctatgggaaactcgagttcctaaaccctactggcagctttaaggataggggtatgactgttggtgtcagcatcgcctcgtccttcagctaccgacttgtagtagcggcaagcacgggtaacactgcggctagcatggcagcatacgctaggagagcagggcttaatccggttatactgattccgaaggggggtatagcctcgggcaagctctcccagatagccgcccttggggcttgggttcttgaggttgagggcagcttcgacgatgctctcgacgctgccagggccgctgcggagaaggggctcgcgtactcactcaacagcataaacccctacaggcttgaggggcagaagaccattgccttcgagattctagaggatgtggacagagtggaccatgtggtggtgcctgtgggtaatgcgggtaacatatctgcaatatggaaagggttcaaagaggccggcctcctaggccttcccagcatgaggcctaggatggtgggggtccaggctgagggcgcctcccccctgtacagggcttgggttgagaagatggactctgtggagagggttagaaacccgagcaccatagcctcggccataaggataggcaatccagtcaacgctgcgaaagccctggcagcggttagggagtcggacggtttaataatatctgtcagcgacgccgagatcctaaaggcggcggccacgctcgctgagaacgaggggatgctggtagagcctgccagtgcagccagccttgcaggcctcataaagctgaggaaccagggcatcatagcttctggctcaagcgtggtgctgatactcacaggccacggtcttaaggatcctagggccctagagtttatagcaagtagtgcgggtgtaaggagagcatatgccagcaccgccgaggaggctctactcaagctggaagagattgctgttggcggttag

SEQ ID NO: 53162 - protein, 393 aa, Aeropyrum pernix K1
MACGSKYPSSPRLFTCPKCGGLLEPFYIDGGSPRGRGVWRYRDLLPRPRRIVTMGEGSTPLVKLENLSRAMGVEVYGKLEFLNPTGSFKDRGMTVGVSIASSFSYRLVVAASTGNTAASMAAYARRAGLNPVILIPKGGIASGKLSQIAALGAWVLEVEGSFDDALDAARAAAEKGLAYSLNSINPYRLEGQKTIAFEILEDVDRVDHVVVPVGNAGNISAIWKGFKEAGLLGLPSMRPRMVGVQAEGASPLYRAWVEKMDSVERVRNPSTIASAIRIGNPVNAAKALAAVRESDGLIISVSDAEILKAAATLAENEGMLVEPASAASLAGLIKLRNQGIIASGSSVVLILTGHGLKDPRALEFIASSAGVRRAYASTAEEALLKLEEIAVGG

SEQ ID NO: 53163 - DNA, 1041 bp, Arabidopsis thaliana
  CDS (1)..(1041)
atggaagcaaatagagagaagtatgctgctgatatattgtccataaaagaagctcatgaccgtattaagccgtatatacatagaactccggtgttaacatctgaatcgttgaattcaatctccggaagaagcttgttctttaagtgtgagtgccttcagaaaggtattgaatgtcgatcgttttacttttctgtttattgtggaaaaagtggagctttcaaattccgtggagcttgcaatgctgttttgtctcttgatgctgaacaagcagccaaaggagttgtaacacacagcagtggaaaccatgctgctgcattgtctttggctgcaaagattcagggaataccggcatatattgttgtaccaaaaggtgctccaaagtgcaaagttgataatgtgatcaggtatggtggtaaggttatatggagtgaagcaacaatgtcttctagagaggaaatagcttcaaaagttttgcaggaaacaggttcagttctgatccatccatataatgatggacgcattataagtggtcagggtacaattgcattggaactgctggagcaaatccaagagattgatgctatagttgtgccgataagcgggggtggtttgatatctggtgtggcgcttgctgccaaatctattaagcctagtatccggattatagccgctgaaccaaaaggagctgatgatgcggctcagtctaaggtcgctggtaaaatcatcactttacctgtgactaatactatagctgatggccttcgagcttctcttggagatttaacctggccggtggtgagggacttggtagatgatgttgtcaccttggaagagtgtgaaataatcgaagccatgaaaatgtgctatgagatactgaaggtctctgtggaaccaagtggagctattggccttgcagcagttttatcaaacagtttccgcaacaatccttcttgtcgtgattgcaaaaacataggaattgtactctcaggaggtaatgttgatttgggctctctatgggattcatttaagagttcaaaataa

SEQ ID NO: 53164 - protein, 346 aa, Arabidopsis thaliana
MEANREKYAADILSIKEAHDRIKPYIHRTPVLTSESLNSISGRSLFFKCECLQKGIECRSFYFSVYCGKSGAFKFRGACNAVLSLDAEQAAKGVVTHSSGNHAAALSLAAKIQGIPAYIVVPKGAPKCKVDNVIRYGGKVIWSEATMSSREEIASKVLQETGSVLIHPYNDGRIISGQGTIALELLEQIQEIDAIVVPISGGGLISGVALAAKSIKPSIRIIAAEPKGADDAAQSKVAGKIITLPVTNTIADGLRASLGDLTWPVVRDLVDDVVTLEECEIIEAMKMCYEILKVSVEPSGAIGLAAVLSNSFRNNPSCRDCKNIGIVLSGGNVDLGSLWDSFKSSK

SEQ ID NO: 53165 - DNA, 1059 bp, Aquifex aeolicus VF5
  CDS (1)..(1059)
atgaatcggtggcaaggaataattaaacagtataaaaagtacctccccgttgacgaaaacacacccatcgtaaccctctacgaaggtaacactcctctcatagaggcggacaacctcgcaagggcgataggttttaaaggaaagatttatctgaagtacgaaggactaaatccgactggttcttttaaagatagggggatgacccttgccatttcgaaagcagtggaagcgggtaaaagagcggtgatatgtgcatccacgggaaacacctccgcttccgccgcggcttacgctgcaagggctggactcagggcttacgttctgctacccaagggtgctgtcgccataggaaagctctctcaggctatgatttacggggctaaagtcctcgccattcaaggaacttttgacgatgccctgaacatagtgagaaaaataggtgaaaattttcccgtggaaattgtgaactcggtcaacccctatagaatagaggggcaaaagacagccgcttttgagatatgcgataccttgggagaggctccagattatcactttatcccagtcgggaacgcaggaaacataaccgcctactggaagggctttaagatttattacgaggaggggaaaataacgaaactccctaggatgatgggctggcaagcggaaggtgctgctcctatagtgaagggctacccgattaaaaatccccagaccatagctacggctataaagataggaaatccctacagctggaagtctgccctgaaagccgctcaggagagtggtgggaaaatagatgcggtaagtgacagcgaaatcctttatgcttacaaactcatcgcctcaacggaaggtgttttctgcgagcctgcttctgccgcgagcgtggcagggttgataaaactcgtaagggaaggcttttttaaaggcggagaagtggtaacgtgtacacttaccggaaacggtttaaaggaccccgataccgctataaaagtttgtgaagaacctataacagtacctccggattttgacgaggtagtaaaggttctaggtttttaa

SEQ ID NO: 53166 - protein, 352 aa, Aquifex aeolicus VF5
MNRWQGIIKQYKKYLPVDENTPIVTLYEGNTPLIEADNLARAIGFKGKIYLKYEGLNPTGSFKDRGMTLAISKAVEAGKRAVICASTGNTSASAAAYAARAGLRAYVLLPKGAVAIGKLSQAMIYGAKVLAIQGTFDDALNIVRKIGENFPVEIVNSVNPYRIEGQKTAAFEICDTLGEAPDYHFIPVGNAGNITAYWKGFKIYYEEGKITKLPRMMGWQAEGAAPIVKGYPIKNPQTIATAIKIGNPYSWKSALKAAQESGGKIDAVSDSEILYAYKLIASTEGVFCEPASAASVAGLIKLVREGFFKGGEVVTCTLTGNGLKDPDTAIKVCEEPITVPPDFDEVVKVLGF

SEQ ID NO: 53167 - DNA, 1002 bp, Rickettsia prowazekii str. Madrid E
  CDS (1)..(1002)
atgaatttattactacaacctcctcaaaatgtagcaatagcacataatagaataaaacaatatataaatttaactccgatcattcactctgaaagcttaaatgcgatgctaggtcatgagattttttttaaggttgaatcattacaaaaaacaggagcatttaaaattagaggcgtattaaataatttgttaaaattaaaagagcaagaaaaattacctgataaaatagtttgttatagtagcggtaaccatggcattggtcttgcttattcaagtaaattatttggtattaaaacaagaatttatttaccgttaaatacttcaaaagtaaaacagcaagcagctctttattacggaggtgaagttatatacacgaatactcggcaagaagcagaatcaagagcaaaggcagatgaagaacaaggattctactatatgcacccttctgatagtgattctataatagcaggagccggtacgttatgctatgaagcattacagcaattaggttttagtcctgatgcaatttttgcttcttgcggcggtggaggtttaatttccggctcatatcttgctaaagaattaatatcacctacaagcttattaataggttcagaaccagttgcggctaatgatgcttatttatcgattaaaaataataatatatatagatttaatgactcaccaattaccattgcagatggtcttaaaactttaagtgtatcagctcgcacatttgaatatttgaaaaaacttgatcatttttatttagcagaagaatatgaaatatattactggacagcgtggcttactcatttacttaaagtaatatgtgagccatcaagtagtataaatatggcttcagtagtaagttggttaaaaacacaaaccaaaacacagaaactattagtattaatctcaggcggcaatatcgaccctactctttataatgagttatggaaaaatgattatctaactgttccaccaagcattagtaactaa

SEQ ID NO: 53168 - protein, 333 aa, Rickettsia prowazekii str. Madrid E
MNLLLQPPQNVAIAHNRIKQYINLTPIIHSESLNAMLGHEIFFKVESLQKTGAFKIRGVLNNLLKLKEQEKLPDKIVCYSSGNHGIGLAYSSKLFGIKTRIYLPLNTSKVKQQAALYYGGEVIYTNTRQEAESRAKADEEQGFYYMHPSDSDSIIAGAGTLCYEALQQLGFSPDAIFASCGGGGLISGSYLAKELISPTSLLIGSEPVAANDAYLSIKNNNIYRFNDSPITIADGLKTLSVSARTFEYLKKLDHFYLAEEYEIYYWTAWLTHLLKVICEPSSSINMASVVSWLKTQTKTQKLLVLISGGNIDPTLYNELWKNDYLTVPPSISN

SEQ ID NO: 53169 - DNA, 1206 bp, Thermotoga maritima MSB8
  CDS (1)..(1206)
gtgatcacactcgaggatataaaagaagcccaaagaacattgaagaatgtggtgcacaggacagctcttgcttacagctctgttctgagcgaggtaaccggtggagagatctacctgaagatggaaaatctccagaagaccggttcgttcaaaataaggggagcgtacaacaaaatagctcacctgagcgaagaagaaagaaagagaggagtcgttgccgcgtccgctggaaaccacgcgcagggagtggcacttgctgctcaaatcttcggtattcccgctaccattgtgatgccgaggtacgcccctctttctaaaatcaccaaaacgaggaatcttggagctcaggtgattcttgaggggaacattttcgacgaggcctacgaggcggctctcagaatacaggagaaaacaggtgcggtttttgtgcatcccttcaatgatcctcatgtcatcgccgggcagggaactatagggctggaaataatggaagatcttccggatgtggaagtggtggtggtgcccgttggtggaggtggtttgatttcgggagtatccgttgcgatcaaatcgatgaatcctgaggttaaagtaataggcgttcaaacggagaacatgccttccatgatcgcttcactgagaaggggcagggcagagcgggtcgaaggtaaacccacacttgccgatggaatagccgtgaaaaagcccggtgacctgaccttcgagctggtgaagaagtatgtcgatgagatggtcgcggtgaacgaagaagaaatagcggatgctatccttttccttcttgagcaggcaaaggtggttgctgaaggtgcaggagcggtgggtgtagccgctgttttgaacaaactggatgtgaagggaaagaaggtagcgatcgtgataagcggtggtaacatagatgtgaacatgatagacagaatcataaacaaagggctcgtgaagagcggaaggaaggtgttcatagaaacgttcgtgatggacagacccggtgccctgaaagagcttctcgggatagtggcggaactcggcgcaaacgttctttccgtttttcacaatcgctccgcaaaggaagttcccattggttttgccaaaatagagctcgagcttgaaacggtcgatgaaaaacacgtcgaagagatagagagggtgttgatcgcaaagggatacgaggtgaggatagtcgggtga

SEQ ID NO: 53170 - protein, 401 aa, Thermotoga maritima MSB8
MITLEDIKEAQRTLKNVVHRTALAYSSVLSEVTGGEIYLKMENLQKTGSFKIRGAYNKIAHLSEEERKRGVVAASAGNHAQGVALAAQIFGIPATIVMPRYAPLSKITKTRNLGAQVILEGNIFDEAYEAALRIQEKTGAVFVHPFNDPHVIAGQGTIGLEIMEDLPDVEVVVVPVGGGGLISGVSVAIKSMNPEVKVIGVQTENMPSMIASLRRGRAERVEGKPTLADGIAVKKPGDLTFELVKKYVDEMVAVNEEEIADAILFLLEQAKVVAEGAGAVGVAAVLNKLDVKGKKVAIVISGGNIDVNMIDRIINKGLVKSGRKVFIETFVMDRPGALKELLGIVAELGANVLSVFHNRSAKEVPIGFAKIELELETVDEKHVEEIERVLIAKGYEVRIVG

SEQ ID NO: 53171 - DNA, 1515 bp, Pseudomonas aeruginosa PAO1
  CDS (1)..(1515)
atgctcgaacaatacgtcaagaagatcctcacctcgcgcgtctacgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaaccacgcccagggcctggccctggcggccaagcggcaggggatcagggcggtcatcgtgatgcccaagaccacccccgagatcaaggtccaggcggtgcgcgcccacggcgccaaggcggtgctgcacggcgacgccttccccgaggcgctggcccacgcgctgaagctggtcgacgagaagggctacaccttcgtccatccctacgacgatccggacaccatcgccggccagggcaccgtggccatggagattctccgccagcagcccggccgcctcgatgcgatcttcgtcccggtgggcggtggcggactggtcgccggcatcgccgcctacgtcaagtacctgcgtccggagatcaaggtgatcggcgtcgagccggacgagtcgaactgcctgcaggcggccatggccgccggcgagcgggtggtgctgggccaggtcgggctgttcgccgacggcgtggcggtggcgcagatcggccagcacaccttcgacatctgcaaggaccacgtcgacgaagtgatcaccgtcagcactgacgagatctgtgcggcgatcaaggacatctacgacgacacccgctcgatcaccgagccggccggcgcgctggcggtggccgggatcaagaagtacgtcgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacatccgccacatggttggcggccatgcggtgaaagtcagcgacgagatggtgttccgcttcgaattccccgagcggcccggcgcgctgttcaacttcctcaccaagctcggcgggcgctggaacatctcgatgttccactaccgtaaccatggtgcggccgacggccgggtggtggccgggttgcaggtgccggaagacgagcgccacctgatcccgcagaccctggaggcgatcggctatccgtactgggacgagaccgccaacccggcctaccagctgttcctcggctga

SEQ ID NO: 53172 - protein, 504 aa, Pseudomonas aeruginosa PAO1
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVVLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 53173 - DNA, 963 bp, Pseudomonas aeruginosa PAO1
  CDS (1)..(963)
atgcctttttctctcgccgccctccaacaggccgccgccatcgtccaccagagcctgccgccgacgccgcagatacgctggccgctgctatgcgaggcactgggttgcgaagtgtggatgaagcacgagaaccacctgccggtgggggccttcaaactgcgcggcggcctggtgtatttccaccacctggcgcaccagggcgagcggccggccgccgtgatcagcgcgacccgcggcaaccacggccagtcggtggccttctcggcgagccgctacggcatccagccgatcatcgtcgtgccgcacggcaacagccgcgagaagaacgcggcgatgcgcagccttggcgcggagctgattgagcacggcgaggacttccaggcctcccgcgaatacgccgccgagcgcgcccggcgcgaaggcctgcacctgattccggcgttccatccctggctggtggccggggtcgccagctacagcctggagttgttcgccgcgctggccgaccttgacgaagtctacgtgccgatcggtatgggttcgggcatctgcggtctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgcctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactga

SEQ ID NO: 53174 - protein, 320 aa, Pseudomonas aeruginosa PAO1
MPFSLAALQQAAAIVHQSLPPTPQIRWPLLCEALGCEVWMKHENHLPVGAFKLRGGLVYFHHLAHQGERPAAVISATRGNHGQSVAFSASRYGIQPIIVVPHGNSREKNAAMRSLGAELIEHGEDFQASREYAAERARREGLHLIPAFHPWLVAGVASYSLELFAALADLDEVYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 53175 - DNA, 1548 bp, Pseudomonas aeruginosa PAO1
  CDS (1)..(1548)
atgagcgcctcgaccctcagcgcaagcaaacccctgctggccggctacgtggaaagcatcctggccgcgccggtgtacgacgtcgccgtggaaacccccttgcaggtcgcgccgcagttgtcccagcgcctgggcaaccgggtgctgctcaagcgcgaggacctgcagccggtgttctccttcaagatccgcggcgcctacacccgtgtcgcgcgcctgagcgacgagcagaaggcccgcggggtgatcaccgcctccgccggcaaccatgcccagggcctggccctggcggcgcagcgcctgggcgtgcgggcggtgatcgtgatgccgcgcaccactcccgaactcaaggtcaagggcgtgctggcacgcggcggcgaggcgttgctgcacggcgacgccttccccgatgcgctggcccatgccctgcaactggccgagcgcgaaggcatgaccttcgtcccaccctacgacgatccggacgtgatcgccggacagggcacggtggcgatggagatcctccgccagcacagcggccgcctcgacgcgatcttcgtgccggtcggcggcggcagcctgatcgccgggatcgccgcctacgtcaagcacctgcgtccggatattcgcgtgatcggcgtcgagccggaggattccaactgcctgcaggcggcgctggccgccggcgaacgggtggtgctgggccaggtcgggctgttcgccgacggggtggcggtggcgcagatcggcgcttgcaacttcgaggtctgcaaggaccatgtcgacgaggtgatcaccgtcggcagcgacgaaatctgcgcggcgatcaaggacatctacgacgacacccgttcgatcaccgagccggccggcgccctggccgtagcggggatcaagaagtacgtggcccgcgaacgcaccgaggggcagaccctggtggccatcgactccggtgccaacatcaacttcgaccgcctgcgccacgttgccgagcgcgccgaactgggcgaacagcgcgaagcgatcatcgccgtcaccgtggccgagcggccgggcagcttcaaggccttctgcgcggcgctgggccggcgccagatcaccgagttcaactaccgctaccacagcgaccgccaggcccacctgttcgtcggcgtgcagacccatccgctcaccgacagccgcgccgacctgctcgccggcctgcgcgagcagggcttcccggtactcgacctgaccgacaacgagatggccaagctgcacatccgccacatggtcggcggccacggtaccgaggtgcgccgcgagcggctgttccgcttcgagtttcccgaacgccccggggccttgctgaacttcctcgacaagctcggctcgcgctggaacatcagcctgttccactaccgcaaccacggcgccgccgacggtcgggtgctggccggattgcaggtgccggacgaggagcgcggcgagctggaggcggcgttgcaagccatcggctatccgtactgggaggaaacccacaacccggcctaccggctgttcgccggttga

SEQ ID NO: 53176 - protein, 515 aa, Pseudomonas aeruginosa PAO1
MSASTLSASKPLLAGYVESILAAPVYDVAVETPLQVAPQLSQRLGNRVLLKREDLQPVFSFKIRGAYTRVARLSDEQKARGVITASAGNHAQGLALAAQRLGVRAVIVMPRTTPELKVKGVLARGGEALLHGDAFPDALAHALQLAEREGMTFVPPYDDPDVIAGQGTVAMEILRQHSGRLDAIFVPVGGGSLIAGIAAYVKHLRPDIRVIGVEPEDSNCLQAALAAGERVVLGQVGLFADGVAVAQIGACNFEVCKDHVDEVITVGSDEICAAIKDIYDDTRSITEPAGALAVAGIKKYVARERTEGQTLVAIDSGANINFDRLRHVAERAELGEQREAIIAVTVAERPGSFKAFCAALGRRQITEFNYRYHSDRQAHLFVGVQTHPLTDSRADLLAGLREQGFPVLDLTDNEMAKLHIRHMVGGHGTEVRRERLFRFEFPERPGALLNFLDKLGSRWNISLFHYRNHGAADGRVLAGLQVPDEERGELEAALQAIGYPYWEETHNPAYRLFAG

SEQ ID NO: 53177 - DNA, 1527 bp, Neisseria meningitidis MC58
  CDS (1)..(1527)
atgaacacgccccttccttattccgattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcatgctcaaggcgtggcattgtccgcacagcgtttgggctgccgtgccgttatcgttatgccggagactacgccgaaaatcaaagtggatgcggttaaaagccatggcggcgaggtggttttgcggggcgtttcatacaacgatgcctacgattatgcgatggagttggcggaaaaagaagggttaacctatatcgcgccgtttgatgatcctgatgtgattgcgggacaggggacggtggggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcactgcggtcaaagtcgtcggaaacgaaaccttccgcctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggagacgatgaaaaagcgcatatctttgtcggacttcaagcggcaggcccgcaggatttggcggttatcggcagccggttggatgaggcgggattgcccaatgtcgatttgaccaacaatgagattgccaaaatccatatccgctatatggtcggagggcggacggacaaagtagaaaacgagcgtttggtcagttttgagtttccggagcgtccgggggcattggcacgctttttgaaccatatgcagggagggtggaatattacgcttttccattaccgcaaccacggtgcggattacgggcggattttggtcggtatcgatgtgccgccgcacgatgccgccgcatttgacggtttcttggaaagtctgggatacagctatcacgaggaaacgcaaaatgccgcgtacaagctgtttcttgcctga

SEQ ID NO: 53178 - protein, 508 aa, Neisseria meningitidis MC58
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSHGGEVVLRGVSYNDAYDYAMELAEKEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTNNEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 53179 - DNA, 1221 bp, Methanothermobacter thermautotrophicus str. Delta H
  CDS (1)..(1221)
atggatggtgaatctgtgataaggtgcatatcatgtggtcgagagtatgacctggaggagatcatatacacctgcagggagtgcgggtcggtacttgaagttgaatgtgacgtggaggtctcaagggacgtcttcaggggcagaaggcagaacatgtggaggtacagggagttcatgcctgttgacccctcaaggatagtcagcctcgatgaggggggaacaccctttgtcaggtgtgacaccataggatctgaacttggtattgagctctatgtgaaggtggagggctccaaccccacagggagcttcaaggacagggggatgagcgtggggatcacaaaggcccttgaacttggcgttgatactgtggggtgcgcctcaaccggtaacacctcagcctcccttgcagcctacgcagccagggctgggctgggctgcgtcgttctactcccatcaggtaaggtcgccctcggtaaacttgcccaggctatgttccatggcgccagggtcctctcggtgaggggaaactttgacgaggcccttgaggctgtcacggaacttgcactgatgggtgaactctacctcctcaactccgtgaaccccttcaggcttgagggtcagaagtcaataggctttgagatagtggatgacctcggctgggagtcccctgaccgcatcatactgcctgtggggaatgcaggtaatatctcagccatctggaagggtatatcagagttttacagggctggattcatagatgagaggccgatgatgaccggtatacaggccgagggcgcttcaccggtggtagaagccttcaggaagggcagaaccgagattgaaccggtcagggatcctgaaacggttgcaacggccataaggataggggcccctgttagctatctcaaggccctccgggccatatatgagtcagatggttatgctgaatccgtgaccgatgaggagatactctctgcccagaaactccttgcaaggagggagggtataggtgttgagcccgcatcagcggcgtccatagcgggtctcatcaaactcgttgatgagggtgttgttgacaggggtgaacgtgtggtctgtgttgtcactggtcatgtactcaaggaccctgacaccgccataaaggcatcaacggaaccagttgaggtagaacctgatataaaccagttaagatccattataaggggtacggggtcctcctag

SEQ ID NO: 53180 - protein, 406 aa, Methanothermobacter thermautotrophicus str. Delta H
MDGESVIRCISCGREYDLEEIIYTCRECGSVLEVECDVEVSRDVFRGRRQNMWRYREFMPVDPSRIVSLDEGGTPFVRCDTIGSELGIELYVKVEGSNPTGSFKDRGMSVGITKALELGVDTVGCASTGNTSASLAAYAARAGLGCVVLLPSGKVALGKLAQAMFHGARVLSVRGNFDEALEAVTELALMGELYLLNSVNPFRLEGQKSIGFEIVDDLGWESPDRIILPVGNAGNISAIWKGISEFYRAGFIDERPMMTGIQAEGASPVVEAFRKGRTEIEPVRDPETVATAIRIGAPVSYLKALRAIYESDGYAESVTDEEILSAQKLLARREGIGVEPASAASIAGLIKLVDEGVVDRGERVVCVVTGHVLKDPDTAIKASTEPVEVEPDINQLRSIIRGTGSS

SEQ ID NO: 53181 - DNA, 1488 bp, Halobacterium salinarum NRC-1
  CDS (1)..(1488)
atgctttctcggtgtcctgtgctgcgtagaccgatccctcacggcacgatcgaccacctgattcgcagtcgcgactgcggaactggcacacgcgtgccccgtctaaccaagcccccactcgcagtttcactttcactccgcttcgatcggttttatgttcgtgggcgtcctaccgatagttgtcacacgctccgttctcgcgttcttcggcgctcaccaccaacggttaaacccggaccacgcataccagcgagtatgctctcgctgtccgacattcgggacgcccgcgagcgcgtctccgaaaccgcccgccacacaccgcttgagtactcgcatacgttctccgatctcaccggcgcggacgtccgcccgaagctggagtgtttccagcgcaccggctcgttcaagatccgtggcgcgaccaaccgcatccgcacgctctccgccgaccagcaggacgccggcgtggtcactgcgtcggccggcaaccacgcccagggcgtcgcgctcgcggcctcccggtcgggcgtcgactcgaaggtggtgatgccggagtccgcgcccatctcgaagatcaaggccaccaagagctacggcgccgaagtcgtcctccacggcgccgactacgacgacgcacaggcccacgcccacgaactcgaagccgccgaaggccgcacgtacgtccacgccttcgacgacgagtacatcatggccggccagggcaccctgggcctcgaaatcgccgcggactgtccgacggttgacaccgtcgttgtccccatcggtggcggtggcctcatctccggcgtcgccaccgcgctcaagggggaactcgacgacgtgcgcgtcatcggcgtgcaggccgagggggcctcgacggtcgcgcggtccctcgacaagggccagccacaggccgtcgatcacgtcgacaccatcgccgacggtatcgccgtccgacaggtcggggcgcagacgttccccgtcatccaggagcacgtcgacgaggtcgtcaccgtctccgacgacgagatcgccaccgcgctcgtgttgctgctggagcgcgggaaaaccctcgttgagggtgccggcgccaccgcgctcgcggccgtcctggaggacaaattcgagtacgcggacggcgaaaccatcgtgcccgcgctctgcggtggcaacatcgacctcaacctcctcaccacggtgatcgttcgcgggctcgtcgaccagggccgctacgtcaagatccgcaccgtgctcaaggacagcccgggcagcctcaacgacctgctggcgaccgccgccgaggagcgcgcgaacatctacgccatccagcacgaccgcaccaaccgcgacatcgcgatgaacgccaccgaggtcgaactcgacctcgaaacgcgaggccccgaacacgtcgaccggctgctcacccggatccaggacgagggcttcgacgtcacggtgctcaacggcccccagatcgtcagcgagtga

SEQ ID NO: 53182 - protein, 495 aa, Halobacterium salinarum NRC-1
MLSRCPVLRRPIPHGTIDHLIRSRDCGTGTRVPRLTKPPLAVSLSLRFDRFYVRGRPTDSCHTLRSRVLRRSPPTVKPGPRIPASMLSLSDIRDARERVSETARHTPLEYSHTFSDLTGADVRPKLECFQRTGSFKIRGATNRIRTLSADQQDAGVVTASAGNHAQGVALAASRSGVDSKVVMPESAPISKIKATKSYGAEVVLHGADYDDAQAHAHELEAAEGRTYVHAFDDEYIMAGQGTLGLEIAADCPTVDTVVVPIGGGGLISGVATALKGELDDVRVIGVQAEGASTVARSLDKGQPQAVDHVDTIADGIAVRQVGAQTFPVIQEHVDEVVTVSDDEIATALVLLLERGKTLVEGAGATALAAVLEDKFEYADGETIVPALCGGNIDLNLLTTVIVRGLVDQGRYVKIRTVLKDSPGSLNDLLATAAEERANIYAIQHDRTNRDIAMNATEVELDLETRGPEHVDRLLTRIQDEGFDVTVLNGPQIVSE

SEQ ID NO: 53183 - DNA, 1527 bp, Neisseria meningitidis Z2491
  CDS (1)..(1527)
atgaacacgccccttccttattccaattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcacgcacaaggcgtggcattgtccgcacagcgtttgggttgccgtgccgttatcgtcatgccggagactacgccgaaaatcaaagtggatgcggtcaaaagccgtggcggcgaggtggttttgcgcggtgtttcatacaacgatgcttacgattatgcgatggagctggcggaacaggaagggctgacctatatcgcaccgtttgacgatcctgatgtgattgcaggacaagggacggtagggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcacggcggtcaaagtcgtcggaaacgaaaccttccgtctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggggacgatgaaaaagcgcatatctttgtcggacttcaagcggcaggcccgcaggatttggcggttatcggcagccggttggatgaggcgggattgcccaatgtcgacctgaccgatgatgagattgccaaaatccatatccgctatatggtcggagggcggacggacaaagtagaaaacgagcgtctggtcagttttgagtttccggagcgtccgggggcgttggcgcgttttttgaaccatatgcagggcggttggaacattacgctcttccattaccgcaaccacggtgcggattacgggcggattttggtcggtatcgatgtgccgcctcacgatgccgccgcatttgacggtttcttggaaagtctgggatacagctatcacgaggaaacgcaaaatgccgcgtacaagctgtttcttgcctga

SEQ ID NO: 53184 - protein, 508 aa, Neisseria meningitidis Z2491
MNTPLPYSNYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTDDEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 53185 - DNA, 1707 bp, Deinococcus radiodurans R1
  CDS (1)..(1707)
ttgccccccggcctattctcggcacaagacagcggcgctccgacgcctgacgcgggccgcttcctgggccagccctcctcccccgctgctggcgggggctgcgacttttgcccgtatgttctcctttctttgccgaggtttttcatgtcagacccccgccctgcccccgcccccgctcccttgcccggtacgctggacgggatggacgtgctgcggctcgcgctgaccagtcaggtctacggcgcggccaccgagacgccgctgagccccgccccgcgcctgagcgagcgcagcggcaaccgcgtgctgctcaagcgcgaggaccagcagcccattttctccttcaaattgcgcggcgcctataacaagatgagccagctcagcgccgaggaacgcgcccggggcgtgatttgcgcttcggcaggcaaccacgcacagggagtggcgtttgccggggagaagctcgggattcccgccgtcatcgtgatgcccgcgaccacgcccgacatcaaggtgcaggcgtgccgggcacggggggccgaggtgatcttgcacggcgactcgttcagcgacgccgaaaccttcgcactggcgctgcaacaggagcgcggcctgaccttcgtgcatccctacgacgacccgctggtgctggcggggcagggcaccatcgcgctcgaactgctgcggcaggtggaagaggacgactacgcggtgttcgtgccggtgggcggcggcggcctgatcgcgggggtggcgagcattctgaaagccctcaagcccggcgtgcgggtcatcggcgtggagcccgacgacagcgacgcgatgtaccagagcctgcaagcgggcgaacgggtgcggctcgacaccgtgggcattttcgtggacggggtggcggtcaagcaggtgggggcctacaccttcgacctgacccggcgttacgtggacgactgggtgcgggtgaacaccgacgaggtgtgcgccgccatcaaggacgtgttcgacgacacccgcgccgtgctggaacccgctggggcgctgagcgtggccgggctgaagaaatacgcggcgacccacggcctgcatgaccggacgctggtggcgctcacctgcggggcgaacatcaacttcgaccgcctgcgccacgtggccgagcgcaccgagataggcgagcagcgtgaggcgattctggccgtcacgattcccgagcggcccggcgcctttctggaatttatcgagctgatcggctcgcgggccatcaccgaattcaactaccgctacgctccgcgcgaagacgcccggatttttgtcggcgtgcagctcgggcagccgggcgagcgccaggaactgctgacgctgctgcgtgggcgcggctacgcggtgcttgacctcaccgaagacgaactcgccaaggtccacgtccgccacatggtcggtggccgcgcccccgaggcggtgaacgagcgggtctacgccttcaccttccccgagcggcccggcgccctgcacgactttttgacgcagctccagggcgagtggaacatcagcctctttcactaccgcaaccacggctcggcgcacgggcgggtgctggcgggcgtgcaggtgcctgacgcggcgctcacccgcttcggtgactttctcgctggcctcggctacccggcgcacgacgtgacgagcaatccggcgtaccggctgttcctgacctga

SEQ ID NO: 53186 - protein, 568 aa, Deinococcus radiodurans R1
MPPGLFSAQDSGAPTPDAGRFLGQPSSPAAGGGCDFCPYVLLSLPRFFMSDPRPAPAPAPLPGTLDGMDVLRLALTSQVYGAATETPLSPAPRLSERSGNRVLLKREDQQPIFSFKLRGAYNKMSQLSAEERARGVICASAGNHAQGVAFAGEKLGIPAVIVMPATTPDIKVQACRARGAEVILHGDSFSDAETFALALQQERGLTFVHPYDDPLVLAGQGTIALELLRQVEEDDYAVFVPVGGGGLIAGVASILKALKPGVRVIGVEPDDSDAMYQSLQAGERVRLDTVGIFVDGVAVKQVGAYTFDLTRRYVDDWVRVNTDEVCAAIKDVFDDTRAVLEPAGALSVAGLKKYAATHGLHDRTLVALTCGANINFDRLRHVAERTEIGEQREAILAVTIPERPGAFLEFIELIGSRAITEFNYRYAPREDARIFVGVQLGQPGERQELLTLLRGRGYAVLDLTEDELAKVHVRHMVGGRAPEAVNERVYAFTFPERPGALHDFLTQLQGEWNISLFHYRNHGSAHGRVLAGVQVPDAALTRFGDFLAGLGYPAHDVTSNPAYRLFLT

SEQ ID NO: 53187 - DNA, 1143 bp, Xylella fastidiosa 9a5c
  CDS (1)..(1143)
gtgcaatactgccgctggattttcttagcaggcacgagtcagcatggcatgccatcaggatgtgtgcagatcatcaggacgtatagctctatggatatacctgatgtaggtcacaccgttgtcaagcaacccaatgcaagtaacgtcaacaccgtgagtgtggccgatgtgttggctgcacaagcccgcttacgtcgttatctaatgcctaccccaattcactatgccgagcgtttcggagtgatgctgaagttggaaaatctgcaacgcaccggatcctataaagtgcgtggcgcgctgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggtcacgaaggttgcaggtgtctcacattggggggcgacggtacgccaacacggccaaagctatgacgaggcctatgcgttcgcatgtgagttggctgagcaaaacgattaccactttctatcagcattcgatgatccggatgtgattgccggtcagggaactgttggcatagagatcaccgcgcatgaaccggatgtagtcatcgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccgtctgtgtgccaacttgttagacgatgtagtgatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 53188 - protein, 380 aa, Xylella fastidiosa 9a5c
MQYCRWIFLAGTSQHGMPSGCVQIIRTYSSMDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPVTKVAGVSHWGATVRQHGQSYDEAYAFACELAEQNDYHFLSAFDDPDVIAGQGTVGIEITAHEPDVVIVPIGGGGLASGIALVLRSQGVRVIGAQVEGVDAMARAIRGDTREIAPVSTLADGVKVKIPGFITRRLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 53189 - DNA, 1218 bp, Sulfolobus solfataricus P2
  CDS (1)..(1218)
atgaattacttagaatattttgatagaattagactagcaaaagagaaaatagaaaaatatgtgcatattactccaatagattattctacaacgttttccagaattataaacgcaaaagtttatcttaagttggaaaatctacagaaaactggatcattcaaagttagaggtgcctttaataagttattatctttaaaggaggaagaaaaaaagaatggcgttattgcagtttcagcaggtaatcatgctcaaggagttgcttatgcagcctccacgttaaatatcaaatcgactatagtgatgccagaaacagctccagcttccaagtatttagctacaaaatcctatggggcagaagtagttctttatggtaagtacttgcatgagagtatgaagaaagcggaagaattgattcaaaatactggtttaatatttgttcatccttatagtgatttagatgtgataacgggtcaaggtaccataggattagaattgtatgatatcgaaccagattacgtaattattccaatagggggtggaggattgatttctggtataagtatagctttaaagtatagattcccaaacgtcaagataataggcgttcagtcttcttcttctccttcaatgaaggtttctaaggatcttgggaggcttgtagaaatagagcctagttattccatagctgatggcatattggttaagtctccttctgaattaacctttagtataattaatgagttagtagatgatatagtattagtggatgatgaagaaatagctgaggcaatagttttactacttgaaagaagtaaaacgctagcagaaggagcaggagctgcagcattagcgtcactaatttcagggaaggttaaagtaaatggaatagacaaaaaagtaatttcattagtaagtgggggaaatattgacttatcattattgtctactctaacagagaagtttttatatagacaaaaaagggtagtcaaagtgagggtaatagttccagataagccaggacagttaaataaagtattaagctatgtagttaagatcagaggtaatataatagatattgttcatgataggcacagtagtgatgtattgcctggatacactaaaatatatataactttcgagcttcagtcttcagaggctattaccttacttctgacaaatctggcaaacgagggaatagacgtgaaaattgtagaatag

SEQ ID NO: 53190 - protein, 405 aa, Sulfolobus solfataricus P2
MNYLEYFDRIRLAKEKIEKYVHITPIDYSTTFSRIINAKVYLKLENLQKTGSFKVRGAFNKLLSLKEEEKKNGVIAVSAGNHAQGVAYAASTLNIKSTIVMPETAPASKYLATKSYGAEVVLYGKYLHESMKKAEELIQNTGLIFVHPYSDLDVITGQGTIGLELYDIEPDYVIIPIGGGGLISGISIALKYRFPNVKIIGVQSSSSPSMKVSKDLGRLVEIEPSYSIADGILVKSPSELTFSIINELVDDIVLVDDEEIAEAIVLLLERSKTLAEGAGAAALASLISGKVKVNGIDKKVISLVSGGNIDLSLLSTLTEKFLYRQKRVVKVRVIVPDKPGQLNKVLSYVVKIRGNIIDIVHDRHSSDVLPGYTKIYITFELQSSEAITLLLTNLANEGIDVKIVE

SEQ ID NO: 53191 - DNA, 1038 bp, Sulfolobus solfataricus P2
  CDS (1)..(1038)
gtgattagtagtatggtaaaagaggtttgtatgaaatgcagaaaggaaagggaaagtatatacgagattaagtgtaacaaatgcggaggaccattcgagatcctgatagattttgaatttgataagaattctgagagaggttttccctatagtgaaaagattttcccttacatcaaacatttcatatccctaggagagggaagaactccattaattaaaaaggggaacatatggtttaaactcgacttcttaaatccatcaggatcatacaaggatagaggagcagtgactctggtctcttatcttgcggaaaaaggtgtaaaacaaattagtgaagactcttctggaaatgcaggatcagcaatagctgcgtattctgcagctgctggtattgaggcatacattttcgttcctgaaacggcaaaaggaggaaaacttaagcaaatagaatcctacggtgctcacgttgttagagtaagggggagtagagaagatgtagcaaaagctgcagagaattctggttactattacgcatcacatgttttacaacctcaatttagagatgggattagaactctggcatatgaaattgtaaaggatttagattggaaaattcctaattatgttttcattccagtatcagcaggaactttacttttaggtgtttataaggggttcaagcacttgctagattctggtgtcatatcggaaatgcctaaaatcgtagcagtccaaacagagcaagttatgccactttgtgctaaattcaaaaagatttcttacacaccaccagacaaggttacctccattgcagacgctttagtatcaactagaccatttctactagattatatggtaaaggcttctagtgaatgcatagttgtaagcgataatgaaatagtagaagcttggaaagaattggctaaaatgggactgctggtagaatatagttctgctactgtatttgctgcttataagaaatacagtgttaacgatgcagtattagttttaaccggtagcggattaaaggtattatga

SEQ ID NO: 53192 - protein, 345 aa, Sulfolobus solfataricus P2
MISSMVKEVCMKCRKERESIYEIKCNKCGGPFEILIDFEFDKNSERGFPYSEKIFPYIKHFISLGEGRTPLIKKGNIWFKLDFLNPSGSYKDRGAVTLVSYLAEKGVKQISEDSSGNAGSAIAAYSAAAGIEAYIFVPETAKGGKLKQIESYGAHVVRVRGSREDVAKAAENSGYYYASHVLQPQFRDGIRTLAYEIVKDLDWKIPNYVFIPVSAGTLLLGVYKGFKHLLDSGVISEMPKIVAVQTEQVMPLCAKFKKISYTPPDKVTSIADALVSTRPFLLDYMVKASSECIVVSDNEIVEAWKELAKMGLLVEYSSATVFAAYKKYSVNDAVLVLTGSGLKVL

SEQ ID NO: 53193 - DNA, 1191 bp, Sulfolobus solfataricus P2
  CDS (1)..(1191)
atgaagtgcttgaattgtggatatgaaacggaaatagatcaaagtcagatattatgtccaagatgtggaggactattagaaattatactagaaccaccaaaggacttctctttcagtaaattgagaggaagaggagtttggagatataaagaattaatagcaggcagatacaaaaatattgtaagcataaatgagggaaataccccactaattagatcctcaaatataaatgataatctttattttaaatttgaagggcttaatccaactggtagttttaaggatagaggaatgacagtggcagttagttctgcggtaagcttgaattacaaaactgtaatagccgcatccactggaaatactgcagcttctgcagctgcttatgctgcaagagctggtataaagagctttatcgtcttacctaaaggtaaggtagcattaggtaaattagctcaatcaatactttatggctcagttattttagaagttgatggaagttttgacgttgctatggatgcagtaatgagattatataaggatttaaaagtagtatatccattaaattcctttaatccatggagattagaaggacaaaagacaatcgcatttgagatagcagaagaactaggagttcctgacaacgtgatagtcccggtaggcaatgcaggcaatatctacgccatatggaaaggatttaatgagctagttaaaactggagttattaatactattcctagaatgattggaatccaagctgagggcgcatcaccaatagttaccgcaataataaaaggaaaagattctccagatttcatagaaaatccagatactgtagcaacagcaataaggatagggaaaccagttaattggcaaaaagcgatgaaagcaataagggaatctaatggaaccgcaatagctgtatctgattccgagatattagacgcacagaagaccctagctagaaaagagggcataggagctgagcctgcttcagcagctgccttagctggttatattaaggcaataaatgaaaaggtggtagataaagatgaaaaaacagttttaatcctaacaggacattcgttaaaggatcccgatagtatgacaaaagctgaggctaaaagaatattagttaatcctttacatatggaaaaaattatcctaggtgagataaatggctctaatagttaa

SEQ ID NO: 53194 - protein, 396 aa, Sulfolobus solfataricus P2
MKCLNCGYETEIDQSQILCPRCGGLLEIILEPPKDFSFSKLRGRGVWRYKELIAGRYKNIVSINEGNTPLIRSSNINDNLYFKFEGLNPTGSFKDRGMTVAVSSAVSLNYKTVIAASTGNTAASAAAYAARAGIKSFIVLPKGKVALGKLAQSILYGSVILEVDGSFDVAMDAVMRLYKDLKVVYPLNSFNPWRLEGQKTIAFEIAEELGVPDNVIVPVGNAGNIYAIWKGFNELVKTGVINTIPRMIGIQAEGASPIVTAIIKGKDSPDFIENPDTVATAIRIGKPVNWQKAMKAIRESNGTAIAVSDSEILDAQKTLARKEGIGAEPASAAALAGYIKAINEKVVDKDEKTVLILTGHSLKDPDSMTKAEAKRILVNPLHMEKIILGEINGSNS

SEQ ID NO: 53195 - DNA, 1251 bp, Streptococcus pneumoniae TIGR4
  CDS (1)..(1251)
atgttaagttcaaaagatataatcaaggctcacaaggtcttgaacggtgtggttgtgaatactccactggattacgatcattatttatcggagaagtatggtgctaagatttatttgaaaaaagaaaatgcccagcgtgttcgctcctttaaaattcgtggtgcctattatgccatttcccagctcagcaaggaagaacgtgaacgtggggtagtctgcgcttctgcgggaaatcatgcgcagggagtagcctatacttgtaatgaaatgaaaattcctgctactatctttatgcccattactacgccacaacaaaagattggtcaggttcgcttttttggtggggattttgtaactattaaactagttggagatacctttgatgcctcagccaaagcagctcaagaatttacagtctctgaaaatcgtacctttattgatccttttgatgatgctcatgttcaagcaggtcaaggaacagttgcttatgagattttagaagaagctcgaaaagaatcgattgattttgatgctgtcttggttcctgttggtggtggcggtctcattgccggggtttctacctatatcaaggaaacaagtccagagattgaggttatcggagtagaggcgaatggagcgcgttccatgaaagctgcctttgaggctggaggtccagtaaaactcaaggaaattgataaatttgctgatgggattgctgtgcaaaaggtaggtcagttgacctatgaagcaactcgtcaacatattaaaactttggtaggtgtcgatgagggattgatttctgaaaccttgattgacctttactctaagcaagggatagtcgcagaacctgctggagcggctagtatcgcctctttagaggttttagctgaatatattaaggggaaaaccatttgttgtatcatttctggaggaaataatgatatcaaccgtatgccagaaatggaagagcgtgccttgatttatgatggtatcaaacattactttgtggtcaatttcccacaacgtccaggagctttgcgtgagtttgtaaatgatatcctggggccaaatgatgatatcacacgttttgagtatatcaaacgagctagcaagggaacaggcccagtattaattgggatcgctttagcagataagcatgattatgcaggtttgattcgtagaatggaaggttttgatccagcttatattaacttaaatggtaatgaaacgctttataatatgcttgtctga

SEQ ID NO: 53196 - protein, 416 aa, Streptococcus pneumoniae TIGR4
MLSSKDIIKAHKVLNGVVVNTPLDYDHYLSEKYGAKIYLKKENAQRVRSFKIRGAYYAISQLSKEERERGVVCASAGNHAQGVAYTCNEMKIPATIFMPITTPQQKIGQVRFFGGDFVTIKLVGDTFDASAKAAQEFTVSENRTFIDPFDDAHVQAGQGTVAYEILEEARKESIDFDAVLVPVGGGGLIAGVSTYIKETSPEIEVIGVEANGARSMKAAFEAGGPVKLKEIDKFADGIAVQKVGQLTYEATRQHIKTLVGVDEGLISETLIDLYSKQGIVAEPAGAASIASLEVLAEYIKGKTICCIISGGNNDINRMPEMEERALIYDGIKHYFVVNFPQRPGALREFVNDILGPNDDITRFEYIKRASKGTGPVLIGIALADKHDYAGLIRRMEGFDPAYINLNGNETLYNMLV

SEQ ID NO: 53197 - DNA, 1314 bp, Agrobacterium tumefaciens str. C58
  CDS (1)..(1314)
ttgtctccgacgccttcctatggcatagcgggtgccattatgaatttcaatggattgactatcgtggacaagcagcttgtggaagcagcgcggcgggaagtgcgggagatattcccggaaacgccgctgcagttgaatgaacatctcagccgtcgctatggcgcatcgatttggctgaagcgtgaggatctgtccccggttcgttcctacaagattagaggcgcattcaattttctccgcaaggcggtggccaaggctggcaaggacaaggttttcgtctgcgcgtccgccggcaaccacgcccagggctttgctttcgcctgccgccatttcggcgttcacggcgtcgttttcatgccggtgacgacaccgcagcagaagatcgaaaaaacccgcatctttggcggagagttcatcaagatccgtctggtgggcgatatcttcgaccagtgttacgccgctgcgcgtcagcatgtgcaggaccatgacggctacatggttccgccctttgaccatgaggatattatcgaaggccaggcgacggtcgccgccgagatcatggaccagctgcccgaaggcaccaaacctgacatcgtcgtgatgcctgtcggtggtggcggtctttcggccggcctgaccgggtttctggccggcacggtgaagaaggagaacttcgtgttctgcgagccggaaggcgcgcccagcctgaaaaagagcctggaacgtggcgaaccggtgacgctgaacaaggtcgacaattttgtcgatggtgccgccgttgcccgcatcggcgacctgaacttcaaggcgctgaaggattttccggccgagcaggtgatgctcatcccggaaaatgcgatctgcgtgacgatcatcgagatgctgaacctagaaggcgtggtgctggagcctgcgggcgccctgtccatcgccgcgctggaaaggctcggccgcgagaggctggaaggcaagacggtcatcgccgtggtctccggcggtaatttcgatttcgagcgcctgccggacgtcaaggaacgcgccatgcgttacaccggcgtgaagaagtacttcatcctgcgcctgccgcagcgccccggcgcgctgcgcgatttcctcaatctgctcggtccggacgacgatatcgcccgtttcgaatatctgaagaaatccgcccgcaatttcggctcgatcctgatcggcatcgagaccaatgcgcaggaaaacttcgccgggttgctggagcgcttcgaggcagccggtctcggctatgaggatattaccgaaaacgacatcttgtcgaacctgatcatctga

SEQ ID NO: 53198 - protein, 437 aa, Agrobacterium tumefaciens str. C58
MSPTPSYGIAGAIMNFNGLTIVDKQLVEAARREVREIFPETPLQLNEHLSRRYGASIWLKREDLSPVRSYKIRGAFNFLRKAVAKAGKDKVFVCASAGNHAQGFAFACRHFGVHGVVFMPVTTPQQKIEKTRIFGGEFIKIRLVGDIFDQCYAAARQHVQDHDGYMVPPFDHEDIIEGQATVAAEIMDQLPEGTKPDIVVMPVGGGGLSAGLTGFLAGTVKKENFVFCEPEGAPSLKKSLERGEPVTLNKVDNFVDGAAVARIGDLNFKALKDFPAEQVMLIPENAICVTIIEMLNLEGVVLEPAGALSIAALERLGRERLEGKTVIAVVSGGNFDFERLPDVKERAMRYTGVKKYFILRLPQRPGALRDFLNLLGPDDDIARFEYLKKSARNFGSILIGIETNAQENFAGLLERFEAAGLGYEDITENDILSNLII

SEQ ID NO: 53199 - DNA, 915 bp, Agrobacterium tumefaciens str. C58
  CDS (1)..(915)
gtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 53200 - protein, 304 aa, Agrobacterium tumefaciens str. C58
MERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 53201 - DNA, 1215 bp, Sulfolobus tokodaii str. 7
  CDS (1)..(1215)
atgtcttatacaaaatattttgatgaaatagtaaaaattcaagatagaattaaacaatatattcatgagacgcctattgattactcaaaaaccttttctgatatgattggagctcaaatatatttaaagcttgaaaatttgcagaaaacaggttcttttaaggtaagaggagctttttcaaaattgacaagcctagccgaagaagaaaggaaaaaaggtgttatagcggtttccgcgggtaatcatgctcaaggtgttgcatatgctgcaaaagttttaggaattaaagcaactatagtaatgccagaaactgctccaatctcaaaatatcaagctacaaagtcatacggtgctcaagttattttgtatgggaaatttcttcatgagagtatgaaaaaagctgaggagattataagagaagaaggaagtattcttgttcatccttacggagatcttgatgtaattttgggtcaaggtacattaggactagaacttttgccatataatccagatattgttgttgttcctataggagggggaggactaatatcaggaatatctatagcattaaaagcaaaaaatccaaaaaccaaaataataggtgtacaatcttcagcttctccttcattaaaggtctcaaaagatcttcataggctagtagagattgagccctctttttcgatagcagatggaattctagtaaaatctccctctgaaataacgtttagcataatagatgaattagtggatgatattgttcttgttgatgatgaagaaatagcaaatgctatagtatatttattagaaagaaataaaacattagtagaaggagcagctgctgcttcattagcagcacttttatctggaaagattaaagttgcttataatcataaagctattccggttctaagtgggggcaatatagatctttcaatgttatccagaattatagataagatgcttttcaagaataaacgaatagtcaaagtgaaggtaatagtaccagataaacctggatatcttaataaagtattaagtagagtagcacaaataagagggaacgttatcgatgtagttcatgatagaacaagcagtgatgttaaacctggttatactaaaatttatgtaatgtttgaagtacctagtggtgatgctctttcagatttcatgtacaacttagctttagatggtattgaggctaaattagtagaatag

SEQ ID NO: 53202 - protein, 404 aa, Sulfolobus tokodaii str. 7
MSYTKYFDEIVKIQDRIKQYIHETPIDYSKTFSDMIGAQIYLKLENLQKTGSFKVRGAFSKLTSLAEEERKKGVIAVSAGNHAQGVAYAAKVLGIKATIVMPETAPISKYQATKSYGAQVILYGKFLHESMKKAEEIIREEGSILVHPYGDLDVILGQGTLGLELLPYNPDIVVVPIGGGGLISGISIALKAKNPKTKIIGVQSSASPSLKVSKDLHRLVEIEPSFSIADGILVKSPSEITFSIIDELVDDIVLVDDEEIANAIVYLLERNKTLVEGAAAASLAALLSGKIKVAYNHKAIPVLSGGNIDLSMLSRIIDKMLFKNKRIVKVKVIVPDKPGYLNKVLSRVAQIRGNVIDVVHDRTSSDVKPGYTKIYVMFEVPSGDALSDFMYNLALDGIEAKLVE

SEQ ID NO: 53203 - DNA, 1188 bp, Sulfolobus tokodaii str. 7
  CDS (1)..(1188)
atgcaaggctatctaaaatgcttagactgtggatcagaatatcctatccaacaagatattataacttgtcctaaatgtggaggattattagagataattgttgaacctaagaaagacttctcattcagtaaactaaaagggaaaggagtttggagatatagagaattaatagctggagaatacaaacatatagttagtttaaatgaaggaaataccccactaattgcttcttctactaataaaaatctatattttaagtttgaaggagccaaccctactggaagttttaaagatagaggaatgacagtagctataagttccgctaaatcattaaactataaagttgtagtagctgcatctactggaaatactgcagcttcagccgctgcatatgcaagtagagctggtttaagaagttacattgtattacctaaaggaaaagttgctttaggaaaattggctcaatctatactttatgggactactatacttgaagttgatggcagttttgatgttgctatgaatagtgtaatgaaattatatagagaactaaaaatagtttatccgcttaactcttttaatccatggagacttgaaggacaaaaaactattgcttttgaaatagttgaggatattggagtacctgataatgtgatagtacccgtaggtaatgccggaaacatttatgctatatggaagggatttgtagagttaatgaatattggggttaccgataaagtacctagaatgattgggatacaagctgaaggagcagcgccaatagctaaggctctagaaaaaggattagataaaccggaatttatagattcacctgaaactgtagcctctgctataagaataggtaaaccagtgaactggaaaaaagcaattaaggctataaaatcatctaatggatttgcaacttatgtttctgactctgagatcttagaggcgcaaaaagaattagctaggagagagggaataggtgcagaacctgcatcagctgcttcctatgctggttatttaaagcttgtaaattctggcaaaattgataaaagcgaaaaaactgttttaattttaactgggcatgcgctaaaggacccagatgcgatgataaaagctgaatcacgaagaattttagttaacccagaacatataaatgaaataatcttgagtgatctaaaatga

SEQ ID NO: 53204 - protein, 395 aa, Sulfolobus tokodaii str. 7
MQGYLKCLDCGSEYPIQQDIITCPKCGGLLEIIVEPKKDFSFSKLKGKGVWRYRELIAGEYKHIVSLNEGNTPLIASSTNKNLYFKFEGANPTGSFKDRGMTVAISSAKSLNYKVVVAASTGNTAASAAAYASRAGLRSYIVLPKGKVALGKLAQSILYGTTILEVDGSFDVAMNSVMKLYRELKIVYPLNSFNPWRLEGQKTIAFEIVEDIGVPDNVIVPVGNAGNIYAIWKGFVELMNIGVTDKVPRMIGIQAEGAAPIAKALEKGLDKPEFIDSPETVASAIRIGKPVNWKKAIKAIKSSNGFATYVSDSEILEAQKELARREGIGAEPASAASYAGYLKLVNSGKIDKSEKTVLILTGHALKDPDAMIKAESRRILVNPEHINEIILSDLK

SEQ ID NO: 53205 - DNA, 1248 bp, Sinorhizobium meliloti 1021
  CDS (1)..(1248)
atgaagcaggatgttgaaaaagcggcagcggcgatgcgcgagatctttccgccgacgccgcttcagctcaacgagcacctgagcgcgcgctgtggggcgaccgtcttcctgaagcgcgaggacctttcgccggtgcgctcctacaagatccgcggcgccttcaatttcttccgcaagtcgctcggctccggagcggccgggaagaccttcgtttgcgcttccgcgggcaatcacgctcagggctttgctttcgtctgccgccacttcggcgttcccggagtcgtcttcatgcccgtgacgacgccccagcagaagatcgacaaaacgcgcatgttcggggccgagttcatcacgatccgcctcgtcggcgatattttcgatcaatgctacaaggcggcgcgcgagcatgtggaagcgatcggcggcgtcatggtgcctcccttcgaccatgacgatatcatcgaaggccaggccacggttgcagcggagatagccgaacaattgccggccggccccgttgccgatctcgtcgtcctgcccgtcggcggcggcggcttggccgcgggcgtgaccgggtatttgggcgacagcctctcggccgaccgttttctgttctgtgaaccggagggggcgccgagcttcaggcgcagcctggaactcggcggcgtcgtcacgctcgaccaggtggacaatttcgtcgatggcgcggcggtcgcacggatcggcgacctgaactttgctgcgctccggagattttcgccggaacaggtgatgctgctgcctgagaatgcgatctgcctgacgatcaccgaaatgctgaatgtcgagggcgtggttctcgaacccgccggcgcgcttgcaatcaccgcactggaagcgcttggccgcgatagtctcgaaggcaagatcgtcgtagcggtcgtttccggaggcaatttcgacttcgagcgcctgccggacgtgaaggagcgggccatgcgccatgcggggctcaagaaatacttcatcctgcgcatggcgcagcgtccgggcgcgcttcgcgatttcctcggtctcctgggagaggaggacgacatcgcccggttcgaatacctgaaaaagtctgctcgaaacttcggctccgtgctcatcggtatcgaaacgaaacacgcggagaatttccccgttctcaaacagcgtttcgatgcggcgggtctccgctaccaggacatcaccgagaacgagatgctggccaacttcgtcatttga

SEQ ID NO: 53206 - protein, 415 aa, Sinorhizobium meliloti 1021
MKQDVEKAAAAMREIFPPTPLQLNEHLSARCGATVFLKREDLSPVRSYKIRGAFNFFRKSLGSGAAGKTFVCASAGNHAQGFAFVCRHFGVPGVVFMPVTTPQQKIDKTRMFGAEFITIRLVGDIFDQCYKAAREHVEAIGGVMVPPFDHDDIIEGQATVAAEIAEQLPAGPVADLVVLPVGGGGLAAGVTGYLGDSLSADRFLFCEPEGAPSFRRSLELGGVVTLDQVDNFVDGAAVARIGDLNFAALRRFSPEQVMLLPENAICLTITEMLNVEGVVLEPAGALAITALEALGRDSLEGKIVVAVVSGGNFDFERLPDVKERAMRHAGLKKYFILRMAQRPGALRDFLGLLGEEDDIARFEYLKKSARNFGSVLIGIETKHAENFPVLKQRFDAAGLRYQDITENEMLANFVI

SEQ ID NO: 53207 - DNA, 978 bp, Caulobacter crescentus CB15
  CDS (1)..(978)
atgaccgtctcgctcgccgacatccaagccgccgccgtacgcctgaagggctcggccgtcgagacgccgctgatcgagagccccgccttgaacgacaggctgggcgggcggatcttcctcaagcccgagaccttgcaacgtgccggcgccttcaagtttcgcggcgcctacaaccgtctttctcagctcagcgatgaggaaaaggcgcgcggcgtcgtggccttctcgtccggcaatcacgcccaaggggtggcgctggcggccaggctgctgggcgtgccggcgctgattgtgatgccctccgattcgcccagcgtgaaggtcgaaggcacgcgcgggtttggcgcggacatccgcttctacgaccgcttcaccgaggaccgcgtcgccatcgccgaccagatcgcggccgagcgcggctgcgtggtcgtgccctcgtatgacgacccgcacatcatcgccggccagggcacggtgggtctggagatcgtcgcccaggccgccgcgcaaggcgcgacgctggaccgcctgatctgctgcgtcggcggcggcggtctgatcgccggaacctcgacggcggtgaaggccctctcgccggccaccgagatctggggcgtggagcccgccggcttcgacgagacgcggcgctcgctggaaagcggccggcgcgagaccatcgacaaggacgcccgctcgatctgcgacgccctgctgaccccgatccccggcgacctgacctggccgatcaaccagaaaaacctctcaggcgtggtcgcggtgaccgacgccgaggtggccgaggcgatgcgctatgcgttctcgaccttgaaactggtggtggagcccggcggctgcgtggccctgacggcggcgctgacaggcaaggtcgacgtcgccggcaagaccgtggcgatcgtgctgtcgggcggcaatgtcgatccggggttgttcgcgcaggtcttgggcggtcaaatctga

SEQ ID NO: 53208 - protein, 325 aa, Caulobacter crescentus CB15
MTVSLADIQAAAVRLKGSAVETPLIESPALNDRLGGRIFLKPETLQRAGAFKFRGAYNRLSQLSDEEKARGVVAFSSGNHAQGVALAARLLGVPALIVMPSDSPSVKVEGTRGFGADIRFYDRFTEDRVAIADQIAAERGCVVVPSYDDPHIIAGQGTVGLEIVAQAAAQGATLDRLICCVGGGGLIAGTSTAVKALSPATEIWGVEPAGFDETRRSLESGRRETIDKDARSICDALLTPIPGDLTWPINQKNLSGVVAVTDAEVAEAMRYAFSTLKLVVEPGGCVALTAALTGKVDVAGKTVAIVLSGGNVDPGLFAQVLGGQI

SEQ ID NO: 53209 - DNA, 1203 bp, Caulobacter crescentus CB15
  CDS (1)..(1203)
atgaccctcgacctcgccgctatccaggccgccgccggccgtctccagggccagatcgagcgcacgccgtgccgccactccaagaccctctcgaagatcaccggcgccgaggtgtgggtgaagttcgagaacctgcagttcaccgccgcctacaaggagcgcggcgcgctcaacaagctgatgctcctctcggagaccgagaagcagcgcggcgtcatcgccgccagcgccggcaaccacgcccagggcttggcctatcacggcgcgcgcctcggcgtgccggtcaccatcgtcatgcccaagaccacgcctttcgtgaaggtgcagcacacccgcgacttcggcgcgaccgtggtcatcgagggcgagacctatgacgacgccaacgcccatgcccgcaagctgcgcgacgagcagggcctgaccttcgtccacccgttcgacgactacgacatcatggccggacagggcaccatcgccctggaaatgctggaagacgcgcccgatctggagatcctgcccgtgccgatcggcggcggcggcctgatcagcggcgtggcgacggcggccaaggcgctgaagccggatatccgcatcatcggctgcgagccggccatgtatccgtccttcaccgccaagatgcgcggtgtcgccgcccactgcggcggccagaccatcgccgaaggggtcgcggtcaagcaggtcggcgagctgacctatggcgtcgttcgcccgttgctggacgacgtgctgctgctggaagagccctatctggagcaggccgtctcgctctattgcaatgtcgagaagaccatcgccgagggcgcgggcgcagcctcgctggccgctttgctggcctatcccgaacgcttccggggcaagaagtgcggcctgatcctgtgcggcggcaatatcgacacccgcctcttggcctcggtgctgacccgcgaactggtgcgcgcccagcgcctggccagcttgcgaatcatcggcgacgaccgtccgggcctgttgtcgaccgtcgcctcggtcatcggcgccatgggcgccaacatcatcgaagtgaatcacaaccgcctggccctggacgtgccggccaagggcgcggagttcgacatcaccatcgaaacccgcgacgcccagcacacccaggaggtcatggaggccctgcgcgagagcggctacccgccgcgggtggtttga

SEQ ID NO: 53210 - protein, 400 aa, Caulobacter crescentus CB15
MTLDLAAIQAAAGRLQGQIERTPCRHSKTLSKITGAEVWVKFENLQFTAAYKERGALNKLMLLSETEKQRGVIAASAGNHAQGLAYHGARLGVPVTIVMPKTTPFVKVQHTRDFGATVVIEGETYDDANAHARKLRDEQGLTFVHPFDDYDIMAGQGTIALEMLEDAPDLEILPVPIGGGGLISGVATAAKALKPDIRIIGCEPAMYPSFTAKMRGVAAHCGGQTIAEGVAVKQVGELTYGVVRPLLDDVLLLEEPYLEQAVSLYCNVEKTIAEGAGAASLAALLAYPERFRGKKCGLILCGGNIDTRLLASVLTRELVRAQRLASLRIIGDDRPGLLSTVASVIGAMGANIIEVNHNRLALDVPAKGAEFDITIETRDAQHTQEVMEALRESGYPPRVV

SEQ ID NO: 53211 - DNA, 972 bp, Sinorhizobium meliloti 1021
  CDS (1)..(972)
atgcgcaattaccccaccattcaggacatccgtgaagcccgggaacggctgaaaccgcacgtcaggcacacgccgctcttgcgtgcggagaaaatcgagaaggccgctggctgtcagctttatctcaaacccgaaaccctgcagatcactggcgccttcaagatccgcggcgccctgaacaaggctctctcgctctcgagagaagagatcgcaaacggcattatcgcgacgtcgtcgggcaaccatgcccaggggctttcttacgcggccaagatgctcggcgtaaaagtgatattggtacttccggtcaccacacccaaaatcaagattgaaaatacaaaagccctgggtgcggaagtcattctttttgatggtgataatgctgctagatggaaaaaggtctacgaaatcgctgaaggaaacaagtatgcggttattcacggcttcgaggaccccgttgtaatggctggccagggaacgatcgggtgcgagatactcgaagacctggacgatgtagatacggtcatcgttcccttaggcggcggaggcctgatctcgggaatcgctaccgccataaaagaaacgaaaccatcggtgcgcgttatcggggcagagcctgccttgacaccgaagtattttcacagccgggtaaacaaggagcgcacatcgcttcccttgaagaacaccattgcggatggcttgaggataagcgttccgggtcaaaacccgtatccgattatcgaaaagtatgtggacgagattgttcttgttgaagacgagcacatcatcgccgggatgcgtgctcttgccaaggatgcgaaattgatcgctgaaccagccgcctcgattggcgtcggagcactgttggcgggcatcatagacgtcaagctggatgaaaaagtctgtgcggtgttgtctggcgggaactgggatctacgcgaccttgccgcgatatacaatgtagcggggtaa

SEQ ID NO: 53212 - protein, 323 aa, Sinorhizobium meliloti 1021
MRNYPTIQDIREARERLKPHVRHTPLLRAEKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPVVMAGQGTIGCEILEDLDDVDTVIVPLGGGGLISGIATAIKETKPSVRVIGAEPALTPKYFHSRVNKERTSLPLKNTIADGLRISVPGQNPYPIIEKYVDEIVLVEDEHIIAGMRALAKDAKLIAEPAASIGVGALLAGIIDVKLDEKVCAVLSGGNWDLRDLAAIYNVAG

SEQ ID NO: 53213 - DNA, 1005 bp, Sinorhizobium meliloti 1021
  CDS (1)..(1005)
gtgagcgtttctctccccgtgacgatcgacgacatcgaggtggcggcacggcgcatttccggccgtgtacttacgacgccgctggcaatgtcgggctcgttgagcgagctctgcggcgtgccggtcggcttaaagctcgagcaccaccagacgaccggtagcttcaagctgcgcggcgcgaccaatgcagtgctttcgctttctgccggcgaccgggcgctcggcgtaatcgcggcctcgaccggcaatcatggccgggcacttgcccatgcggcaaaggcggaaggctcggtcgctacgatctgcatgtcgcacctggtgcccgtgaacaaggtctccgaaatcagacgcctcggcgccaatgtgcggattgtcggcaattcccaggacgaggcgcaggaagaagtcgaaaggctcgttgcggaaaatggtctcgtgatggtgccgcccttcgaccatcgggcgatcgtcgccgggcaggggacgctcggactcgaggtcgtggcgcagatgccggacgttgccatggtgcttgtaccggtgtcgggtggtggactggcagccggagtggcggcagcggtcaaggcgcgcagaccggcgacgcgtgtcataggcctgacgatggagcgcggtgcggcgatgaaggcgagcttcgccgccggcggacccgcgctcgtcgatgaacaaccgagccttgcggactcgctcggcggcggcatcggcctcgacaatcgcgtcacattccgcatgtgccgggagctcctcgacgacataatcctcctgacggaagccgagatcgccgccggcatgcgccacgcctatgccgaggagcgcgagatcgtcgaaggggcgggggccgtcggcatttcggcgcttctcgccggcaagatcaaggacatcgacggccccatcgcggttattatctcggggcgcaacgtcgacatggacctgcacctgcgcgtgatgaacggcgaaacggacccattccgcgaggaggcggcatga

SEQ ID NO: 53214 - protein, 334 aa, Sinorhizobium meliloti 1021
MSVSLPVTIDDIEVAARRISGRVLTTPLAMSGSLSELCGVPVGLKLEHHQTTGSFKLRGATNAVLSLSAGDRALGVIAASTGNHGRALAHAAKAEGSVATICMSHLVPVNKVSEIRRLGANVRIVGNSQDEAQEEVERLVAENGLVMVPPFDHRAIVAGQGTLGLEVVAQMPDVAMVLVPVSGGGLAAGVAAAVKARRPATRVIGLTMERGAAMKASFAAGGPALVDEQPSLADSLGGGIGLDNRVTFRMCRELLDDIILLTEAEIAAGMRHAYAEEREIVEGAGAVGISALLAGKIKDIDGPIAVIISGRNVDMDLHLRVMNGETDPFREEAA

SEQ ID NO: 53215 - DNA, 1527 bp, Synechocystis sp. PCC 6803
  CDS (1)..(1527)
atgaccaccgattacctcgaaagaattcttaaagcccgggtttacgatgtggcgatcgaaactccgttggatttggcggccaatttatcgaagcggctgggtaaccgggtttactttaagcgggaagacctacagccggtcttttcctttaagttacggggggcctataacaaaatggcccagttatcaccggaattattggcaaaaggagtaattgcagcttcggcgggtaaccatgcccagggagtggccctaggagcttccaagttgggtaccagggcgattattgttatgcccgaaaccactcctcaggtgaaagtggaggcggtcaaagctcggggcggtgtggtggtgctctatggcgaaacctatgacgatgcctatggccatgcccgacagttggagcaggaaaaagggctaacttttatccatccttttaatgatcccgacgtgattgctggccaaggcaccattggcatggaaattctacgtcagtatcaacagcccattgatgccatttttgtggcgatcggtggcggtgggctgattgcgggggtagcggcctacgttaaacgcctctatccagaaattaaaattatcggcgtggaaccaacggatgccgatgctatgcgccaatctttggcggcgggaaaacgggtcaagctaaaccaagtgggactgtttgcggatggtgtggcggtgcgggaagtgggggatttaacttttcccctctgtcagcaatatgtggatgatattttgctggtggatacggacgacacctgtgcggccatcaaagattgctttgaagatacccgctcaattttggagccggcgggagcgttggccattgcgggactgaaacaatatgtccaaaagcaaggctgtcgagaccaaaccctagtggcgatcgcctgtggggcgaatatgaactttgaccgattgagatttgtggcggaacgggccgagtatggggaacagcgagaggccatttttgcagtgaccattcccgaacaaaggggcagtttaagaaaattttgtgaagggttagggaaacataacattaccgaatttagttaccgcattgcggaggggcccgatgctcatatttttgtcggcattcaggtgcaaaaccgcagtgatgcgtcccaactggccgccagctttaaccgccaaggttttaaaaccctcgatttaaccgatgacgaactgacgaagctccatttgcgccatatggtggggggccgtcccccccaggtgacccaattggaaaatcaacgggaattactctaccgatttgaatttcctgagcggccaggggcattgatgaaatttttgggctgtatggatccagcctggaatattagtttgttccattaccgtaaccacggggccgactacggcagaattgtcgtcggcatgcaggttcccttggcagaaatggaacagtggcaacagtttttagccaatttaggctatcgctattgggacgagagtgataatccggtttatcgtctctttcttcgctaa

SEQ ID NO: 53216 - protein, 508 aa, Synechocystis sp. PCC 6803
MTTDYLERILKARVYDVAIETPLDLAANLSKRLGNRVYFKREDLQPVFSFKLRGAYNKMAQLSPELLAKGVIAASAGNHAQGVALGASKLGTRAIIVMPETTPQVKVEAVKARGGVVVLYGETYDDAYGHARQLEQEKGLTFIHPFNDPDVIAGQGTIGMEILRQYQQPIDAIFVAIGGGGLIAGVAAYVKRLYPEIKIIGVEPTDADAMRQSLAAGKRVKLNQVGLFADGVAVREVGDLTFPLCQQYVDDILLVDTDDTCAAIKDCFEDTRSILEPAGALAIAGLKQYVQKQGCRDQTLVAIACGANMNFDRLRFVAERAEYGEQREAIFAVTIPEQRGSLRKFCEGLGKHNITEFSYRIAEGPDAHIFVGIQVQNRSDASQLAASFNRQGFKTLDLTDDELTKLHLRHMVGGRPPQVTQLENQRELLYRFEFPERPGALMKFLGCMDPAWNISLFHYRNHGADYGRIVVGMQVPLAEMEQWQQFLANLGYRYWDESDNPVYRLFLR

SEQ ID NO: 53217 - DNA, 1269 bp, Listeria monocytogenes EGD-e
  CDS (1)..(1269)
atggaattagttgacttattagtaacagaagaagatgtcgaaaaggcctatgaagtcttaaagtcggtcgtcaaacatacgccactagaatatgatttttatctttcggaaaaatatcattgcaatgtctatctgaaacgcgaagatttgcaaagagtgcgttcttttaaattacgtggtgctttttatgctatttctagattatcagcggaacaattggaaaaaggagtggtgtgcgcaagtgctggaaatcatgcgcaaggagttgcatatacgtgcaaacgaatgacagttccagctacgatttttatgccaacgactaccccgcaacaaaaagtatcacaagtaaaattttttggtggtagtaatgtcgaagtggttttagttggcgatacgtttgatgcttctgcaactgccgcgaaagaatttgctgcagcacatggccaaacttttatcccaccgtttgatgatcctgatattattgcaggccaaggctcgcttgctgtggagatggtcaaagatttaaataaagcacacgagcaagcagattatgtttttgctggaattgggggtggtggcttgattagcggtgttgcaacgtatctcaaagcgaagagcccgattacaaaaatcatcggggtagaacctgatggcgcgccttcaatgacagcagctttaaaacaaaatcaagtcgtaacactagataaaatcgataaatttgtcgatggtgctgcggtaaaagaagttggtagcttaacgttccaacatgccaaagtgttagtcgatgaagtgacaactgtttctgaaggtgctgtttgttctacgattttggatatgtatacgaagcaagcgattgttgcagaacctgctggagcactttccgttgctgcacttgaaacctaccgcgaggaaattaaagacaagacggttgtttgtattgtaagtggcggaaacaatgatattaaccggatgcaagaaattgaagaacgttccctcctacatgaaggattaaagcattattttatcgtcaatttctcgcagcgtcctggggctttgaaagaatttgttaacgatgtgctcggtccacatgacgatatcaccaaattcgaatatacgaaaaaagtgaatcgaggtaatggacctgtaattatcggtgttttgttgcaagataaaaatgattatgaaggattgcttgaccgggttgctgcttttgacccgagctatattccgattaatgataatcaaaccctatacactttgcttgtataa

SEQ ID NO: 53218 - protein, 422 aa, Listeria monocytogenes EGD-e
MELVDLLVTEEDVEKAYEVLKSVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAAAHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 53219 - DNA, 1269 bp, Listeria innocua Clip11262
  CDS (1)..(1269)
atggagttagttgatttattagtgacagaagaagatgtcgaaaaagcctatgatgtattaaaaccagttgtcaagcataccccgcttgaatacgatttttacctatcagaaaaatatcattgcaatgtatatttgaaacgtgaagatttacagcgggtgcgttcttttaaattacgtggtgctttttatgccatttctcgactgtcagcagaacagttagaaaaaggagttgcctgtgcaagcgctggaaatcatgcccaaggagtcgcctatacttgtaaacgtatgacggttccggcaacgattttcatgccaactactaccccacaacaaaaagtatcgcaagtgaaatttttcggtggaagtaatgtggaggttgttttagttggtgacacgtttgatgcatctgctactgccgcaaaagaattcgcagcagaacatggtcagacatttatcccgccgtttgatgatccagatattatcgcaggccaaggatcgctcgcggttgaaatggtaaaagatttaaataaagcacatgagcaagcggattatgtttttgcaggtattggtggcggcggcttaattagcggtgtggcatcttatctaaaagcgaaaagtccaatcacaaaaattatcggtgtagaaccagctggcgcgccttcgatgacagaagcattaaaacaaaatcaagttgtgactctagataaaatcgataaatttgttgacggggctgcagtgaaagaagttggaagtttaacatttcagcatgcaaaagtcttagttgatgaagtgacaaccgtttctgaaggagcagtttgttcaacaattttagatatgtatacgaagcaagcgattgtcgccgaaccagctggtgctctttccgttgctgctctcgaaacttatcgtgaggaaatcaaagataaaacagtagtctgtatcgttagtggcggaaataacgatattaatcgaatgcaagaaattgaagagcgttccctacttcatgaaggattaaaacattatttcatcgtcaacttctctcaacgccctggtgctctaaaagagtttgtaaatgatgttcttggaccgcatgatgatattactaaattcgaatatacgaaaaaagtaaatcgaggcaatggacctgttatcatcggtgtacttttacaagataagaatgattatgaaggcttgcttgaccgggttgctgcttttgatccgagttatataccgattaatgataaccaaacactttacacattacttgtttaa

SEQ ID NO: 53220 - protein, 422 aa, Listeria innocua Clip11262
MELVDLLVTEEDVEKAYDVLKPVVKHTPLEYDFYLSEKYHCNVYLKREDLQRVRSFKLRGAFYAISRLSAEQLEKGVACASAGNHAQGVAYTCKRMTVPATIFMPTTTPQQKVSQVKFFGGSNVEVVLVGDTFDASATAAKEFAAEHGQTFIPPFDDPDIIAGQGSLAVEMVKDLNKAHEQADYVFAGIGGGGLISGVASYLKAKSPITKIIGVEPAGAPSMTEALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 53221 - DNA, 1056 bp, Listeria innocua Clip11262
  CDS (1)..(1056)
atgtataaaggtttactagaaaaatataaagaatatctaccagtaactgaaaaaacgccaatgatctcacttgcggaaggaaacacaccacttatcccattaccaaatttatcaaaagaacttggagtaactttatatggaaaatatgaagggttaaatccaactggttcttttaaagaccgcggaatggttatggctgtggctaaagcgaaagaagaaggtgcggaagcggttatttgtgcatcgactgggaatacttcagcagcggcggcggcatatgcaacacgtgccggattaaaagcatatattgttatcccagaaggtaaagttgctctaggaaaattagcgcaagcagtcatgtatggcgctgatattatctcgattcaaggtaattttgatgaagctttaaaatctgttcgtgaacttgctgaaacagaagcagtaacgcttgtaaactcagtaaatccttatcgtttagaaggccaaaaaacggctgcattcgaaatctgtgagcaattaggttctgctccagatgttcttgcaattccagtcggtaacgccggaaatatttctgcatactggaaaggttttaaagagtggaatgaggcaaacgcttctggacttccacggatgcatggatttgaagcagaaggagcggctgcaattgtccaagggaaaccgattgataacccggaaacaattgcaacagcgattcgtatcggaaatccagctagttgggagcttgcagaagcagctcgcgacgaatctggcggatacatccattctgtaacagatgatgaaattgttaatgcttataaaaaaatcgcagcgcaagatggagtcttcatcgagccaggttctgctgcatcattagctggagttattcaacatgtggcgaatggaacaattaaacaaggggaaaaagtcgtttgtgtctttactggaaatggcttaaaagacccagatacagcaatgagtgtacatgaaattccgatttcccatgtagatgatattgaagcaatgcgtacacatttacgttcaggagtgaaagcttaa

SEQ ID NO: 53222 - protein, 351 aa, Listeria innocua Clip11262
MYKGLLEKYKEYLPVTEKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEANASGLPRMHGFEAEGAAAIVQGKPIDNPETIATAIRIGNPASWELAEAARDESGGYIHSVTDDEIVNAYKKIAAQDGVFIEPGSAASLAGVIQHVANGTIKQGEKVVCVFTGNGLKDPDTAMSVHEIPISHVDDIEAMRTHLRSGVKA

SEQ ID NO: 53223 - DNA, 954 bp, Caenorhabditis elegans
  CDS (1)..(954)
atgactacaaaaataacaatggaagaaatgagagcagcttatcaaagaactgctccatttcttcataaaacacttgttataacaagtgaaaatattgatgaaaaagttggaaatggaacacatgttctattcaaatgtgaacatttacaaaaaactggaagtttcaaagccagaggagcactgaattctgctattttggcaaaagagaaaaatgcaaaaggaatgattgcccattcgtctggaaatcacgggcaagctctagcgtgggctgctcaaaaaatcggacttccttgtacaattgtcgttccaaaaaatgctccaatttctaaaattgaaggaatgagagaatacaatgcgaatattgttttctgtgagccaactgttactagtcgagaatctgtatgtgctgatttgactgaaaaacttgagtattattgtgtagaaccttataattgtgtttcaatgatcaacggacattcatcagttgcatttgaaatcctggaacaggttggcaatgagattgattccatttttttatctgttggaggtggtggtttagcttcatctgttgcttttctgataggcaacttgaggccagacatcgaagtataccttgtgcaaccagcacagaaagaactttcgaactttctggaaaatggaattaagtgtccggttgacacattggatacaattgctgatggagttcgtgtagcaagagttggaccgctttgtgaaccaatactcaaacagtattgtgcacaaaaagttatcagtgtgaaggaagacgagatcaaagaaggattgaaactcatatggacaagaatgaagcaacgaattgaaccaactgcagcacttgcatttgcaggagttctctaccacaaaccggctcacatcaaacgtccactagtcatcctatgcggaggaaatgttgatactaattatgtgatcaattaa

SEQ ID NO: 53224 - protein, 317 aa, Caenorhabditis elegans
MTTKITMEEMRAAYQRTAPFLHKTLVITSENIDEKVGNGTHVLFKCEHLQKTGSFKARGALNSAILAKEKNAKGMIAHSSGNHGQALAWAAQKIGLPCTIVVPKNAPISKIEGMREYNANIVFCEPTVTSRESVCADLTEKLEYYCVEPYNCVSMINGHSSVAFEILEQVGNEIDSIFLSVGGGGLASSVAFLIGNLRPDIEVYLVQPAQKELSNFLENGIKCPVDTLDTIADGVRVARVGPLCEPILKQYCAQKVISVKEDEIKEGLKLIWTRMKQRIEPTAALAFAGVLYHKPAHIKRPLVILCGGNVDTNYVIN

SEQ ID NO: 53225 - DNA, 1347 bp, Caenorhabditis elegans
  CDS (1)..(1347)
atgcttcaaagcacgttgcttcgaaagtcgattttctattctctagctcaccgccgccacgtggcatccgtgcctctgaaggatgtcttttgtgacccggaaaacccgaaaatcctgcaattcggcgatatttcgatggctcatcatcggattcagaatggaatcgttcgtaccgattgccggaaatccagatgtttgtcgaaattgttcgatatgaacatctatctgaagatggaggtcaatcaggacactggaagcttcaaggagcgcggagcccgatatgctctacagaatttgccggaggagaagaagaaagccggggtttacgcggcttctgctggaaatcatgcgctggcactttctcttcatgggaaacagttgggtgtagaggtgaacgtggtgatgcccaagattgctccattgatgaaaatcaatcgatgccaggacctgggagccaacattctggttcagggcgaagacatcgccgagagccgagaaatcgctcttcggatggctcacgatagcaacggaacctatatcaacggctacgatcattatgacattctcgccggcgccggcaccactggaatcgagattctggagcaaatccagatgcctgacgcgattttggtgccggttggtggtggtgggctggttgcaggtgtcgccacagctgtcaaggctttgtctccaactaccgaagtgatcggtgttgttagtgagacttgtcaggctattgtgaaatctctccaagcaggacaccctgtgtacacgccgactcgtccaacactagctgacggattagcagtacccaatgcaggagtgaatgcttttgcgtcgatgatcggaaaagtggatcgagtgattagtgtgcctgaaaacgacatcgctgtggcaattctccgcctaatcgagaatgagaaggtggtctgcgaaggcgccggagcaatcggaatcggagcaattctatcgggaaagctgaatcatttgaagggaaaaacagtcgtatcaattctctctggtggaaatatcgatagtacatcgctgggtagatgcattgagagaggtctcgcgtatgatcatcgtgtaattcgtctgtcggttatcattcctgataagcctggtggtctgtcgaaattgactggcctggtgggcgaactgagtggaaatgttcgggatttgtatttggaacgtgcattcatgagaaacgacatgtcgagtcaacgtgtcaagatggtgattgaggtgcgcggagaggagcacgaaatgcagttgaagcagaagttccaggaagtatacgacccgtcaaactgccaattcaagaacaatcgcctgccaagactttga

SEQ ID NO: 53226 - protein, 448 aa, Caenorhabditis elegans
MLQSTLLRKSIFYSLAHRRHVASVPLKDVFCDPENPKILQFGDISMAHHRIQNGIVRTDCRKSRCLSKLFDMNIYLKMEVNQDTGSFKERGARYALQNLPEEKKKAGVYAASAGNHALALSLHGKQLGVEVNVVMPKIAPLMKINRCQDLGANILVQGEDIAESREIALRMAHDSNGTYINGYDHYDILAGAGTTGIEILEQIQMPDAILVPVGGGGLVAGVATAVKALSPTTEVIGVVSETCQAIVKSLQAGHPVYTPTRPTLADGLAVPNAGVNAFASMIGKVDRVISVPENDIAVAILRLIENEKVVCEGAGAIGIGAILSGKLNHLKGKTVVSILSGGNIDSTSLGRCIERGLAYDHRVIRLSVIIPDKPGGLSKLTGLVGELSGNVRDLYLERAFMRNDMSSQRVKMVIEVRGEEHEMQLKQKFQEVYDPSNCQFKNNRLPRL

SEQ ID NO: 53227 - DNA, 1539 bp, Caenorhabditis elegans
  CDS (1)..(1539)
atggttgctccatctcgaaagaagtcgattattcatcatcatgatcactctcatgaatcaacacctcaaaaaactcaccatcatcgagtgaagcaggctgaacgtaaacggacagcaagcatcagtaaagaagatggaatggaatataacaaaagagttcgaaagcttcataaggcattcttaacccatggagccgagtccccacatgttgatgataaacagacttctggaagtaacagtgatactgaagctccacttttcgatccggattgtgatccagagaacccaaagaaattgaaattttctgatatttcaagtgctgcatttaacattaaaaatggagttcaaacaacaccatgtgtgcgatctcttcaactgtcatccaagtgtgaaatggacctttatttcaaaaaagaatatctgcaagtgacaggatcattcaaagaacgaggagcaagatacgctctttcaaaaatggctgagcaattcaaaaaagcaggagtgatcgctgcgagcgcaggaaatcatgctctagctctcagttatcatggacaacaaatggggattccagtgacagtggtcatgcctgttattgctccacttatgaaaattcaattctgcagaagcttgggagcaacagttattctcaagggagagagtattgcagtggccaaggactttgcacttcgtcacgctaaagagaatcacttaaagtacattaatggttatgatgcaattgatattcttgctggacaaggaacaattggacttgaaattcttgatcaagttccagatgttgatacaattcttgtaccagttggaggtggtggattaattgctggaatcgcaacagctgttaagacattgaagccggatgttcatatttatgtaagctcatttctcataattgcaaattttaaagtaaccggaattgaatcagaaacctgcccatcgttcactgaagcatatgaagctggccatataataacttcccaggccaaagcgtcacttgctgatggtctcgccgttcccacagtcggcggaaattctttggagacagcaaaaggcttggttgataaggttatcacagtgaaagaagaaagcattgcgctgagtattttaagacttttggaagttgaaaaggctgttgttgaaggaggaggagctgttggattagcagctattttggaaggaaaagtaccagaattgaaaggaaagaaagttgtttcaattctttccggtggaaatattgatacaacagtacttggaagatcaattgaaagaggattagctgtagatggaagacttgttcgtttagaagttgtcgtatcagatagaccaggaggtattgctgaactaacaactacaattgctcatcttggagcatcaatcaaagatattttccacgaaagagcatggatctcaacggatgtattccacgttaaagttaaggttgtggcagaaactcgtggaaaagagcacgtggaggagattgagactgcattgaagaaaatttatgataatgttatacttcattga

SEQ ID NO: 53228 - protein, 512 aa, Caenorhabditis elegans
MVAPSRKKSIIHHHDHSHESTPQKTHHHRVKQAERKRTASISKEDGMEYNKRVRKLHKAFLTHGAESPHVDDKQTSGSNSDTEAPLFDPDCDPENPKKLKFSDISSAAFNIKNGVQTTPCVRSLQLSSKCEMDLYFKKEYLQVTGSFKERGARYALSKMAEQFKKAGVIAASAGNHALALSYHGQQMGIPVTVVMPVIAPLMKIQFCRSLGATVILKGESIAVAKDFALRHAKENHLKYINGYDAIDILAGQGTIGLEILDQVPDVDTILVPVGGGGLIAGIATAVKTLKPDVHIYVSSFLIIANFKVTGIESETCPSFTEAYEAGHIITSQAKASLADGLAVPTVGGNSLETAKGLVDKVITVKEESIALSILRLLEVEKAVVEGGGAVGLAAILEGKVPELKGKKVVSILSGGNIDTTVLGRSIERGLAVDGRLVRLEVVVSDRPGGIAELTTTIAHLGASIKDIFHERAWISTDVFHVKVKVVAETRGKEHVEEIETALKKIYDNVILH

SEQ ID NO: 53229 - DNA, 1005 bp, Ralstonia solanacearum GMI1000
  CDS (1)..(1005)
atgccgtcgatcgccaatgccgcttcgctcaatcgtgccgctgaactgcgccgtctgcgcgcggctgccgccgttgtcaatgccgtgatcccgccgacgccgcagtactgctggccgctgttgtcgcaggcgctgggggctgccgtgtgggtcaagcacgagaaccatacggaagtgggcgccttcaaggtgcgcggcgggctgaactatctgcacgccttgcgtcgtcgcgatccggaactgcgcggcgtgatcgcggcgacacgcggcaaccatgggcagtcgatcgccctggcggcgcgcaagcaaggcatgtcggccaccatcgtggtgccccacggcaacagcgtggaaaagaacgccgccatgcgcgcgctcggcgccgaactggtcgaagccggcgaagacttccaggcgagccgcgaagccgcggcaaggcaggccgccgagcgcggcctgcacctggtgccggccttccacgaagacctggtggccggggtggccagctattggctggagtttttcgaggaggccgcgccgctggacgtggtctacgtgccgatcggcatgggctcgggcatctgcgcggcggcggcggcgcgcgatgcgttccggctgtcgacgcgcatcatcggcgtggtgtcggcgcatgcgcgatgctatgactactcgttcaattgcggcgcgccgatttccgcgccggtatcgacgcaactggccgacggcctggcatgccggacgccggatgcgacggcgctggaggtgatccgcgcgggcgtcgacgaaatcgtcacggtgacggacgacgaagtcgccgaggccatccgcctgtacttctccaccacgcacaacattgcggagggtgccgccgccgcggccctggcggcggcctggcagcagcgcgaccagttggccggcctgcgcgtcggcctgccgctgaccggcggcaacatcgaccgcgccacgctggcgcgggtgctggccggtcagccgatcggcgcttaa

SEQ ID NO: 53230 - protein, 334 aa, Ralstonia solanacearum GMI1000
MPSIANAASLNRAAELRRLRAAAAVVNAVIPPTPQYCWPLLSQALGAAVWVKHENHTEVGAFKVRGGLNYLHALRRRDPELRGVIAATRGNHGQSIALAARKQGMSATIVVPHGNSVEKNAAMRALGAELVEAGEDFQASREAAARQAAERGLHLVPAFHEDLVAGVASYWLEFFEEAAPLDVVYVPIGMGSGICAAAAARDAFRLSTRIIGVVSAHARCYDYSFNCGAPISAPVSTQLADGLACRTPDATALEVIRAGVDEIVTVTDDEVAEAIRLYFSTTHNIAEGAAAAALAAAWQQRDQLAGLRVGLPLTGGNIDRATLARVLAGQPIGA

SEQ ID NO: 53231 - DNA, 972 bp, Ralstonia solanacearum GMI1000
  CDS (1)..(972)
atgaccacgctgcccatcacctacgacgatgtcgtcgccgcccacgcccgcctgcagggccaggtccaccggacgcccgtcctcacgtcgaccacggcgaatgcgctgaccggcgccgagctgttcttcaagtgcgagaacttccagcgcatgggcgccttcaagttccgcggcgcgtacaacgcgctgtcgcagttcacacccgagcagcgcaaggccggcgtcatcaccttctcgtcgggcaatcatgcgcaggcgatcgcgctgtcggcgcggctgctgggcatgcgcgcggtgatcgtgatgcccaaggacgcgccgacgatcaaggtcgaggccacgcgcggctacggcggcgaggtggtcttctacgaccgctataccgaagaccgcgaagccatcggccgccggctggccgagcagcacggcctgacactgatcccgccctacgatcatccgcacgtgatggccgggcagggcacggccgccaaggaactgatcgaagagaccggaccgctcgacctgctgctcgtctgcctgggcggcggcggtctgctgtcgggctgcgccacggcggcgcgcgcgctgagcccggcctgccggatcatcggcgtggagcccgaggccggcaacgacggccagcagagcctgcgcaagggcgagatcgtccacatcgacacgcccgccaccatcgccgacggggcgcagacgcagcacctgggccactacacttttgcggtgatccgtgcgctggtcgacgacatcgcgacggtgagcgatgccgatctggtcgacaccatgcgcttcttcgccggccgcatgaagatcgtggtggagccgaccggctgcctggccgcggcggccgccctgcggcagcgggtggaggtgcgcggcaagcgcgtcggcgtgatcatttcgggcggcaatgtggacctgcagcactttgcccggctcgtgcaggcggacgcatga

SEQ ID NO: 53232 - protein, 323 aa, Ralstonia solanacearum GMI1000
MTTLPITYDDVVAAHARLQGQVHRTPVLTSTTANALTGAELFFKCENFQRMGAFKFRGAYNALSQFTPEQRKAGVITFSSGNHAQAIALSARLLGMRAVIVMPKDAPTIKVEATRGYGGEVVFYDRYTEDREAIGRRLAEQHGLTLIPPYDHPHVMAGQGTAAKELIEETGPLDLLLVCLGGGGLLSGCATAARALSPACRIIGVEPEAGNDGQQSLRKGEIVHIDTPATIADGAQTQHLGHYTFAVIRALVDDIATVSDADLVDTMRFFAGRMKIVVEPTGCLAAAAALRQRVEVRGKRVGVIISGGNVDLQHFARLVQADA

SEQ ID NO: 53233 - DNA, 975 bp, Agrobacterium tumefaciens str. C58
  CDS (1)..(975)
atgacagatatttcgatgatcgaggcggcgcgtgagcgcatcggcaaccatgcggtgcgaacaccgctgctcacctcgccttttctggacgagatcgccgggcgaaagctgttcgttaaggcggaatgcctgcaaaggacgggatccttcaagtttcgcggcggctggtcggcggtatccggcctgccggcggatgtgcgcgccaagggtgtgatcgctttttcctccggcaaccatgcgcagggcgtggcgctcgcggcccgcctgcatggcattcccgccgtcatcatcatgccttcggatgcgccgaagatcaaaatcgacaatacccgcgcctatggcgccgaggtggtgctttacgaccgggcgaatgaagaccgtgacgccattggcaaccggttgtcgagcgagcgcggtttgaccctgatcaggccttacgatgaaccgctggtgattgcggggcaggggaccgctgggctggaaatcgctgagcaaggcgccgaactcggtatcggtgctgccgaggttctggtgccttgcggtggcggcggcctcacctccggcatctctcttgcactcgatgcgaaagcgcgaaattataaggtcaggacggcagaaccggagcgtttcgatgacgtggcgcgctcccttgcggcgggcaagatcgagcggaatgcgacgacatcgggttcgatctgtgatgcaatcgtcacgccgcagcctggcaatatcacctttcccatcatggcagggctttgcgggaaaggtatcgccgtcagcgaggaggaagcgctgcgggccatggttctcgccttcaaccggctgaaggtcgttatcgagccgggtggtgctgttgcgcttgccgcagcgctttttcatggcaaggaactggaaagcgaaaccgtgattgcggttgcctccggcggcaatgtcgatcccgggatcatggccgacgctctgtcacgcttcggttga

SEQ ID NO: 53234 - protein, 324 aa, Agrobacterium tumefaciens str. C58
MTDISMIEAARERIGNHAVRTPLLTSPFLDEIAGRKLFVKAECLQRTGSFKFRGGWSAVSGLPADVRAKGVIAFSSGNHAQGVALAARLHGIPAVIIMPSDAPKIKIDNTRAYGAEVVLYDRANEDRDAIGNRLSSERGLTLIRPYDEPLVIAGQGTAGLEIAEQGAELGIGAAEVLVPCGGGGLTSGISLALDAKARNYKVRTAEPERFDDVARSLAAGKIERNATTSGSICDAIVTPQPGNITFPIMAGLCGKGIAVSEEEALRAMVLAFNRLKVVIEPGGAVALAAALFHGKELESETVIAVASGGNVDPGIMADALSRFG

SEQ ID NO: 53235 - DNA, 1011 bp, Agrobacterium tumefaciens str. C58
  CDS (1)..(1011)
atgaagagcgaaaacctgtccatatccgccgataaaaaccagcttccggtctcgctggccgcgatagagcgggcggcaacgcggctttcgggacaggtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 53236 - protein, 336 aa, Agrobacterium tumefaciens str. C58
MKSENLSISADKNQLPVSLAAIERAATRLSGQVERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 53237 - DNA, 1212 bp, Pyrobaculum aerophilum str. IM2
  CDS (1)..(1212)
atgatcctcctggaggaggctgcgtcggtaataagagaaaaacagcgggaatcaaaaatccataggacgccgactttgaggtcagagtctctgactagaataacaggcggggaggtgttcctcaagttggaatcgcttcaaaagacaggcagtttcaagatcaggggggcatattttgccatgtataaatacataaaggagggttatagggagtttataaccgcctcgtcgggtaatcacgcgcagggagttgcctatgcggcacaattacacggagtaaaggccactgttgtaatgcctgaaactacgccttggctcaaggttaaaaagacccaggattacggcgccaacgttatattatacggcgagagttattacgaggcggagaaaaaagccatggaattagtacgcggaggagttaagttcctccacgcgtataacgactggtacgtcatctcgggacaagccactttaggccttgagattgtagaggatgtcggtgacgtagacgtagtagttgtgccaataggcggcggggggcttatctccggcgttgcatatgccgtgaagaagagaaggcctggggcaaaggtaataggggttcaagccagcggagcgccggcggtgtacttgtctttaaaagaggggcggcccattgtgattgagaaagtagacactattgccgacggtatcgctattaaaagccccggcgacattacgttgaaattaatacaagagtacgtagacgacgtggtgttagtagacgacaatgaaattgtagatgccatttacctcctccttgaaaggacaagagtagtggctgagggcgctggggctgttgcagtggccgcgttaatgtcggggaaaattaacgtaagtggtaaaaaagtagtggcggttgtctccggcggtaatatagacgcgcctatttttatgcgcgttctcatgaaggcaatggcgagacagaggcgggtgattaaattagtcggcgaagtgcctgacaagcctggaactcttgcgaaggcctcttctttcctggcctcacacaatgtgaatatcctagaggttttccacgagcgctacgacccggaacaacggcctaattatgtaagactcatatttgtagtggaaattccaggcacgttagacgtatcaaagctcttagacgaactggaaaaaaacggcttctttttcagagtcgcctcgcagtaa

SEQ ID NO: 53238 - protein, 403 aa, Pyrobaculum aerophilum str. IM2
MILLEEAASVIREKQRESKIHRTPTLRSESLTRITGGEVFLKLESLQKTGSFKIRGAYFAMYKYIKEGYREFITASSGNHAQGVAYAAQLHGVKATVVMPETTPWLKVKKTQDYGANVILYGESYYEAEKKAMELVRGGVKFLHAYNDWYVISGQATLGLEIVEDVGDVDVVVVPIGGGGLISGVAYAVKKRRPGAKVIGVQASGAPAVYLSLKEGRPIVIEKVDTIADGIAIKSPGDITLKLIQEYVDDVVLVDDNEIVDAIYLLLERTRVVAEGAGAVAVAALMSGKINVSGKKVVAVVSGGNIDAPIFMRVLMKAMARQRRVIKLVGEVPDKPGTLAKASSFLASHNVNILEVFHERYDPEQRPNYVRLIFVVEIPGTLDVSKLLDELEKNGFFFRVASQ

SEQ ID NO: 53239 - DNA, 1047 bp, Pyrobaculum aerophilum str. IM2
  CDS (1)..(1047)
ttgcttgaagtggaagttcgtaataaagtctgggccccaaagggcaacgggatctggcgttattcaacaatgttgcctcttaaaagcgggatatccctgggagaggggaggacccccctggtgaaatccaatctggcggagaatctgtatgtaaaatttgaaggggctaacccaactggaagttttaaagaccggggaatggccctcggcgtgactgtggccaaggagagcggcgccaataaagtcgtcgtggcgtctactggcaacacggcggcctctgcggcggcttacgccgctagggctgggcttaggtgttatgtagttttgcccaagggcaatgtggccagggggaagttaatacaagcggcgttacacggcgctgagcttgttatgataaacggcctatttgataaggcgcttgactacgtggttaactacgggacaaaatacgcatatcctctaaacagctttaacccgtggaggctggaggggcagaagaccgtggcctttgagatatacgaagagctggggtgtccggactacgtaatagtgccagtgggaaacgcggggaatatctcggctatatggaaggggtttagggaactcgccgagctggggctttgtaataaactgccgaaaatggtgggcgtccaggcggagggcgcggcgccgcttgtcgaggcctgggcccgcggcgtggaggagccgctttttgtagacgagcctaacacagtggcgacggcaattaaaatcggcaggcctataaactggcccaaggcgctgagggccgtgaaggagtcaggaggctttttcgtaaaagtgtctgacggggagatattaaaggcgcagaggctcttggcaactcgcgacggcataggggcggagcccgcgggcgccgcgtcaatagccgcggcgattaaattaaatatagggggagtagccgtggccgtggtaaccggccatgcgctgaaagaccccgacgttatagaaataacagcgaaggaggtgagaaatgcagacgagctgatagagcttttggaaaaatga

SEQ ID NO: 53240 - protein, 348 aa, Pyrobaculum aerophilum str. IM2
MLEVEVRNKVWAPKGNGIWRYSTMLPLKSGISLGEGRTPLVKSNLAENLYVKFEGANPTGSFKDRGMALGVTVAKESGANKVVVASTGNTAASAAAYAARAGLRCYVVLPKGNVARGKLIQAALHGAELVMINGLFDKALDYVVNYGTKYAYPLNSFNPWRLEGQKTVAFEIYEELGCPDYVIVPVGNAGNISAIWKGFRELAELGLCNKLPKMVGVQAEGAAPLVEAWARGVEEPLFVDEPNTVATAIKIGRPINWPKALRAVKESGGFFVKVSDGEILKAQRLLATRDGIGAEPAGAASIAAAIKLNIGGVAVAVVTGHALKDPDVIEITAKEVRNADELIELLEK

SEQ ID NO: 53241 - DNA, 1209 bp, Clostridium perfringens str. 13
  CDS (1)..(1209)
gtgattattttgtatttagaaaaaattattaaagcaaaaaaaaatatagaagatgtagttataaaaacacctttaatatatagcgaggtcttttcaaggaaatctggaaaccaagtgtatatgaaatgtgaaaatttacaattaacaggtgcttacaaaataagaggtgctttaaataaaataagatctttatcagatgaagaaaaatcaaaaggtgttgtttgttcttctgccggaaatcatgctcaaggcgtagcttttgcagcatcacaagctaatgttaaatcaactatagtaatgccaaagactactcctctactaaaaatccaatcaacaaaggatttaggagggaatgttgttttatcaggttatgtttatgatgatgcttttaatgaggctaaaagaattgaacaagaacaaggagccttatttatacatccatttaatgatattgatgtaatttgtggacaaggtacagtagccttagaaatatttgaagatttaaatgatgtagatattattctctgccctataggtggcggtggcttaataagtggagttaccctagctgctaaggctttaaaccctaatgttaaagtaattggagtacaggctgaaggtgcaaatgcaatggttaaaagttttaaggcaggagaaataattgctttagacgctgttgatactattgctgatggaattgcagtaaaaagacctggtgatttaacatttaaatttataaaagaatatgttgatgatataataactgtatcagatcatgaaattgttgaagcattctttacattaagtgaaaaacataaacttttagcagaagcttcaggagcagtctcattagcagcttctgctaaattaaattgtaaagataaaaatatagtatcagtaataagtggtggtaatatagatatggttactataacttcattaataaacagcgcattagtagctaaaggaagactttttggatttagtttagaagttcctcataaaccaggacaaatattgaagattgctaaagttcttgctgatactaatgctaatatagtaaaacttgaacatgatcattttaaagcaagggatgctcttaaaaatatggttatagaagtaactttagagacaaatggacactctcacatagaggaaataaaaaaagctttaacagatcaaaattatgtaataaaacaaatttattaa

SEQ ID NO: 53242 - protein, 402 aa, Clostridium perfringens str. 13
MIILYLEKIIKAKKNIEDVVIKTPLIYSEVFSRKSGNQVYMKCENLQLTGAYKIRGALNKIRSLSDEEKSKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLNDVDIILCPIGGGGLISGVTLAAKALNPNVKVIGVQAEGANAMVKSFKAGEIIALDAVDTIADGIAVKRPGDLTFKFIKEYVDDIITVSDHEIVEAFFTLSEKHKLLAEASGAVSLAASAKLNCKDKNIVSVISGGNIDMVTITSLINSALVAKGRLFGFSLEVPHKPGQILKIAKVLADTNANIVKLEHDHFKARDALKNMVIEVTLETNGHSHIEEIKKALTDQNYVIKQIY

SEQ ID NO: 53243 - DNA, 1185 bp, Pyrococcus furiosus DSM 3638
  CDS (1)..(1185)
atggtgctgaaatgtgtagtctgtgggagagagtatcctgaagacgaagttaggtataggtgtgagtgtggaggtctattagaggttgttatcgatctagataaagttgatacttccatttttaacggtaaggagataaagctgtggaaatatgaaagctggctacccgtaaagaagagagttagtctggaagaaggtggaactcccctatataggttattaaatcttgaaagtgatcttggagtaaaagagctctatgcaaaaaacgagggtgcgaatccaacaggttcatttaaagaccgcggaatgacggttggagtctcgaaggctcttgagctaggaatggataaagtcatatgtgcatctacgggaaatacttcagcatcacttgctgcttatgctgcaaaagcaggaataaaagcatatgtcctaatcccaagtgggaagatagcgttaggaaagcttgctcaagcaataatctatggggctagggttgtaccaatcaaggggaactttgacgatgctctaagagtagtcgtggagacaagcaaagaacttgggatatacatgttaaattcaataaacccattcaggctcgaaggacaaaagacaatagcgtatgagatatatgaccaacttggaaaagttccagacaacgttattctcccagttggaaatgcaggaaacatttctgcaatatggaaggggtttaaggagatgtatgaggctggcgtaatagatgaacttcccaggatgataggaattcaagcagaaggagcatccccattagcgaaggcttggaaagagaaaagaaaattccaacccgaagagagtccagaaaccattgcatcggccataagaataggaaaccccgcaaattggataaaggcatggagggctgttgaagaatctgggggactatttgagagcgtaagtgatgaggaaatactaagagctcagaaacttctagcgtctagggaaggactatttgttgaacctgcttctgcagcatctttagctggcttaattaagctccttgaaagtggtgaaataagcaggaatgagagttacgttttaatcacaactggacatgggctaaaagatccaaatatcgtcataaagaacttccaagttccagaacctatagacccaactttagaagcttttaaggaggtgattgaatga

SEQ ID NO: 53244 - protein, 394 aa, Pyrococcus furiosus DSM 3638
MVLKCVVCGREYPEDEVRYRCECGGLLEVVIDLDKVDTSIFNGKEIKLWKYESWLPVKKRVSLEEGGTPLYRLLNLESDLGVKELYAKNEGANPTGSFKDRGMTVGVSKALELGMDKVICASTGNTSASLAAYAAKAGIKAYVLIPSGKIALGKLAQAIIYGARVVPIKGNFDDALRVVVETSKELGIYMLNSINPFRLEGQKTIAYEIYDQLGKVPDNVILPVGNAGNISAIWKGFKEMYEAGVIDELPRMIGIQAEGASPLAKAWKEKRKFQPEESPETIASAIRIGNPANWIKAWRAVEESGGLFESVSDEEILRAQKLLASREGLFVEPASAASLAGLIKLLESGEISRNESYVLITTGHGLKDPNIVIKNFQVPEPIDPTLEAFKEVIE

SEQ ID NO: 53245 - DNA, 1152 bp, Pyrococcus furiosus DSM 3638
  CDS (1)..(1152)
atgcttaggtgcacttcatgtggaagaatgtattcatttgacagcccatatcaaaggtgcgaatgtggagagcctttggaacttgagcttttcaatgggatgtataaaaagaaaggaaagagggtatgggaaaggttttctgagttctttcctctcgaactagatccagagttaagcttgggagaaggagatactccattaacaagagcaaagaagctttcgaaagaacttggaattgagctatatttaaaaaacgagactataaatcccacgtggagttttaaagataggggaacctacctgggaattcatagggcgatacaacttgactttagaaggattgggacggtatcaacgggaaatatggcggcaagtgttgccgcatatggagctcattctgagctcgaagtttacattttggtttcctcaacaataccagaggaaaagattaaggccttagctccctatggagcaaagattgtaaaggttcatggggactatggggaactctattatagggccctagaaatagggcagaaaaagggaatatatttcataaactcggatgatccctttagagttgaagggtataagagcataagcttcgagataagtgaggagataactccagactacgtaatagtccctacgtcatctggaggcctatttagaggtattgtgaaggggtttctggaagccaagaatagtggactaatagaaaagctccctagattttttgtggtacaggctgagggctgttctccaatatgtaaagcattcaacgctggaaaagaaaagatagagagatttgaaaatccccatacaatcgcccatgcaatagaaaatccatatcctccaagtggaaatgcagtcctaagattgctgaagaaattgaatggcatttgtaccacggttacagatgaagagattctagaggcccagaaaatcctgggaagagaaggaatttttgttcaactcgcatctgcaacaggaatagccgcagtaaaaaagctaaggcgaaaaggaattatcaaagaaggagcaattgtagttagcattcttacgggctctggattaaagacattgaggtacattaagcaaccaaaagtcgaggaatgctctttacaaagattagaagagtgcattggataa

SEQ ID NO: 53246 - protein, 383 aa, Pyrococcus furiosus DSM 3638
MLRCTSCGRMYSFDSPYQRCECGEPLELELFNGMYKKKGKRVWERFSEFFPLELDPELSLGEGDTPLTRAKKLSKELGIELYLKNETINPTWSFKDRGTYLGIHRAIQLDFRRIGTVSTGNMAASVAAYGAHSELEVYILVSSTIPEEKIKALAPYGAKIVKVHGDYGELYYRALEIGQKKGIYFINSDDPFRVEGYKSISFEISEEITPDYVIVPTSSGGLFRGIVKGFLEAKNSGLIEKLPRFFVVQAEGCSPICKAFNAGKEKIERFENPHTIAHAIENPYPPSGNAVLRLLKKLNGICTTVTDEEILEAQKILGREGIFVQLASATGIAAVKKLRRKGIIKEGAIVVSILTGSGLKTLRYIKQPKVEECSLQRLEECIG

SEQ ID NO: 53247 - DNA, 1338 bp, Pyrococcus furiosus DSM 3638
  CDS (1)..(1338)
atgaaatgtccgaaatgcgggagagagtggactacttttattccccccttttgtacttgtggggctgaacttgaaattagctatgactactctaaagtagatgttagaaagtggaagaacagactttcttctgtatggaaatatcgagagcttcttccccctgtaaagagaatgattacactgcgagagggtggaactccgttaataaaggcaagaatttcagaaaaaattgggatagatgtgtatattaaggatgaaactagaaatcccacaggttcatttagggatagactagctacagttgccatttcttatggtttaccttatgcatccaacggatttattgtagctagtgatggaaatgctgcagtttcagttgcagcttatgctgcaagagctgaaaaggaagcgtttgtagtaatcccaaggaaagttgacagggggaagttaatacagatgatggcctttggggccaaaatcattagatttggggaaagtgttgacgaggcaatagagtatgcaagggaaatagcaaagctcaatggcctttataacgtcacgccagaagataatattattggacttgaaggtcaaaaaacaatagcctttgaactttgggaagagctaaatcccacccacgtagtagttccaactggtagtggaagttatatttattcaatttacaagggatttaaggagttaatggaaatcggggttcttgaggaaattcctaatttgatagccgttcaaactgataaatgcaatcctatagcatctgaagttctgggaacaaagaagaaatgcacagaaacaaaagctctcggcttgtacgttaaaaatccagttatgaaaaacaaggcagttaaagctataaaagaaagcaaaggtactgcagtaattgtaaatgaggaagaaatcatgagaggagaaaaattacttgcaagtgagggcatttatgcagaattatcctcagccgtagtcatgccggctttgctaaagcttaaagaaaatgggtttatagaaaaaggagacaaagttgtactagtagttacaggttctggtttaaaaactggagaaggtggaaaagagaaattttcaattggaccaactaaaattgagatacttaggctgttgaaagaaagagaaatgtatgcatatgagatctggagcttacttgggaaacctctaaagtaccaagcagtccatcagcacattaaggagttacttgaattgggattagttgaacaggcatatagaaagggaaagagggtatattacaagataactgaaaaaggattgagaattctacaaaacttcgaagacctagagaacatttaa

SEQ ID NO: 53248 - protein, 445 aa, Pyrococcus furiosus DSM 3638
MKCPKCGREWTTFIPPFCTCGAELEISYDYSKVDVRKWKNRLSSVWKYRELLPPVKRMITLREGGTPLIKARISEKIGIDVYIKDETRNPTGSFRDRLATVAISYGLPYASNGFIVASDGNAAVSVAAYAARAEKEAFVVIPRKVDRGKLIQMMAFGAKIIRFGESVDEAIEYAREIAKLNGLYNVTPEDNIIGLEGQKTIAFELWEELNPTHVVVPTGSGSYIYSIYKGFKELMEIGVLEEIPNLIAVQTDKCNPIASEVLGTKKKCTETKALGLYVKNPVMKNKAVKAIKESKGTAVIVNEEEIMRGEKLLASEGIYAELSSAVVMPALLKLKENGFIEKGDKVVLVVTGSGLKTGEGGKEKFSIGPTKIEILRLLKEREMYAYEIWSLLGKPLKYQAVHQHIKELLELGLVEQAYRKGKRVYYKITEKGLRILQNFEDLENI

SEQ ID NO: 53249 - DNA, 1803 bp, Schizosaccharomyces pombe
  CDS (1)..(1803)
atgactggaacgagtttttacacttcggtactcagattgggacgattggctcaacagggcctaaaattccaatctgtaaaacatattcgtccatcatgtttttcatcttttggattacaagctaaacgttggaactctactcaacaaaatgatagttctattgattgtttagaacctaagctgcaaggaattattgaagacaatatttctccctcgacggcacaaaaagaaatatcagacatcaagtttaatattccaaaggaaatgcttcttccagatggaactcctgattatttacgtttgactctcacgtctaacgtgtatgaagttatcaaggagactcctcttacaaagggtgttgtcatttctgaaagtaccggtgttccagtctacttaaaacgtgaagatctcactcctgtgttttcatttaaaattcgaggggctcataataaaatggcttctcttgataagcagtcattgaaaaatggagtcattgcttgttccgctggcaatcacgcccagggtgttgcttactccgctaggactcttggtgtaaaagctaccattgttatgcctcagaatactcctgaaatcaaatggaggaacgttaagagattgggcgctaatgttctcttacatggagctaattttgacattgctaaagcagaatgtgcacgtttggctaaagagcaaaatctcgaagttattcatccctttgacgatccttatgtaattgctggacaaggaaccattggacttgaaattcttcatcaaatagatcttcgcaagctggatgctatttactgcgctgttggcggtggtggtttaattgctggaatagctacttacgttaagcgtattgctccccatgttaaggtcattggtgtcgagacatttgacgctgatgctttaaaaaagtctttgaaggacaaaaagcgggtaacccttaaggaagttggcttattcgctgatggaactgctgtgaaacttgttggagaggaaaccttccgtcttgtctccaagaatattgacgatgtagttcttgttgacaaagatgagatttgtgcagccattaaggatgtttttttggatacccgttcagtggtcgaaccatcaggagctatggctgttgctggtatgaagcgttatgtcgctaaacacaagcctaaaaatcccaatgctgctcaggtttgcatcttaagtggtgccaatatggactttgatcgccttagatttattgctgagcgtgctgatcttggtttgaacaaggaagtattcttgagtgtcactattcctgagcgccctggttcatttgaagccctacacaacattattactccacgtagtattaccgaattttcttatcgttacgataatgatgactatgctaacatttacacatcgtttgtggtaaaggaccgtgcaactgaattgcctttgattcttcaacaaatctctgagcaaaatatggttgcagaagatatcagcgataatgaacttgctaaaactcatgcccgttatcttattggaggaaaatcatctgtttcaaaagagcgtttgtaccgattggatttccctgaacgccctggagctttatgtaagtttttgaggagtataaaggaagtttgcagcatttcccttttccattatcgtaattgtggtggagatatagctagtgtgcttgctggccttagagtttttgatggccaagtggaaaaacttcattcagttttggaagagattggatacaactgggtggacgaaacaaataatcccgtttacttgcgctatcttcgtaaatag

SEQ ID NO: 53250 - protein, 600 aa, Schizosaccharomyces pombe
MTGTSFYTSVLRLGRLAQQGLKFQSVKHIRPSCFSSFGLQAKRWNSTQQNDSSIDCLEPKLQGIIEDNISPSTAQKEISDIKFNIPKEMLLPDGTPDYLRLTLTSNVYEVIKETPLTKGVVISESTGVPVYLKREDLTPVFSFKIRGAHNKMASLDKQSLKNGVIACSAGNHAQGVAYSARTLGVKATIVMPQNTPEIKWRNVKRLGANVLLHGANFDIAKAECARLAKEQNLEVIHPFDDPYVIAGQGTIGLEILHQIDLRKLDAIYCAVGGGGLIAGIATYVKRIAPHVKVIGVETFDADALKKSLKDKKRVTLKEVGLFADGTAVKLVGEETFRLVSKNIDDVVLVDKDEICAAIKDVFLDTRSVVEPSGAMAVAGMKRYVAKHKPKNPNAAQVCILSGANMDFDRLRFIAERADLGLNKEVFLSVTIPERPGSFEALHNIITPRSITEFSYRYDNDDYANIYTSFVVKDRATELPLILQQISEQNMVAEDISDNELAKTHARYLIGGKSSVSKERLYRLDFPERPGALCKFLRSIKEVCSISLFHYRNCGGDIASVLAGLRVFDGQVEKLHSVLEEIGYNWVDETNNPVYLRYLRK

SEQ ID NO: 53251 - DNA, 933 bp, Corynebacterium glutamicum ATCC 13032
  CDS (1)..(933)
atgctcaccctcaacgatgtcatcaccgcccaacaacgaaccgcccctcatgttcgacgaacgccacttttcgaagcagaccccatcgacggcacacaaatctggatcaaagcagagttcctccaaaagtgcggcgtgttcaaaacgcgtggagcattcaaccgccagctcgcagcttcggaaaacggactactcgacccaacggttggcatcgtcgcggcatcaggcggaaacgcaggactcgcaaatgcttttgccgcagcatccttaagcgttcccgccacggtattggtgcccgaaactgccccacaagtaaaagttgatcgcctcaagcaatacggtgcaaccgtgcaacaaatcggatctgaatatgcggaagcatttgaggcagctcaaacctttgagtcggaaactggtgctctgttttgccacgcctacgaccagcccgacatcgcagctggagcaggcgtcattgggctagaaattgtcgaagatcttcccgacgttgacaccatcgtggttgctgtcggtggcggtggactctatgcaggaatcgcagccgtcgtagcagcccacgacatcaaagtggtggccgttgaaccctccaaaattccaaccctgcacaactcactcattgccggccaaccagtcgatgtgaacgtttctggtatcgcggcagattctttgggggctcgccaaattggacgagaagcctttgacatcgcaactgcccatcccccaataggcgtcctagtggacgatgaagcaatcatcgcagctcgacgccacctctgggacaactaccgcatccctgccgagcatggcgctgccgcagcactcgcctctcttaccagtggagcatacaaacctgcagcagatgaaaaagtggcagtcattgtgtgcggagcgaacactgacctcacaacactgtga

SEQ ID NO: 53252 - protein, 310 aa, Corynebacterium glutamicum ATCC 13032
MLTLNDVITAQQRTAPHVRRTPLFEADPIDGTQIWIKAEFLQKCGVFKTRGAFNRQLAASENGLLDPTVGIVAASGGNAGLANAFAAASLSVPATVLVPETAPQVKVDRLKQYGATVQQIGSEYAEAFEAAQTFESETGALFCHAYDQPDIAAGAGVIGLEIVEDLPDVDTIVVAVGGGGLYAGIAAVVAAHDIKVVAVEPSKIPTLHNSLIAGQPVDVNVSGIAADSLGARQIGREAFDIATAHPPIGVLVDDEAIIAARRHLWDNYRIPAEHGAAAALASLTSGAYKPAADEKVAVIVCGANTDLTTL

SEQ ID NO: 53253 - DNA, 1215 bp, Fusobacterium nucleatum subsp. nucleatum ATCC 25586
  CDS (1)..(1215)
atggctaagttagaagcttttataaaagcaaaagaaaaattatcaaaagtacttttagaaacacagttaatttacagtcctatattctcaaaagaatctggaaacaaagtattcatcaagcctgagaacttacaaaaaacaggttcatttaagataagaggagcatacaataaaatttctaatctaacagatgctgaaaagaaaagaggtgtaattgcctcatctgctggaaatcacgctcaaggtgttgcttatggtgctaaggaatctggtataaaggcagttattgtaatgcctaaatctactcctcttataaaagttgaatctacaaaacaatatggagcagaagttattttacatggtgatgtttatgatgatgcctttaaaaaagcaaaagaattagaagaaaaagaaggttatgtgtttgtccatccttttaatgatgaagatgttttagatgggcaaggaacaatagccctagaaattttagaagaacttcctgaaactgatattatacttgttcctattggtggtggtggtttaatttcaggtatagcttgtgctgcaaaaatattaaaacctgaaataaaaattattggtgttgaaccagaaggagctgcttctgcttatgaagctataaaggaaaataaagttgttgaacttaaagaagctaatacaatagctgatggaaccgctgtaaagaaaattggagacctaaactttgaatatattaaaaaatatgttgatgaaattataacagtatctgattatgaattgatggaagcatttttattattagtagaaaaacataaaattattgcagaaaattctggtatattatcaatagctgctacaaaaaaacttaaggaaaaaaataaaaaagttgtatctgtcataagtggtggtaatatagatgtcttaatgatttcatctatgattaataaaggacttatcagaagagatagaatctttaattttacagttagcattcctgataaaccaggtgaattagcaaaagttgtagatttaatcgctgaacagggggctaatgtgataaaacttgaacataatcaatttaaaaatctatcaagatttaaggacattgaattacaaattactgttgaaactaatggaagtgaacatgtccaaaatttaactcaagcttttgaagaaaaaggttatgaaatagtaagaatcaaatctaaaataaattaa

SEQ ID NO: 53254 - protein, 404 aa, Fusobacterium nucleatum subsp. nucleatum ATCC 25586
MAKLEAFIKAKEKLSKVLLETQLIYSPIFSKESGNKVFIKPENLQKTGSFKIRGAYNKISNLTDAEKKRGVIASSAGNHAQGVAYGAKESGIKAVIVMPKSTPLIKVESTKQYGAEVILHGDVYDDAFKKAKELEEKEGYVFVHPFNDEDVLDGQGTIALEILEELPETDIILVPIGGGGLISGIACAAKILKPEIKIIGVEPEGAASAYEAIKENKVVELKEANTIADGTAVKKIGDLNFEYIKKYVDEIITVSDYELMEAFLLLVEKHKIIAENSGILSIAATKKLKEKNKKVVSVISGGNIDVLMISSMINKGLIRRDRIFNFTVSIPDKPGELAKVVDLIAEQGANVIKLEHNQFKNLSRFKDIELQITVETNGSEHVQNLTQAFEEKGYEIVRIKSKIN

SEQ ID NO: 53255 - DNA, 1212 bp, Methanopyrus kandleri AV19
  CDS (1)..(1212)
ttgcattacgtcctggagtgtgttgaatgcggttcggagttcgatgatgactcactggtacggtgccccgagtgcggaggactcctggaggtggcactgcgctacgacgaaatcgaggtgagtcggtcgacgttcgagggtcgtcgcctcggcgtatgggccttccgggagctcctaccagtgaacacggacgatcccgtcacgatgtccgagggcggtacgggcttacacccgtgtccgagactgggcgaggagctcggtgttagggagctgttcgtgaagaacgagggcgagaaccccacgggctccttcaaggatcggggaatgaccgtgggagttaccaaggccgtggagctcggtgcggaggtcgtcgcatgtgcctcgacgggcaacacatcggcctcgttggccgcctacgccgcccgcgcgggccttacgtgtgccgtcctccttccggccggtaaggtggccctaggcaaactcgctcaagccctcttccacggtgcccgcgtgattccagtgaacggcaacttcgacgacgccttggatgtcgtgaagaagctggccgatgagggcatcgtgtacattctaaactccgtgaacccgttccgcctctccggtcagcgtaccatcgcgtacgagatctgcttgcagttggactgggaggtccccgacgcggtcgtcgtgccggtcggtaacgcgggtaacatcagcgcgatctggcaggggttcctcgatctctacaggctgggaatcatcgacgagctcccgaggatgtacggagtacaggcggagggtgctcgaccgatcgtcgaggcgattcggcggggcaaggaggacatcgaaccggatcccgagcccgaaaccgtcgccaccgcgatccgcatcggtaacccagtgaacgccatcaaggctctccgtgccatccggtgttcgggcggctgggccgtagaggtctccgacgaggaaatactctcggcgcagcgtgagctcgcaacgcgggaggggatcttcgtggagccggcgagtgccgcctcgatagcgggactcaggaagttcgtggaggagggtgagatcgacgccgacgagcgggtggtctgcgtgaccaccggacacggtttgaaggatccggagacggtcatggaagtgtgtgagctgcctgaacccgtggaaccggatcccgagaccatacagcgtttaatcgccgagtga

SEQ ID NO: 53256 - protein, 403 aa, Methanopyrus kandleri AV19
MHYVLECVECGSEFDDDSLVRCPECGGLLEVALRYDEIEVSRSTFEGRRLGVWAFRELLPVNTDDPVTMSEGGTGLHPCPRLGEELGVRELFVKNEGENPTGSFKDRGMTVGVTKAVELGAEVVACASTGNTSASLAAYAARAGLTCAVLLPAGKVALGKLAQALFHGARVIPVNGNFDDALDVVKKLADEGIVYILNSVNPFRLSGQRTIAYEICLQLDWEVPDAVVVPVGNAGNISAIWQGFLDLYRLGIIDELPRMYGVQAEGARPIVEAIRRGKEDIEPDPEPETVATAIRIGNPVNAIKALRAIRCSGGWAVEVSDEEILSAQRELATREGIFVEPASAASIAGLRKFVEEGEIDADERVVCVTTGHGLKDPETVMEVCELPEPVEPDPETIQRLIAE

SEQ ID NO: 53257 - DNA, 1056 bp, Thermoanaerobacter tengcongensis MB4
  CDS (1)..(1056)
atggcgtacgaaggaattataaaagcttatagagagtttttgcctcctataagagatgaaaatattgtcacgttaaaagagggcaacacacctttaattgaagcttttaacctccaaagaaaatatttgccgggtataagggtgtatctaaaatacgaagggctaaatcccacaggttcttttaaggacagggggatgacggtagcggtatctcaagcaaagcaagaagggtctaatgccgtcgtatgcgcctcaacaggcaacacttctgcttctgcagcagcctatgcagcaaaagcaggccttaaaagtgtggtattaattcctggcggtaaaattgctctggggaaactcgcacaggcaattgcttatggggcagaggttattgcggtagatggcaattttgatgacgctttaaggcttgtgagagaaatttcgcagaaattcccgattactttggtaaattctataaacccctatcgcctggaaggccaaaaaacggcagcttttgaaatatgtgatgctttgggagaagtaccagactatgtctctcttcctgtgggcaatgcaggaaatataactgcttactggatgggatttaaagaatactaccggaaggggaagataaaaaagcttcccaaaatgcttggctttcaggcggcaggagcggctcctattgtggaaggaagagtaatagaaaatcccgagacgattgccacggctataagaattggcaaccctgccagctggcagaaggcagtggctgcaagagatgagtcgggggggataattgacaaagttacggatgaggaaatactggaggcttattcaattttggcaaaaacagaggggatttttgcagagccagcctctgcagcctccatagcgggtgtgataaagaagtacaaagaaggattttttaaagaaggagattctgtggtgtgtatccttacggggaatggtttaaaagaccctgatactgctgttaaactagggggagaggtaaagagaatacagccaaatctaaaggaattggaggaagttttgtatggatag

SEQ ID NO: 53258 - protein, 351 aa, Thermoanaerobacter tengcongensis MB4
MAYEGIIKAYREFLPPIRDENIVTLKEGNTPLIEAFNLQRKYLPGIRVYLKYEGLNPTGSFKDRGMTVAVSQAKQEGSNAVVCASTGNTSASAAAYAAKAGLKSVVLIPGGKIALGKLAQAIAYGAEVIAVDGNFDDALRLVREISQKFPITLVNSINPYRLEGQKTAAFEICDALGEVPDYVSLPVGNAGNITAYWMGFKEYYRKGKIKKLPKMLGFQAAGAAPIVEGRVIENPETIATAIRIGNPASWQKAVAARDESGGIIDKVTDEEILEAYSILAKTEGIFAEPASAASIAGVIKKYKEGFFKEGDSVVCILTGNGLKDPDTAVKLGGEVKRIQPNLKELEEVLYG

SEQ ID NO: 53259 - DNA, 1230 bp, Streptomyces coelicolor A3(2)
  CDS (1)..(1230)
atgagctacagcacagcgtcctgcgtcgctcccgtcaccctcgacgacgtgcgcggagcccagaagatgctctcgggcgtggcgcgggtgacggccatggagggcagcaggcacctctcccagctggtcggctcgccggtgcacctcaagtgcgagaacctccagcggacgggctcgttcaagctgcgcggcgcctacgtgcggatcgccgggctgctccccgagcagcgggccgcgggcgtggtcgcggcgagcgcgggcaaccacgcgcagggcgtcgcgctggcctcgtcgctgctcggtgtgcgctcgacggtgttcatgccgcagggggcgccgctgcccaagatcagcgcgacccgggactacggcgccgaggtgcggctgcacggccaggtggtggacgagacgctggccgccgcgcaggagtacgcggagcggaccggcgcggtcttcatccaccccttcgaccaccccgacgtcatcgcgggccagggcacggtcgggctggagatcctggagcagtgccccgaggtgcggaccgtcgtcgtcggcatcggcgggggcggactggcggccgggatcgcggtcgcggtgaaggcgctgcggccggacgtgcggatcgtcggcgtgcaggcggagggcgcggccgcctacccgccctcgctggccgccggacgcccggtcgccgtgcagaacccggcgacgatggccgacgggatcaaggtggggcggcccggcgacgtgccgttcgggatcgtcggcgaactggtggacgaggtccgcacggtctccgaggacgcgctgtcgaccgcgctgctgctgtgtctggagcgggccaagctggtcgtggagccggccggagcgagcccggtggcggcgctgctgagcgagccggacgccttcgagggaccggtcgtcgcggtcctgtccggcggcaacgtggacccggtgctgatgcagggtgtgctgcggcacggcatggccgcgcagggccgctacctggcggtccggctgcggctgacggaccggcccggcgccctggccacgctgctcggggtgttgtcagtggtcgacgctaacgtcctcgatgtgagccacgtccgaacccatccgcggctcgggctcacggaggcggaggtcgagctgcacctggagacgaagggcccggagcactgcaccgaggtcggccgcgtgctgcgggaagcgggatacacggtcatcgcctga

SEQ ID NO: 53260 - protein, 409 aa, Streptomyces coelicolor A3(2)
MSYSTASCVAPVTLDDVRGAQKMLSGVARVTAMEGSRHLSQLVGSPVHLKCENLQRTGSFKLRGAYVRIAGLLPEQRAAGVVAASAGNHAQGVALASSLLGVRSTVFMPQGAPLPKISATRDYGAEVRLHGQVVDETLAAAQEYAERTGAVFIHPFDHPDVIAGQGTVGLEILEQCPEVRTVVVGIGGGGLAAGIAVAVKALRPDVRIVGVQAEGAAAYPPSLAAGRPVAVQNPATMADGIKVGRPGDVPFGIVGELVDEVRTVSEDALSTALLLCLERAKLVVEPAGASPVAALLSEPDAFEGPVVAVLSGGNVDPVLMQGVLRHGMAAQGRYLAVRLRLTDRPGALATLLGVLSVVDANVLDVSHVRTHPRLGLTEAEVELHLETKGPEHCTEVGRVLREAGYTVIA

SEQ ID NO: 53261 - DNA, 1218 bp, Methanosarcina mazei Go1
  CDS (1)..(1218)
atgtatcatctaaaatgtatcgagtgcggtgcagagtattcaaaagatgaagtaatctatacatgcagcaaatgcgatgggctgcttgatgttatttatgattattcctcaattaaactcgacatggaaaaattaaagaccgaatgtccttcggtctggaaatatgcagaacttctccccatagaaagagaacctgtgaccatacatgaaggcgggaccccactttacagatgcgatcgccttgccgaaaagatagggattaaagaactctatgtaaaacatgaaggaatgaacccgactggctcatttaaagatagagggatgactgttggggttacaaaagcacttgaactcggaatgagtaccgtcgcctgtgcatcaaccgggaacacgtcggcagcccttgcaatctatggggcaaaagcaggaatacctgtggttgtgcttcttccggctggaaaagttgcccttggaaaggtagcccaggcacttatgcacggggcaaaagtcctcagcatccgcggaaactttgatgatgcactcgctcttgtgcgcactctctgctcccaggaaaagatctacctcttaaactcgatcaacccttacaggctggaaggccagaagaccatcggcttcgagattgcagaccagctcggcttcaaagttcctgacaggattgtcctgcccgtaggaaatgcaggcaatatcactgctatctacaagggtttcagggagttcaagctccttggcatcacggactccctcccgaagatgacgggaattcaggcagcaggctcctgccccatagtaaaagccattaaaaacggggctccggaaatcactcccgaagagaacccggagacggttgcaacggcaatcaggataggaaaccctgtgaacgcaacaaaagccctgaacgctataagggaatccggcggtactgcggagtccgtaactgatgaagaaatccttgcagcccagaaagaccttgcaaggcttgagggtataggagtcgaacctgcaagtgcagcctcggtagctggtcttaagaaactcgttgacatgggagtcataggcagggacgaaacagtagtctgcattaccacaggccacctccttaaagacccccagaccgttattgacatctgtgaggaacctactgtcgttgatgcaaacatcgagtccatccgggaagcgattttcgggaagggaaaataa

SEQ ID NO: 53262 - protein, 405 aa, Methanosarcina mazei Go1
MYHLKCIECGAEYSKDEVIYTCSKCDGLLDVIYDYSSIKLDMEKLKTECPSVWKYAELLPIEREPVTIHEGGTPLYRCDRLAEKIGIKELYVKHEGMNPTGSFKDRGMTVGVTKALELGMSTVACASTGNTSAALAIYGAKAGIPVVVLLPAGKVALGKVAQALMHGAKVLSIRGNFDDALALVRTLCSQEKIYLLNSINPYRLEGQKTIGFEIADQLGFKVPDRIVLPVGNAGNITAIYKGFREFKLLGITDSLPKMTGIQAAGSCPIVKAIKNGAPEITPEENPETVATAIRIGNPVNATKALNAIRESGGTAESVTDEEILAAQKDLARLEGIGVEPASAASVAGLKKLVDMGVIGRDETVVCITTGHLLKDPQTVIDICEEPTVVDANIESIREAIFGKGK

SEQ ID NO: 53263 - DNA, 960 bp, Xanthomonas campestris pv. campestris str. ATCC 33913
  CDS (1)..(960)
atgatcgaaacgcttcttcctgcctattccgacgtcctgcaggcggctgcacgcattgccccgcacaccgcaccgaccccgttgctgcgctcgcacacgctggacacgctcagcggtgcgcagctgatgttcaaggccgagcacctgcagcgcagcggtgcgttcaaattccgcggcgcctgcaatgcggtctgggcgttgccggccgagaccgccgcacatggcgtggtgacgcactcttccggcaaccatggcgcggcgctggcactggccgcgcgcacccgcggcatcggctgccatgtggtggtgcccgaaggcgcggtggctgccaagctggccaatatttcccggcatggcgccaccttgtggcgctgcgcgccgaccatcgctgcgcgcgagcagctatgcgccgaggtccaggccagcagcggtgcgaccctggttcacccgtataccgatccggcggtgattgccggccagggcaccgcaacgctggagctgttgcacgacagcggcggcctggatgtgctggtggcgcccgtgggcggcggcgggctggcggccggggcggccctggcgctgcaggcttcgcccggttgcgcgctggtgctggccgagccggcgggtgcagccgacaccgcgcggtcgctggcggcagggcagcggctggtggacttcgttcccgacaccgtgtgcgacgggctgcgcggcaccctgggggcgcccaacttcgcgctgctgcaggccgccggagcgcaggtcatcaccgttgacgatgccgccgtggtgcaggccatgcgcctgctctggcaggtcttgaaacaggtggtggaaccgtcgtcggccatcgcgctggcggccgtgctggccgacccggcgcgctttgccgggaagcgggtgggcgtcatcttgtctggcggcaacgtcgacctggacgccttgccgtgggccgccgcgtga

SEQ ID NO: 53264 - protein, 319 aa, Xanthomonas campestris pv. campestris str. ATCC 33913
MIETLLPAYSDVLQAAARIAPHTAPTPLLRSHTLDTLSGAQLMFKAEHLQRSGAFKFRGACNAVWALPAETAAHGVVTHSSGNHGAALALAARTRGIGCHVVVPEGAVAAKLANISRHGATLWRCAPTIAAREQLCAEVQASSGATLVHPYTDPAVIAGQGTATLELLHDSGGLDVLVAPVGGGGLAAGAALALQASPGCALVLAEPAGAADTARSLAAGQRLVDFVPDTVCDGLRGTLGAPNFALLQAAGAQVITVDDAAVVQAMRLLWQVLKQVVEPSSAIALAAVLADPARFAGKRVGVILSGGNVDLDALPWAAA

SEQ ID NO: 53265 - DNA, 960 bp, Xanthomonas axonopodis pv. citri str. 306
  CDS (1)..(960)
atgatcgagacggtcccccttgcccattccgacgtcctgcaagccgctgcgcggatcgcgccgcactgcgcgccgacaccgttgctgacatcgcacagcctagatgcgctcagcagtgcgcagttgttcttcaaggccgagcatctgcagcgcagtggcgcattcaagttccggggtgcctgcaatgccgtatggtcgctgccggacgcgctggctgcgcgcggtgtggtcacgcattcctccggcaatcacggcgcggcgctggcgcttgccgcacgcacgcgcggcatcggctgccacgtggtggtgcccgagggcgcggtggcggccaagctcgccaatatctcccggaacggcgccacgttgtggcgttgcgcgccgaccatcgcggcgcgggaacagatgtgcgctgaggtgcaggccggcagcggcgccacgctggtgcacccgtataccgatcgtgcagtgatcgccgggcagggcaccgccacgctggagttgctgcaccagagcggcgtgctggatgtgctggtggcgcctgtcggcggtggtgggctggcggccggtgccgcactggcgctgcaggcttcgccggactgcgagctggtgctggccgagcctgccggcgcagccgacaccgcgcgttcgctggcggccgggcagcggctggtcgatttcgtgccggacaccatttgcgacggcctgcgcggcaccttgggcgcgcccaacttcgccgtgctgcagcgcgccggtgcgcaggtgatcacggtggacgatgccgcggtggtgcaggccatgcggctggtctggcagttgctcaagcaagtggtcgagccgtcttcggcgatcgccctggctgcggtcctggcccagccggcacggtttgccgggcggcgagtggggctgatcctgtccggcggcaatgtcgatctggacgccttgccttgggtcgcggcgtga

SEQ ID NO: 53266 - protein, 319 aa, Xanthomonas axonopodis pv. citri str. 306
MIETVPLAHSDVLQAAARIAPHCAPTPLLTSHSLDALSSAQLFFKAEHLQRSGAFKFRGACNAVWSLPDALAARGVVTHSSGNHGAALALAARTRGIGCHVVVPEGAVAAKLANISRNGATLWRCAPTIAAREQMCAEVQAGSGATLVHPYTDRAVIAGQGTATLELLHQSGVLDVLVAPVGGGGLAAGAALALQASPDCELVLAEPAGAADTARSLAAGQRLVDFVPDTICDGLRGTLGAPNFAVLQRAGAQVITVDDAAVVQAMRLVWQLLKQVVEPSSAIALAAVLAQPARFAGRRVGLILSGGNVDLDALPWVAA

SEQ ID NO: 53267 - DNA, 1119 bp, Xanthomonas axonopodis pv. citri str. 306
  CDS (1)..(1119)
atgcctgattccggccgcccttccgcacaggagccagaggtaggcgacgtggccgtgagcgtggccgacgtgctggccgcacaggcacgcctgcgcaagtacctgtcgcccacgccgctgcactacgccgaacgcttcggtgtgtggttgaagctggagaatttgcagcgcaccggctcctacaaggtgcgcggcgcattgaatgcgttgctggccgggctggaacgcggcgatgagcgcccggtgatctgcgcctcggccggcaaccacgcgcaaggtgtggcgtggtcggcgtaccggctgggtgtgcaggccatcacggtaatgccctatggcgcgccgcagaccaagattgccggtgtcgcgcattggggtgccacggtgcgccaacatggcaacagctacgacgaagcgttcgcgtttgcgcgcgagctggccgaccagaacggctatcgcttcctgtccgccttcgacgacccggacgtgatcgccggccagggcacggtgggcatcgagctggcggcgcatgcgccggacgtggtgatcgtgccgatcggcggcggtggcctggcctccggcgtggcgctggcattgaagtcgcaaggcgtgcgcgtggtcggggcgcaggtggaaggcgtggattcgatggcgcgcgccgtccgcggcgatctgcgcgaaatcgctccggtcccaacgctggccgatggcgtgaaggtcaagattccaggcctgctcacgcgccgcctgtgctcgagcctgctcgatgatgtcgtgatcgtgcgcgaggccgaattgcgcgaaacattggtgcgcctggcactggacgaacacgtcattgccgagggcgctggcgccctcgccctggccgccggtcgccgcgtttccggcaaacgcaaatgtgcggtggtctctggcggtaatatcgacgcaaccgtgctggccacactcttgtccgaggtgcggccgcgtccgccacgcaagccgcgccgccgcaataccgagcgactccgcaacgaacgcagcgccaatccgccacccgccacacacgttctttcccgcccatccgcagtcgcttcaacgcctgtcaccgccatcgccgtagaggagtcttcctggtga

SEQ ID NO: 53268 - protein, 372 aa, Xanthomonas axonopodis pv. citri str. 306
MPDSGRPSAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGLASGVALALKSQGVRVVGAQVEGVDSMARAVRGDLREIAPVPTLADGVKVKIPGLLTRRLCSSLLDDVVIVREAELRETLVRLALDEHVIAEGAGALALAAGRRVSGKRKCAVVSGGNIDATVLATLLSEVRPRPPRKPRRRNTERLRNERSANPPPATHVLSRPSAVASTPVTAIAVEESSW

SEQ ID NO: 53269 - DNA, 1041 bp, Staphylococcus aureus subsp. aureus MW2
  CDS (1)..(1041)
atgacaaccaacacagttacattacaaacagcacatattgtaagtttaggagatatcgaagaagctaaagcaagcattaaaccatttattcgtcgaacacctctaattaaatcaatgtatttaagccaaagtataactaaagggaatgtatttctaaaattagaaaatatgcaattcacaggatcttttaaatttagaggcgctagcaataaaattaatcacttaacagatgaacaaaaagaaaaaggcattatcgcagcatctgctgggaaccatgcacaaggtgttgctttaacagctaaattattaggcattgatgcaactatcgtaatgcctgaaacagcaccacaagcgaaacaacaagcaacaaaaggctatggggcaaaggttattttaaaaggtaaaaactttaacgaaactagactttatatggaagaattagcgaaagaaaatggcatgacaatcgttcatccatatgacgataagtttgtaatggcaggccaaggaacaattggtttagaaattttagatgatatttggaatgtgaatacagtcatcgtaccagttggcggtggaggattaattgcaggtattgccaccgcattaaaatcatttaacccttcaattcatattatcggtgttcaatctgagaatgttcatggtatggctgagtctttctataagagagatttaactgaacatcgagtggatagcacgatagcagatggttgtgatgtaaaagttcctggtgaacaaacatatgaagtagttaaacatttagtagatgaatttattcttgttactgaagaagaaattgaacatgctatgaaagatttaatgcagcgtgccaaaattattactgaaggtgcaggcgcattaccaacagctgcaattttaagtggaaaaataaacaataaatggcttgaagataaaaatgttgttgctttagtttcaggcgggaatgttgacttaactagagtttcaggtgtcattgaacatggactgaatattgcagatacaagcaagggtgtggtaggttaa

SEQ ID NO: 53270 - protein, 346 aa, Staphylococcus aureus subsp. aureus MW2
MTTNTVTLQTAHIVSLGDIEEAKASIKPFIRRTPLIKSMYLSQSITKGNVFLKLENMQFTGSFKFRGASNKINHLTDEQKEKGIIAASAGNHAQGVALTAKLLGIDATIVMPETAPQAKQQATKGYGAKVILKGKNFNETRLYMEELAKENGMTIVHPYDDKFVMAGQGTIGLEILDDIWNVNTVIVPVGGGGLIAGIATALKSFNPSIHIIGVQSENVHGMAESFYKRDLTEHRVDSTIADGCDVKVPGEQTYEVVKHLVDEFILVTEEEIEHAMKDLMQRAKIITEGAGALPTAAILSGKINNKWLEDKNVVALVSGGNVDLTRVSGVIEHGLNIADTSKGVVG

SEQ ID NO: 53271 - DNA, 1410 bp, Drosophila melanogaster
  CDS (1)..(1410)
atgtcccaggcagtgaaaacggaaacgcccaaggaaccaaatgttgtggctgccaaagccaatggcggcaccgctgtcaatggaaagttggaagcccagaagagaccccggcatgtttctggtggtgtggaggaaatcatcgatcccttttgcaatccggagaaaccgcaacgcatatccttccatgacgtcacatccgctgcctttctcatccgcggtggcgtggaacgcactccttgtccgaaatccacatcatcggatctatatggcatggagttatatctgaaaaaggatttcctacaatatacaggcagcttcaaggagcgtggcgcacgctatgccttgctatcattgaccgaggaacagaagcgaaccggagtgatcagtgcctccttgggtaatcacgcccaggccctgtgctatcatggctggaaactcaatataccagtgaccgtggtgatgcccaaggcggcgcccatcatgaagatccaaaagtgccggaactacaaggcacgcgtcatcgtcgacggaaatgacatgggcgaagccaagtccctggccatgcgaatgtcccgcgaggagggactcctgtacgtgaatggctacgatcatccgcacattatggccggccagggaactattggtttggagatactcgaacaggtgccggaaccggatgcagtggtggtgccagtgggcggcggtggactgattgccggtattgccacagccgttaaagctttgtcccccaaaaccaagattattggtgtggagtcggagaagtgcgccagcttcacccgggccatggaaaatgatggacctattcacacgcccatcaagaacacattggctgatggcttggccgttcctaaagttggctataatgcctatgccaccgcaatgccgctaatagatcgcatggtggtggtcaaggaggagtggatcgcagtggctatcctaagattggtggaggaggagaagtgcgtcgtcgagggagcgggtggtgcgggtctggcggccattctggccggacacttggatgagctcaagggaaagaaagttgtggtgcttctgtgtggaggaaacatagacaccaccgtttttggacgttgtttggagcgaggtttggctgccgttggacgcctggttaagtttaatgtggaggttagcgatcgtcctggcggaatcaacgatctttgcgccctgcttgtccgagtaggcgtgtccattaaggacatcatgcacgagcgagcctggctgagggatgtttataccgtggaagtgaaggtcgtgtgcgaaaccgtggactggacccatagtttgcagctaaaaaacgagctgaagaagttctactcgaaagttcagttctccgatgttccgctggccctgtcaaatgataccgattcgtag

SEQ ID NO: 53272 - protein, 469 aa, Drosophila melanogaster
MSQAVKTETPKEPNVVAAKANGGTAVNGKLEAQKRPRHVSGGVEEIIDPFCNPEKPQRISFHDVTSAAFLIRGGVERTPCPKSTSSDLYGMELYLKKDFLQYTGSFKERGARYALLSLTEEQKRTGVISASLGNHAQALCYHGWKLNIPVTVVMPKAAPIMKIQKCRNYKARVIVDGNDMGEAKSLAMRMSREEGLLYVNGYDHPHIMAGQGTIGLEILEQVPEPDAVVVPVGGGGLIAGIATAVKALSPKTKIIGVESEKCASFTRAMENDGPIHTPIKNTLADGLAVPKVGYNAYATAMPLIDRMVVVKEEWIAVAILRLVEEEKCVVEGAGGAGLAAILAGHLDELKGKKVVVLLCGGNIDTTVFGRCLERGLAAVGRLVKFNVEVSDRPGGINDLCALLVRVGVSIKDIMHERAWLRDVYTVEVKVVCETVDWTHSLQLKNELKKFYSKVQFSDVPLALSNDTDS

SEQ ID NO: 53273 - DNA, 1263 bp, Bacillus anthracis str. A2012
  CDS (1)..(1263): w means a or t/u, m means a or c
atggtgcaaaaggtaaaggagagagtgaaaattgaagatatcttaatggcccatacttgtatgaaagatatcgttattaaaacaccgttacaacgtgatacagttttatctgagaaatatgattgtgacgtttatgtaaaacgcgaagacttacaattaattcgctctttcaaaattcgtggtgcgtacaatttaattcgaagtttatcgaaagaacaattacaaaacggtgttgtttgtgcaagcgctggtaatcatgcacaaggggtagcttatacgtgtaatttattgaagattccgtcaaaaattttcatgccaacaacaacacctaagcaaaaagtatcacaagttcaatttttcggtggtgatttcgcagagattgtattggttggtgatacattcgatagctcttttcaagaagcgcagcgttattgtgaagaaaatagaatgacatttgttcatccgtttgatgatccgtacgtagttgctggtcaagggacagtggcagttgaaattatgcatgatatggagaaaccggttgattatatctwtacagcaatcggcggtggtggattagcatcaggtgttggtacatatgtgwmaggtgttagtcctgctacacaggtcattggggtagagccaatgggagctgcatctatgaaagaggcttttcttcaaaatgataatgtggcattggagaaaatagatagttttgttgatggggcagcggttaaaaaggtaggaaagttaacatttgaaacttgtaaagatgtaattgatgacattgttttagtaccagagggaaaggtttgtacgacgattttagaactgtataagaaaaatgcgattgtagctgaaccagctggtgcactctctattgcagcgcttgatttatacagagatgaaattaaaggtaaaacagttgtatgcacattaagtggtggaaacaatgatattgatagaatgcaagaaatgaaagaacgatctcttatttacgaagggttaaagcattatttcatcattgaattcccgcaacgttcaggtgcgttaagagaatttcttgataaaggattagggccagaagatgatattactcgctttgagtatattaagaaacataataaggaaaatggtccagcattagtcggagtagagttaaaacataaagaagattacgagcagttaattatccgttttaaagaaaataatattcaatttatggagcttaataaaaatcctgttttgtttgatttgcttatttaa

SEQ ID NO: 53274 - protein, 420 aa, Bacillus anthracis str. A2012
  misc_feature (184)..(184): Xaa can be Tyr or Phe
  misc_feature (201)..(201): Xaa can be any amino acid
MVQKVKERVKIEDILMAHTCMKDIVIKTPLQRDTVLSEKYDCDVYVKREDLQLIRSFKIRGAYNLIRSLSKEQLQNGVVCASAGNHAQGVAYTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIXTAIGGGGLASGVGTYVXGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 53275 - DNA, 1545 bp, Yersinia pestis KIM
  CDS (1)..(1545)
atggcagtttcgcaacccttatctgctgccccctgcggggcagaatatctgcgggcgatattacgtgcgccggtgtatgaggtggcgcaagtcaccccgttacaagtgatggagaaaatctcctcgcgcgtgggtaataccgttttagtgaagcgtgaagatcggcagccggtacacagctttaagttgcgcggtgcttacgcgatgatctccagcctgacggaagagcagaaagcctgtggcgtcgtcacggcttctgcgggtaaccatgctcaaggcgtggcgctttctgcccataaaatggggattaaagcgctgatcgtcatgcccgttgctactgcagatattaaagttgatgcggtacgtgcttttggcggcgaggtgctgctgtttggcgctaattttgatgaagccaaaaccaaagctatcgcgcttgctcaagagcagggctacacctttgtgccaccgtttgaccatccggcggtgattgccgggcaggggacgctggcgatggagttactgcaacaagatgcccatcttgatcgggtttttgtcccagtgggcggcggtgggctggtggccggtgtggcggtgcttatcaagcaattgatgccacagattaaagtgattggtgttgaagccgaggattctgcctgtttgcgggccgcgctggatgcggggcagccggtcgatttggcgcgtgtcgggctgtttgccgagggcgtggcagttaagcgtatcggtgacgagcctttccgcctgtgtcaggaatatctggacgatgtgatcaccgttgacagtgatgctatctgtgccgcagtcaaagatctgtttgaggatgttcgcgccattgctgagccttctggtgcgttggcattggcgggcctgaaaaaatatgtgcagcagcataatattcagggcgagcgtctggcacatgtgctttctggtgcaaacgtgaacttccatggtttgcgttatgtgtcagagcgttgcgagttaggtgagcagcgtgaagccctgctggcggtgactattccagagcaaaagggcagtttcctgcgtttctgtgaattactgggtggccgttcggtaacggaatttaactaccgttacgccgatgctgaaaacgcctgcatttttgttggggtacgtttgactcgtggttatgctgagcgggttgaaattcttgctgaattgcaggacaaaggttatcaggtggtcgatttatctgatgacgaaatggcgaaactgcatgtgcgttatatggttggtgggcggccctcgaaaccactgcgtgagcgcctgttcagctttgaattccccgagtcaccaggcgctttgctgaaattcctgcatacgttgggcactcactggaatatttctctgttccactaccgcagccatggcacagattttggccgggtattggcggcatttgagttgtcggctaccgaaccgcaatttgaagagcgcttagcggctctgggctactattgccacgatgaaacggataacccggcgtttaagttctttttagcgggttaa

SEQ ID NO: 53276 - protein, 514 aa, Yersinia pestis KIM
MAVSQPLSAAPCGAEYLRAILRAPVYEVAQVTPLQVMEKISSRVGNTVLVKREDRQPVHSFKLRGAYAMISSLTEEQKACGVVTASAGNHAQGVALSAHKMGIKALIVMPVATADIKVDAVRAFGGEVLLFGANFDEAKTKAIALAQEQGYTFVPPFDHPAVIAGQGTLAMELLQQDAHLDRVFVPVGGGGLVAGVAVLIKQLMPQIKVIGVEAEDSACLRAALDAGQPVDLARVGLFAEGVAVKRIGDEPFRLCQEYLDDVITVDSDAICAAVKDLFEDVRAIAEPSGALALAGLKKYVQQHNIQGERLAHVLSGANVNFHGLRYVSERCELGEQREALLAVTIPEQKGSFLRFCELLGGRSVTEFNYRYADAENACIFVGVRLTRGYAERVEILAELQDKGYQVVDLSDDEMAKLHVRYMVGGRPSKPLRERLFSFEFPESPGALLKFLHTLGTHWNISLFHYRSHGTDFGRVLAAFELSATEPQFEERLAALGYYCHDETDNPAFKFFLAG

SEQ ID NO: 53277 - DNA, 1062 bp, Oceanobacillus iheyensis HTE831
  CDS (1)..(1062)
atgacctggcaaggtttattaaaggaatatgcggatttattaccagtcacagaccagacaccatcattaagtctaatggaaggaaacactcctttattgtcttttccaactttatcaaaggaattaggaatagagttatatggaaaatttgaaggattaaacccgaccggctcatttaaagatagaggcatggttatggcagttgcaaaagcaatcgaagaaggcagcaaatccattatttgtgcttctacaggaaatacttcagctgcagctgctgcctatgctgctagggctggtatacgtgcaattattgtcatccctaaaggaaaagttgctttaggaaaattagctcaagccgtcatgtacggtgcagagattgttgagattgatggtaattttgatgaggcactgcaaatggttcgtaaaatcagtgagaaatcagccgttacattagttaactctgttaatccttatcgtattgacggacaaaaaactgccgcatttgaagtttgcgatcaattaggttcagctcctgatattcttgctattccagtagggaatgcaggaaatattagtgcatattggaaaggatttaaagaatataacgaaaaacaccaatcgggactacccaaaatgatgggatttgaagcagaaggtgctgctgctattgttaaaaataaagttattgagcaaccagaaacagtagctactgctatccgtatcggtaacccagcaagttgggaacttgccctaaaagcaaaagaagaatcaaatggaagtattgggtatgtaacagatgaagagattgtaaatgcgttcaagcttttaccacaaaaagaaggtatttttgcagagccaggatcagcagcatctatcgctggtgttatccaacaggttaaaagtggaactattccaaaaggtagtaaggttgttgctgtattgacagggaatggattgaaagatccacaaacggcaatcgatcaactatccattgatcctgtaagcttaccaaacaacgaaaaagcagtcatggactatcttgaagagttgattacatcatga

SEQ ID NO: 53278 - protein, 353 aa, Oceanobacillus iheyensis HTE831
MTWQGLLKEYADLLPVTDQTPSLSLMEGNTPLLSFPTLSKELGIELYGKFEGLNPTGSFKDRGMVMAVAKAIEEGSKSIICASTGNTSAAAAAYAARAGIRAIIVIPKGKVALGKLAQAVMYGAEIVEIDGNFDEALQMVRKISEKSAVTLVNSVNPYRIDGQKTAAFEVCDQLGSAPDILAIPVGNAGNISAYWKGFKEYNEKHQSGLPKMMGFEAEGAAAIVKNKVIEQPETVATAIRIGNPASWELALKAKEESNGSIGYVTDEEIVNAFKLLPQKEGIFAEPGSAASIAGVIQQVKSGTIPKGSKVVAVLTGNGLKDPQTAIDQLSIDPVSLPNNEKAVMDYLEELITS

SEQ ID NO: 53279 - DNA, 1017 bp, Oceanobacillus iheyensis HTE831
  CDS (1)..(1017)
gtgagttgtcttggggatcgcttaactggtgaaaaagtataccaagctatgaagaaattaacaccgattgttcatcgtacaccattagtaacatcacatacaacggatgatattgttggaaaacatgtttactgtaaaatggaaaatcaacaaaaaactggggcatttaaatttcgaggagcaagttataaattaatgcaactgtcaaaagaagaattacaacacggcgtaattacagcttcagctggtaatcatgcacaaggtgtagctcatgccgctgcaaaattaggagttaaggcaacgatttttatgtctgaaggaacgcctctagcgaaaattaatgcgacaagaaattatggggcaaccgtaaatcttgttggagaaagttttcaagaagcttatgaggcttcacttcaacatcaaaaagtaactggtgctacgtatatccacccatttgatgattatgatattatggctggtcaagggacaattgcaatggaattactccgccaagaagaccgtattgataccattattgtcccaattggtggaggtggattaattagtggcattgcagttgctgctaaacatgtaaatagaaacattaaaataatcggcgtacaggctgaaggtgctgcagcaatgcatcaaagttatcattcgagcaaagtacattctttatcaaatgtttcaacaattgcagaaggaatagcggtaaaacaaccaggagatttgaccttgccacttattcgatcctatgttgatgatattgttacggttaatgatgaacaaattgcttcagcaatcatttacatgttggaaagaaataagacgttaatggaaggtgctggtgccgctgcattagctgcactatttgcacataatgacacgatctcatccaggcattgtggtgttatagttagtggaggtaacttggacatcagtaatatgcaaaaaatacaacatctatccagtaatattaataaaaatccagaaagagcatatgtggcgctataa

SEQ ID NO: 53280 - protein, 338 aa, Oceanobacillus iheyensis HTE831
MSCLGDRLTGEKVYQAMKKLTPIVHRTPLVTSHTTDDIVGKHVYCKMENQQKTGAFKFRGASYKLMQLSKEELQHGVITASAGNHAQGVAHAAAKLGVKATIFMSEGTPLAKINATRNYGATVNLVGESFQEAYEASLQHQKVTGATYIHPFDDYDIMAGQGTIAMELLRQEDRIDTIIVPIGGGGLISGIAVAAKHVNRNIKIIGVQAEGAAAMHQSYHSSKVHSLSNVSTIAEGIAVKQPGDLTLPLIRSYVDDIVTVNDEQIASAIIYMLERNKTLMEGAGAAALAALFAHNDTISSRHCGVIVSGGNLDISNMQKIQHLSSNINKNPERAYVAL

SEQ ID NO: 53281 - DNA, 1227 bp, Brucella suis 1330
  CDS (1)..(1227)
atgacccccttcgtcaaatccgtggcccaggcagaaaaggcaatgcgcgcgctcttttgcgaaacgccattgcaacgcaacgattatctgtcgcggaaatatggtgcgcagatttggctgaaacgcgaagacctgacgccggtgcgctcctacaagctgcgcggtgccttcaattttatttccaaagccgttgaaacaacagataaaaatgccgttttcgtctgtgcttccgccggcaatcatgcgcagggctttgcattcgtctgccggcatttcgggcgcaagggcgtggttttcatgccagtcaccacgccgcagcagaaaatcgacaagacgcgcacctttggcggagaattcatcgaaatcaaacttgtcggcgatattttcgatgtctgttatgccgcctcgcaggaattcgcagccgccaacaagggcgtgatggtgccacccttcgaccatcccggcattgttgaagggcaggcgacagtcgcgctggaaatcgagcggcaattgccggacgacagcaagtcggacctcgtgctcctgccggttggcggtggcgggctttcaagcggcgtaacgcaatatatcgccgatcttggctggaaaaccgctttccgctttgtggagccgcagggcgcggcaagcctcaaggccagcctggaggcgggcaagcgggtcaagctttcgcatatcgataattttgtcgatggtgctgccgttgcagaaatccgcaaagaaaatttcaaacttctcaaaggcttcgatccgaaaactgtcataacggttccggaaaacaggctctgcgcgaccattgttgaaatgctgaatattgaaggtgttgtgctggaaccggccggtgcgctcggcatcgatgcgctcaaggatttcaagaaaagcgacatcaagggcaaacgcattgttatcgtcgtttctggcggcaatttcgatttcgagcggctgccggatgtgcgggaaagggcgcttcgttttgaagggctgaagaaatatttcattttccgctttcctcagcgccccggcgcattgcgctccttccttgaccttctggggccggatgacgatattgcgcgctttgaatatctcaagaaatcggcgcgaaatttcggctcggtgctaatcggtatcgaaaccagggacgcggcaaatttcaagcttctggagaagaagtttgccgaatccggctgggcatcaggatatcagcgataa

SEQ ID NO: 53282 - protein, 408 aa, Brucella suis 1330
MTPFVKSVAQAEKAMRALFCETPLQRNDYLSRKYGAQIWLKREDLTPVRSYKLRGAFNFISKAVETTDKNAVFVCASAGNHAQGFAFVCRHFGRKGVVFMPVTTPQQKIDKTRTFGGEFIEIKLVGDIFDVCYAASQEFAAANKGVMVPPFDHPGIVEGQATVALEIERQLPDDSKSDLVLLPVGGGGLSSGVTQYIADLGWKTAFRFVEPQGAASLKASLEAGKRVKLSHIDNFVDGAAVAEIRKENFKLLKGFDPKTVITVPENRLCATIVEMLNIEGVVLEPAGALGIDALKDFKKSDIKGKRIVIVVSGGNFDFERLPDVRERALRFEGLKKYFIFRFPQRPGALRSFLDLLGPDDDIARFEYLKKSARNFGSVLIGIETRDAANFKLLEKKFAESGWASGYQR

SEQ ID NO: 53283 - DNA, 1638 bp, Shewanella oneidensis MR-1
  CDS (1)..(1638)
atgttatctctcgcatcgtcgcaaacggaacaagcggagtctcagccagctcaggcttctcccgcttcagttgagaaaagtcagctagctcaacactatctgcaaaagatcctactatcgtcggtttatgatgttgcgaaagtgacaccactctcgagcctcaataaactctcggcgcgtttaggctgccaagtgtttttaaagcgtgaggatatgcaacccgtacattcctttaaactgcgtggcgcctataaccgcatcgcccagttgagccaagccgaatgccagcgtggcgtggtgtgcgcctcggcgggcaaccatgcccaaggtgtagccatgtcggcggcgagccgtggtgtggatgcggtgattgtgatgcccgaaaccacgccggatattaaagtcgatgcggtgcgccgcttgggtggcaacgtggtattgcacggccaagctttcgatcaagccaatggttttgcgatgacgatggcccagcaggaaggtcgggtgtatatcgcccccttcgatgatgaagccgtgatcgctggccaaggcactattgcccaagaaatgctgcaacagcagcgcgatcttgaagtgatttttgtgcccgtgggcggcggcggtttaattgcgggtattgctgcctactacaaggcggtgatgccacaggtgaaaattgtcggcgttgagcctgaagatgcggcctgcttaaaggcggcgatggaagcgggcgagcctgtgaccttatcccaagtgggcctgtttgccgacggggtcgcggttaagcgtattggtactgagccatttcgtgtcgccaaactgtgtgtagatgccgtggtgacggtcacgtccgacgaaatctgtgcagcggtgaaagatatttttgaagatacccgcgctattgccgaacccgcaggtgctttatctttagctgggcttaaaaaatatgtcagcactaatgctacaggtgagagtggtcgcggcgaaaaggtcgcggcgattttaagtggcgcgaatgtgaacttccacagtttgcgctatgtgtccgagcgctgcgagctgggtgagcaaaaagaagcggtgctggcggttaaagtgcccgagcgtccgggcagcttcctgcgtttttgtgagctgctcgaaaagcgggtgatgaccgaatttaattatcgctttagcagccgagatatggcggtggtatttgcgggtatccgtttgaccaaaggccatggtgaattagagcagatcatcaataccttagaagacaatggctttgaggtgcaggacttatccggtgatgaaactgcgaaattgcatgtgcgttatatggtcggtggtcatccgccagagccgttagaggagcgcctatttagctttgagtttcccgagcatccgggtgcactgctgaagtttttaaccaccttgcagagtaagtggaatatcagtctatttcattatcgcaaccacggcgcagcctttggccgagtgctggcggggtttgaagtgcccgcgagtgatgccttgccatttcagcagtttttaactgagctgggatttgtctatcaagaagagacccaaagccctgcttatcaactgtttttgaatgccggaaaaggaaaaaacaacctgcctgtgtag

SEQ ID NO: 53284 - protein, 545 aa, Shewanella oneidensis MR-1
MLSLASSQTEQAESQPAQASPASVEKSQLAQHYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMTMAQQEGRVYIAPFDDEAVIAGQGTIAQEMLQQQRDLEVIFVPVGGGGLIAGIAAYYKAVMPQVKIVGVEPEDAACLKAAMEAGEPVTLSQVGLFADGVAVKRIGTEPFRVAKLCVDAVVTVTSDEICAAVKDIFEDTRAIAEPAGALSLAGLKKYVSTNATGESGRGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPASDALPFQQFLTELGFVYQEETQSPAYQLFLNAGKGKNNLPV

SEQ ID NO: 53285 - DNA, 1251 bp, Streptococcus mutans UA159
  CDS (1)..(1251)
atgatttcagctaaagatgtggttgctgctaacaaagtcttaaaagatgttgttgttcaaacaccacttgattttgatcgctatttgtcagaaaaatatggagcgacaatttatttaaaacgtgaaaatatgcaaaaggtgcgttcttttaaaattcgtggcgcttattatgctatttcacaattatcagatgaagaaaaggctagaggagttgtttgtgcttctgccggaaatcatgctcaaggagttgcttatacctgtaatgaaatgaaaattcctgcaactattttcatgcctgtaacgactcctcatcaaaagattgggcaagttcaattttttggaggctcctttgtaactatcaaattggtaggtgatacttttgatgcttctgctcaggcagcccaagattatacgaaagctgaaggaatgacctttatcgatccctttgataatgacatggtacaagcgggtcaaggaacaattgcttatgaaatttatgatcaggctcaagaagatggtttgagctttgatgctattttagtacctgttggtggtggcggtcttatttcaggtgtatcagcctatgttaaagatgtggctcctgaaattgaggttattggcgttgaggcaatgggagcgcgcagcatgcgggcagcttttgataaaggacatcctgttaaattagagcatattgataaatttgcagatggcatagctgttcaaaaggttgggcgttctacctatgatgttgctagaaaatatgtggatcgcttgattggtgtagatgaaggtctcatttctgaaaccttgattgatatgtattctaaacaaggtattattgcagaaccagcaggagcagcttctattgcagctctggaagaaatgaaagatgatattaaaggcaaaactattgtctgtattatttctggtggaaataatgacattaaccgtatgcaagaaatggaagaacgtgcacttatttatgatggtgtgaagcattattttgttgtgaattttccacaacgcccaggagctctgcgggaatttgttaatgatattttaggaccaaatgatgatatcacccgttttgaatatattaaacgtgccaataaaggaacaggtccagtcctaatcggcattactttagcggataaaaatgattatcaggatctaattgatcgtttgggtgcttttgacccaggttatatcaatcttcatggcaatgaaagtctgtataatatgctcgtctga

SEQ ID NO: 53286 - protein, 416 aa, Streptococcus mutans UA159
MISAKDVVAANKVLKDVVVQTPLDFDRYLSEKYGATIYLKRENMQKVRSFKIRGAYYAISQLSDEEKARGVVCASAGNHAQGVAYTCNEMKIPATIFMPVTTPHQKIGQVQFFGGSFVTIKLVGDTFDASAQAAQDYTKAEGMTFIDPFDNDMVQAGQGTIAYEIYDQAQEDGLSFDAILVPVGGGGLISGVSAYVKDVAPEIEVIGVEAMGARSMRAAFDKGHPVKLEHIDKFADGIAVQKVGRSTYDVARKYVDRLIGVDEGLISETLIDMYSKQGIIAEPAGAASIAALEEMKDDIKGKTIVCIISGGNNDINRMQEMEERALIYDGVKHYFVVNFPQRPGALREFVNDILGPNDDITRFEYIKRANKGTGPVLIGITLADKNDYQDLIDRLGAFDPGYINLHGNESLYNMLV

SEQ ID NO: 53287 - DNA, 951 bp, Drosophila melanogaster
  CDS (1)..(951)
atgcccaaggcggcgcccatcatgaagatccaaaagtgccggaactacaaggcacgcgtcatcgtcgacggaaatgacatgggcgaagccaagtccctggccatgcgaatgtcccgcgaggagggactcctgtacgtgaatggctacgatcatccgcacattatggccggccagggaactattggtttggagatactcgaacaggtgccggaaccggatgcagtggtggtgccagtgggcggcggtggactgattgccggtattgccacagccgttaaagctttgtcccccaaaaccaagattattggtgtggagtcggagaagtgcgccagcttcacccgggccatggaaaatgatggacctattcacacgcccatcaagaacacattggctgatggcttggccgttcctaaagttggctataatgcctatgccaccgcaatgccgctaatagatcgcatggtggtggtcaaggaggagtggatcgcagtggctatcctaagattggtggaggaggagaagtgcgtcgtcgagggagcgggtggtgcgggtctggcggccattctggccggacacttggatgagctcaagggaaagaaagttgtggtgcttctgtgtggaggaaacatagacaccaccgtttttggacgttgtttggagcgaggtttggctgccgttggacgcctggttaagtttaatgtggaggttagcgatcgtcctggcggaatcaacgatctttgcgccctgcttgtccgagtaggcgtgtccattaaggacatcatgcacgagcgagcctggctgagggatgtttataccgtggaagtgaaggtcgtgtgcgaaaccgtggactggacccatagtttgcagctaaaaaacgagctgaagaagttctactcgaaagttcagttctccgatgttccgctggccctgtcaaatgataccgattcgtag

SEQ ID NO: 53288 - protein, 316 aa, Drosophila melanogaster
MPKAAPIMKIQKCRNYKARVIVDGNDMGEAKSLAMRMSREEGLLYVNGYDHPHIMAGQGTIGLEILEQVPEPDAVVVPVGGGGLIAGIATAVKALSPKTKIIGVESEKCASFTRAMENDGPIHTPIKNTLADGLAVPKVGYNAYATAMPLIDRMVVVKEEWIAVAILRLVEEEKCVVEGAGGAGLAAILAGHLDELKGKKVVVLLCGGNIDTTVFGRCLERGLAAVGRLVKFNVEVSDRPGGINDLCALLVRVGVSIKDIMHERAWLRDVYTVEVKVVCETVDWTHSLQLKNELKKFYSKVQFSDVPLALSNDTDS

SEQ ID NO: 53289 - DNA, 1311 bp, Corynebacterium efficiens YS-314
  CDS (1)..(1311)
atgagcgcaacacacgtgtctgagaagagcccaggagtgatcgacagcgggatggagccgattcgtgccgccgacattcagatggcgcaggcacgaatttcctccgtgatcgcgcccacccccctggagtactgcccgcgtctgtcggaggagaccggcgtggaggtctacctcaaacgtgaggacctccaggatgttcgttcctacaagatccgcggtgccctcaactccggttcccagctgagccgggagcagcgtgatgctggcattgtggcggcctccgcgggaaaccacgcgcagggtgtggcgtttgtgtgcaagtcactgggtgttcaagggcgcatctacgtgcccgtgcagaccccgaagcagaagcgcgaccgcatcctggtgcacggtggggaatatgtcaccctcgtagtgaccggcaacaacttcgatgaggcctccgctgccgcccatgaggatgccgaacgcaccggggccaccctgatcgaaccgttcgatgcccgggacaccatcatcggccagggcactgtcgcagccgagatcctctcccagctgaccacactgggtaaatccccggaccatgtcatggttcccgtcggcgggggcggactgctcgccggggtggtcagttacatggcagatatggcaccgcgcaccgccatcgtcggggtggaacccgcgggggcagcctccatgcaggcggccctgaaggccggggggccggtgaccctggagaacgcggatcccttcgttgatggtgccgccgtcaagcgcgtcggggacctcaactaccaggtggtggagaagaacctgggccgcgtccacatgatggatgtcagcgagggtgcggtgtgcaccgagatgcttgagctgtaccagaacgagggcatcatcaccgagcctgccggcgcactgtcggtggcgggtctgcgggacatgaaattcgccaaggggtccgtcgtagtgtgcatcatctccggtggtaacaatgatgtgctgcgctataacgagatcgtggagcggtccctggtccaccgtggcctcaagcactacttcctggtgaacttcccgcagaaaccgggacagctgcgcagcttcctggaggacatcctcggccccgaggatgacatcaccctcttcgagtacctcaagcgcaacaaccgtgagaccggcaccgccctggtgggtctccagctgggtgaggccagcggcctggattccctcctggcacgcatggatgcctccgcgatcgactgtcgccgcctcgaaccgggcacccccgagtacgacttcctgacctag

SEQ ID NO: 53290 - protein, 436 aa, Corynebacterium efficiens YS-314
MSATHVSEKSPGVIDSGMEPIRAADIQMAQARISSVIAPTPLEYCPRLSEETGVEVYLKREDLQDVRSYKIRGALNSGSQLSREQRDAGIVAASAGNHAQGVAFVCKSLGVQGRIYVPVQTPKQKRDRILVHGGEYVTLVVTGNNFDEASAAAHEDAERTGATLIEPFDARDTIIGQGTVAAEILSQLTTLGKSPDHVMVPVGGGGLLAGVVSYMADMAPRTAIVGVEPAGAASMQAALKAGGPVTLENADPFVDGAAVKRVGDLNYQVVEKNLGRVHMMDVSEGAVCTEMLELYQNEGIITEPAGALSVAGLRDMKFAKGSVVVCIISGGNNDVLRYNEIVERSLVHRGLKHYFLVNFPQKPGQLRSFLEDILGPEDDITLFEYLKRNNRETGTALVGLQLGEASGLDSLLARMDASAIDCRRLEPGTPEYDFLT

SEQ ID NO: 53291 - DNA, 918 bp, Pseudomonas putida KT2440
  CDS (1)..(918)
atgaccttgcacattcatacccccctgatcgagtcgcgcccgctgtcgttggcggccggtcgtaatatctggctcaagctcgacgccctgcaaccctgcggttcgttcaaactgcgcggtgtaggccacgcctgcgaggtacaccacgcgcgtggcgcccggcactttgtgtcctcgtcaggtggcaatgccggtttggcagtcgcctatgccggacgcaagctgggggtgccggtgaccgtggtgatacccgaaaccaccaccgaacgggccaagcagttgctgcacctggaagacgccaaggtggtggtgcaaggcagttcctggcaagaggccaacgccctggcacagacactggtaggcccgaacgatgccttcatccacccattcgacgacccactgctgtgggccgggcatgccagcctggtggatgaagtggccgaggccggcctgaagccggacgcggtggtgttgtcagtcggcgggggcggcttgctcagtggcgtggtggaggggctcaagcgcaatggctggggcgatgtgcctgtgctggcggtagaaaccgagggcgcggcgtcgctgcatgcggccatgcaggctgggcattcggtggagctggagcgcatcgcctcggtggcgacgtcgctgggggccaagcgtgtggctgatcaggcgctgatgtgcgtgcagcagcatccggtgcacagccatctggtcagcgatcgcgcagcgctggaggcctgtgagcggttcttgctggaccaccgtgtgctggtcgagcccgcgtgcggggcggcgttggcagtggcctatgatgccaaggctctgggcgccttgcgcaatgtcctggtggtggtctgtggtggcgctaccgcaacactggagcagatccaggcctggctgcagcaggcagactga

SEQ ID NO: 53292 - protein, 305 aa, Pseudomonas putida KT2440
MTLHIHTPLIESRPLSLAAGRNIWLKLDALQPCGSFKLRGVGHACEVHHARGARHFVSSSGGNAGLAVAYAGRKLGVPVTVVIPETTTERAKQLLHLEDAKVVVQGSSWQEANALAQTLVGPNDAFIHPFDDPLLWAGHASLVDEVAEAGLKPDAVVLSVGGGGLLSGVVEGLKRNGWGDVPVLAVETEGAASLHAAMQAGHSVELERIASVATSLGAKRVADQALMCVQQHPVHSHLVSDRAALEACERFLLDHRVLVEPACGAALAVAYDAKALGALRNVLVVVCGGATATLEQIQAWLQQAD

SEQ ID NO: 53293 - DNA, 1053 bp, Pseudomonas putida KT2440
  CDS (1)..(1053)
ttgctgtttgtggaatattattctatggtggacaaattatccacgcgcctgcaaggacccgtcatgccagccaccccgtccgttgatgcccagttccttgatacattgcaccaaaacattcaggacgcccacgcggcgctccgcccggccgtcagcattaccccgctcttgcacagccctcgtttgtcggcactgaccggctgtgaagtgctgctcaaatgcgaacacctgcagcacaccggttcgttcaagtttcgcggtgccagcaacaagatgcgcctgttgccggccgaggcacgcaagcagggggtgatagccgcctcatccggtaaccatgggcaggccctggccctggccggcaagatggctggcgtgccagtgaaggtctacaccaccacgggcgcatcggcatacaaaacagaggcaatgcgcgcgctgggcgccgaagtggtctgcctgcccaccgacccgctgagtgcagagctggaagcagccaggcaagccaaggcccagggcgtacctttcgtgtcaccttacaacgacctgcaagtcattgccggccagggcaccataggcatggagttgctcgagcaggcgccagacctggacgcggtgttcgtcgccgtgggcggtggcgggatgatttccggcatcggcgccgccctgcgcgtactcaagccgggcactgagatcatcggctgctggccggcgaatgacccaaccctgcagcaatcactcaaggccggtgaaatcatcgaattggatgcctgcgaaacgctgtcggatggcacggccggcggcgtcgagccaggctccatcaccttcccgctttgccaggcgctgctcaccgataccgtgttggtcagcgaggatgaaatccgctgcgccatgcgcgacatcgccagcagtgagcgctggatcatcgaaggcgctgctgcggttgcggtcgccggcatgcagaggctcgccgaacgctatcagggcaagcgtgtcgccgtgatcctgtgtggccgtaacatcctgctggaaaagttcctcgaggccgttcaatga

SEQ ID NO: 53294 - protein, 350 aa, Pseudomonas putida KT2440
MLFVEYYSMVDKLSTRLQGPVMPATPSVDAQFLDTLHQNIQDAHAALRPAVSITPLLHSPRLSALTGCEVLLKCEHLQHTGSFKFRGASNKMRLLPAEARKQGVIAASSGNHGQALALAGKMAGVPVKVYTTTGASAYKTEAMRALGAEVVCLPTDPLSAELEAARQAKAQGVPFVSPYNDLQVIAGQGTIGMELLEQAPDLDAVFVAVGGGGMISGIGAALRVLKPGTEIIGCWPANDPTLQQSLKAGEIIELDACETLSDGTAGGVEPGSITFPLCQALLTDTVLVSEDEIRCAMRDIASSERWIIEGAAAVAVAGMQRLAERYQGKRVAVILCGRNILLEKFLEAVQ

SEQ ID NO: 53295 - DNA, 1593 bp, Pseudomonas putida KT2440
  CDS (1)..(1593)
ttgggcaacgtaaaaatagccaaggagtcatcgatgaccagcttcagtgtccctcgtactaccgtcaccccccagcaactgctgtcggagcaggtgcgtcgcattcttgcggcgccggtgtacgacctggccattgaaacgcccctgcaagcggccccggccttgtctgccgccctgggcaaccaggtgttgctcaagcgcgaagacctgcagcctacgttttcgttcaagatccggggtgcctacacccgcctgtcgcgactgaccgatgtgcagcgtgagcgcggggtgatcaccgcttcggcgggcaaccatgcccagggcgtggccttggccgcatcgcatctgggtatgaaggcaaccatcgtcatgcccaccaccacgccatcgttgaaagtggaaggcgtgcgttcgcgcggcgggcatgtggtgctgcatggcgagagcttcccgcatgcgctgacccacgcactgaagctggccgacagcgaaggcgcgaccttcgtgccaccgttcgatgacccggatgtgatcgccgggcagggtaccgtggccatggaaatcctccgtcagcgccctggggcgttggacgcgatctttgtgcccgtgggcggtggcggcttgatcgccgggatcgccgcctatgtgaagtacctgcgccctgacgtgaaggtgatcggtgtcgagccggcagattccaactgcctgcaggctgccatggccgtcggcgagcgcgtgatcctgccgcaggtgggcacctttgccgacggcgtggcggtggcgcagatcggcgcccattgcttcgagctgtgccgccacttcgtcgacgaggtggtgacggtgagcagtgacgagctgtgcgcggcgatcaaggatatctacgacgacacccgttcgatcaccgagccgtccggggccttggccgtggccggtatcaagaagtacgtggcgcgtgaaggtgtgcaggggcagaccctggtggccatcgactccggggccaacgtcaatttcgaccgcttgcgccatgtggccgagcgggccgagctgggtgagcagcgcgaggcgatcatcgccgtgacgattccggagcagccgggcagcttccgggccttttgccacgcactgggcaagcggcagatcaccgaattcaactaccgcttctaccccgggaaggaggcgcgcctgttcgtgggcgtgcagacccacccggtgcacgacccacgtgagcagttgctggccagcttgcgggagcaggggtacagcgtgctggacctgaccgacaacgagctggccaagctgcatgtgcgccataccgtcggcggacatgccgcgtcaggggctgatgagcgggtactgcgcttcgagttccccgaacggccaggggcgttgctggggtttctggagcggttgggcaagcgttggaacatcagcctgttccattaccgcaaccatggtgcggcggaggcgcgggtgttcgctgccttggaagtgccagcggacgagttggcgggcttgccgtcgacgctggacgagatggggtaccggtactgggacgagactgacaacccggcgtacaagctgttcctgggctga

SEQ ID NO: 53296 - protein, 530 aa, Pseudomonas putida KT2440
MGNVKIAKESSMTSFSVPRTTVTPQQLLSEQVRRILAAPVYDLAIETPLQAAPALSAALGNQVLLKREDLQPTFSFKIRGAYTRLSRLTDVQRERGVITASAGNHAQGVALAASHLGMKATIVMPTTTPSLKVEGVRSRGGHVVLHGESFPHALTHALKLADSEGATFVPPFDDPDVIAGQGTVAMEILRQRPGALDAIFVPVGGGGLIAGIAAYVKYLRPDVKVIGVEPADSNCLQAAMAVGERVILPQVGTFADGVAVAQIGAHCFELCRHFVDEVVTVSSDELCAAIKDIYDDTRSITEPSGALAVAGIKKYVAREGVQGQTLVAIDSGANVNFDRLRHVAERAELGEQREAIIAVTIPEQPGSFRAFCHALGKRQITEFNYRFYPGKEARLFVGVQTHPVHDPREQLLASLREQGYSVLDLTDNELAKLHVRHTVGGHAASGADERVLRFEFPERPGALLGFLERLGKRWNISLFHYRNHGAAEARVFAALEVPADELAGLPSTLDEMGYRYWDETDNPAYKLFLG

SEQ ID NO: 53297 - DNA, 1275 bp, Staphylococcus epidermidis ATCC 12228
  CDS (1)..(1275)
atgacagtgacagtaagaactaaagtttcgacaaaagatatagatgaagcatatttacgtctaaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgccaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggcactttagctaaggaaatattaaatcaagctgaaaaagaggataaaacatttgattatgtatttgctgctataggtggtggcggtcttatttcaggagtgagcacatattttaaagcacattccccccatactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggatgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgtcaatgatgtcctcggacctcaagacgatattacaaaatttgaatatttaaagaaaacatcacaaaacactggaactgttattataggtatacagctgaaacatcatgatgatctcattcagttaaaagatcgcgtatgtcaatttgatccttctaatatttatatcaatgaaaataaaatgttatattcattacttatttaa

SEQ ID NO: 53298 - protein, 424 aa, Staphylococcus epidermidis ATCC 12228
MTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 53299 - DNA, 1245 bp, Bradyrhizobium japonicum USDA 110
  CDS (1)..(1245)
atggctgacttgtcccaaaccacgtcctccgatctcagcggccttccggtcgcgcctggtgacattcaggcagccgccgagaccatccgcggtgccgtcgtcgagacgccctgcagctacagccgcacgctgagcaacatctgcggctgtgacatctggctcaaattcgagaacctccagttcacctcctcgttcaaggagcgcggcgcgctcaaccgcctcaccgcgctgacgccggaggagcgtatgcgcggcgtcatcgccatgtcggcgggcaaccacgcgcagggcgtcgcctatcacgccaggcggctcggcattcccgccaccatcgtgatgccggtcggcacgcccatggtgaagatcgagaacacgaagcaccacggcgcggaggtggtggtgacgggcgcgacgctggaggaggcggccgcgtttgcgcgcagccacggtgaagctcacggcatgatcttcgtccacccttacgacgatccgcttgtgatcgcggggcagggcaccgtcgggctggagatgttgaaggcggtgccggagctcgacacgctggttgtcccgatcggcggtggcggcctgatcagcgggatcggcattgccgcgaaatcgatcaagccatcgctgcggattcttggcgtcgaggcctggctctatccctcgatgtacaacgccatccatgacggcaatctgccggcgcgcggcgatacgctcgccgagggcatcgcggtgaagtcgcccggcaagatcacgactgaaatcgtccggcgcctcgtcgacgacatcgcgctggtcaacgaggccgagctcgagcgcgcggtcgcgaccctgatctcgatcgagaagacggtcgtcgagggcgccggcgccgccggccttgccgcgctgatgtccgacccgtcccgctttgccggccagaaggtcggcctggtgctgagcggcggcaatatcgacacgcggttgatcgcctccgtcctgacccgcgaactggcgcgcgagggacggttgacccagttgtccctcgacattcctgaccggcccgggcagctggcggcggtggctgcgctgctggccgaggctggcgccaacatcatcgaggtctcgcatcagcggaccttctccgacctgccggccaaggcgacgctactgcaactcgtgatcgagacccgcgacagcgcccatctcgacgaggtcatggcgaggctcagtgcttccggcttgagcgcgcgctgcacctga

SEQ ID NO: 53300 - protein, 414 aa, Bradyrhizobium japonicum USDA 110
MADLSQTTSSDLSGLPVAPGDIQAAAETIRGAVVETPCSYSRTLSNICGCDIWLKFENLQFTSSFKERGALNRLTALTPEERMRGVIAMSAGNHAQGVAYHARRLGIPATIVMPVGTPMVKIENTKHHGAEVVVTGATLEEAAAFARSHGEAHGMIFVHPYDDPLVIAGQGTVGLEMLKAVPELDTLVVPIGGGGLISGIGIAAKSIKPSLRILGVEAWLYPSMYNAIHDGNLPARGDTLAEGIAVKSPGKITTEIVRRLVDDIALVNEAELERAVATLISIEKTVVEGAGAAGLAALMSDPSRFAGQKVGLVLSGGNIDTRLIASVLTRELAREGRLTQLSLDIPDRPGQLAAVAALLAEAGANIIEVSHQRTFSDLPAKATLLQLVIETRDSAHLDEVMARLSASGLSARCT

SEQ ID NO: 53301 - DNA, 1005 bp, Bradyrhizobium japonicum USDA 110
  CDS (1)..(1005)
atgggcgcgataaggttgagtatgaccgaacagccccttccgatcggccccgccgatatcgatgccgcagcacgcgtgatcgcgcccttcgccatccgcaccccgctgttgtcctttcccgtgctcaacgagcgcgtcggcgcaaaagtgttcctgaagccggagatgctccagcgcaccggctccttcaagttccgtggcgccttcaacaaggtcgcctcgatcccgcaggacaagcgcgccggcggcgtcgtggccttctcctccggcaaccatgcccagggcgtggcggccgcggccaagatcctcgacatgcaggcgaccatcgtgatgcccgcggacgcgccgctgtccaagcgcgagcgcaccaagtcctacggcgccgaggtcgtgctgtacgaccgcgatcgcgacgaccgcgaggcgatctcgcgcggcatcgccgagaagcgcggcgcgacgctggtcaggccgtatgacgatcccttcgtgatcgctggccaaggcaccgccggccgggagatcgcggacgacatggcaacgctgggccttagccccgacatcgtggtggcacccgcctccggcggcggcctgatcgccggcgtcgcgaccgcgatcaaggcgcgatatccgctggcgcaggtcgtggttgccgagccggaggcgttcgacgatcacggcatttcgctgactgcaggccatcgcgagccgcatgggccggcaggccgcaccatctgcgacgcgctgatggcgctgatccccggcgagatgacatttgcgatcaacagcaagctgctcgcgcgcggcgtcaccgcatccgacaaggaagtcggtgcggcggtggcgttcgcctatcgcgagctgaagctggtggtggagccgggaggggccgtcggccttgccgcgctgctcgcggggcgtctcgacgtcgccggcaagaacgtcgtcatcgtcctctccggcggcaatgtcgatgccgatctgttcgccgagctcgtggcctga

SEQ ID NO: 53302 - protein, 334 aa, Bradyrhizobium japonicum USDA 110
MGAIRLSMTEQPLPIGPADIDAAARVIAPFAIRTPLLSFPVLNERVGAKVFLKPEMLQRTGSFKFRGAFNKVASIPQDKRAGGVVAFSSGNHAQGVAAAAKILDMQATIVMPADAPLSKRERTKSYGAEVVLYDRDRDDREAISRGIAEKRGATLVRPYDDPFVIAGQGTAGREIADDMATLGLSPDIVVAPASGGGLIAGVATAIKARYPLAQVVVAEPEAFDDHGISLTAGHREPHGPAGRTICDALMALIPGEMTFAINSKLLARGVTASDKEVGAAVAFAYRELKLVVEPGGAVGLAALLAGRLDVAGKNVVIVLSGGNVDADLFAELVA

SEQ ID NO: 53303 - DNA, 1053 bp, Xylella fastidiosa Temecula1
  CDS (1)..(1053)
atggatatacctgatgtagggcacacagttgtcaagcaacccaatgcaagtaacgtcaataccgtgagtgtggccgatgtgttggctgcacaagcccgcttacgtcgttatctaatgcctactccaattcactatgccgagcgtttcggagtgatgctgaagttagaaaatctgcaacgcaccggatcctataaagtgcgcggcgcactgaacgcaatgttagttgcgctggaacgcggcgataaccgccctgtcatttgcgcatcagccggtaaccacgcccaaggcgtagcttggtcagcttaccggcttggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 53304 - protein, 350 aa, Xylella fastidiosa Temecula1
MDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 53305 - DNA, 1218 bp, Clostridium tetani E88
  CDS (1)..(1218)
atgactatgggattaaaacttggagatgtaaagcaagcgcaaaataatattaaaaaggttgtaagaagaacacccttggtatactcatcaacttttacaaaattaactggatataatatttatattaagtgtgaaaacaagcaaaagacaggtgcttttaaattaagaggagcttataataaaatagtaagtcttaacgaagaagaaaagaaaaaaggggttatagcatcgtcagcgggtaatcacgcacaaggtgttgcctatgcagcatctgcttttggtataaattctacaatagttatgcccgttacagcaccattagctaaagttaatgctacaaaaggttatggtgccaaggtaattcaatgtggagaagtctatgatgaatgttatataaaagcacttcaaacgcaaaaagaaaatgggtatacattcatacatccttttgatgatgaacaggttatagcaggacagggtactataggattagaaatattagaagatatggaagatgtagatgctatagtagtaccagtgggtggaggaggcttaatatcaggaatagcactagctgcaaaatctattaaaccaaatgttaagataataggagtgcaaccatctattatagcttcctctaaagtatccttagagaagggaaaggttaccacattacctggagttaagtccttagcagatggtatatctgttagtactccaggagaaataacatttaaatatatgaatgaatatgtagatgatatagtaaccgtttcagaagatgaaattgcatatagtgtattttgtttattagaaagagggaaacttttagcagaaggtgctggagcggcagctatggcagctatattaagtgataagattaatataaagggtaagaatatagtatctctcataagtggagggaatattgatatagcaacggtttctaaaataatagacagagaacttataagacttagaagaagactaagatttatagtagaaattaaagatagaataggacagttaagtagcataataacagaaattgtatccacgggagccaatgtagtaaaattaaggcaagatactaattggaataaaaaaggattggactatgtaaatgttatgtttgaaatcgaagttcagacagtagaacaatcacaagaacttatagatgctttaacaaagaaaggatacaaactagaaataatatcatag

SEQ ID NO: 53306 - protein, 405 aa, Clostridium tetani E88
MTMGLKLGDVKQAQNNIKKVVRRTPLVYSSTFTKLTGYNIYIKCENKQKTGAFKLRGAYNKIVSLNEEEKKKGVIASSAGNHAQGVAYAASAFGINSTIVMPVTAPLAKVNATKGYGAKVIQCGEVYDECYIKALQTQKENGYTFIHPFDDEQVIAGQGTIGLEILEDMEDVDAIVVPVGGGGLISGIALAAKSIKPNVKIIGVQPSIIASSKVSLEKGKVTTLPGVKSLADGISVSTPGEITFKYMNEYVDDIVTVSEDEIAYSVFCLLERGKLLAEGAGAAAMAAILSDKINIKGKNIVSLISGGNIDIATVSKIIDRELIRLRRRLRFIVEIKDRIGQLSSIITEIVSTGANVVKLRQDTNWNKKGLDYVNVMFEIEVQTVEQSQELIDALTKKGYKLEIIS

SEQ ID NO: 53307 - DNA, 1284 bp, Tropheryma whipplei str. Twist
  CDS (1)..(1284)
gtgcgccacggtatcgttcttgaggattttcgcgcggccgcgaaagtaatgcacagcaagttcgttgtgcatactccggtcatacagtctgttatgctgtcagaccttgtcgggtctcccgtttattttaagtgtgaaaacctgcaaataacaggatcctacaagataagaggggtgttcaattatcttcacaacctcaaaaaaagatcgactgctgtcgttgccgcaagcgctgggaatcatgcacagagcgtggcctatgctgcaaaacaaataggtatcaaggcagttatttttatgccaagcagtgttagtctgccaaagtacaacgcaaccaaaaaatacggtgcggaaattattctagatcagggtgatattcaaaccctcatactcaaggcaagacggtatgcaaaaaaacataagttcgtttttatcccgccatttgatcaccgcgatattgttgtcggccagggcacaattgccctcgaactgttagagcaggttcctgatctaagaacggtagttgtgccaactggcggcggaggactcgtggctggtattgcctctgccgttaccctggcgcagaatcccagcggaacgatcttcacaaaaagtggcttagaacagccggccaagtctggcatacgggtggttggcgttcaagcaaaaacatcggcgtcttttatagaatcgatggttgcaggaaagccagtgaaggtaaatataacctcacatttcgcagatgggatagcggttccaaaacccggaaagataacattcgaactcgcgagatgtttcgttgacaggtttgtcgaagttggtgatcacgaaattgcaggcgccatactcaccctgcttgaagactcaaaaataatagttgaacctgccgctgccagtgctgccgcagctgttctaagtaaaaaaatcacaaatctgaaagggtcaacagtgattgttttgagtggcggtaatatcgacccaatgactttgagccagataattctccgggggctatcactcaggtctcggaggctaaccttacgggcacaactcaaagatgtgcccgggcagctggctgaattttcaagagttgttgcaaaagccgaggctaatgttgttgctgtcaatcattcacgtggtaactacacggatgacaatggtcgcatctccttcggtgatgtctttatggacatcgaccttgaaacccgtggccacgagcattctcagagtattgtccgtgcccttcgagattccgggtttgtagttgaagttctgggattgtaa

SEQ ID NO: 53308 - protein, 427 aa, Tropheryma whipplei str. Twist
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLILKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 53309 - DNA, 1284 bp, Tropheryma whipplei TW08/27
  CDS (1)..(1284)
gtgcgccacggtatcgttcttgaggattttcgcgcggccgcgaaagtaatgcacagcaagttcgttgtgcatactccggtcatacagtctgttatgctgtcagaccttgtcgggtctcccgtttattttaagtgtgaaaacctgcaaataacaggatcctacaagataagaggggtgttcaattatcttcacaacctcaaaaaaagatcgactgctgtcgttgccgcaagcgctgggaatcatgcacagagcgtggcctatgctgcaaaacaaataggtatcaaggcagttatttttatgccaagcagtgttagtctgccaaagtacaacgcaaccaaaaaatacggtgcggaaattattctagatcagggtgatattcaaaccctcatattcaaggcaagacggtatgcaaaaaaacataagttcgtttttatcccgccatttgatcaccgcgatattgttgtcggccagggcacaattgccctcgaactgttagagcaggttcctgatctaagaacggtagttgtgccaactggcggcggaggactcgtggctggtattgcctctgccgttaccctggcgcagaatcccagcggaacgatcttcacaaaaagtggcttagaacagccggccaagtctggcatacgggtggttggcgttcaagcaaaaacatcggcgtcttttatagaatcgatggttgcaggaaagccagtgaaggtaaatataacctcacatttcgcagatgggatagcggttccaaaacccggaaagataacattcgaactcgcgagatgtttcgttgacaggtttgtcgaagttggtgatcacgaaattgcaggcgccatactcaccctgcttgaagactcaaaaataatagttgaacctgccgctgccagtgctgccgcagctgttctaagtaaaaaaatcacaaatctgaaagggtcaacagtgattgttttgagtggcggtaatatcgacccaatgactttgagccagataattctccgggggctatcactcaggtctcggaggctaaccttacgggcacaactcaaagatgtgcccgggcagctggctgaattttcaagagttgttgcaaaagccgaggctaatgttgttgctgtcaatcattcacgtggtaactacacggatgacaatggtcgcatctccttcggtgatgtctttatggacatcgaccttgaaacccgtggccacgagcattctcagagtattgtccgtgcccttcgagattccgggtttgtagttgaagttctgggattgtaa

SEQ ID NO: 53310 - protein, 427 aa, Tropheryma whipplei TW08/27
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLIFKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 53311 - DNA, 1524 bp, Pseudomonas syringae pv. tomato str. DC3000
  CDS (1)..(1524)
atgaccgatctgctcaatcactacgcccgcaaaatcctcacctcgcgcgtctacgacgtagcggtcgaaaccccgctgcatggcgcccgccagctgtccgagcggctgggcaatcaggtgctgctcaagcgcgaagatttgcagccggtgttctccttcaagattcgcggcgcgtacaacaagctcgcccaattgaccgcagaagaggccgcacgcggcgtggtcacggcctcggcgggcaatcacgcccagggcctggcgctggcggcgaaagagctgggcattctggccaccatcgtcatgccgcgcaccaccccggaaatcaaggtcgaaggggtgcgttcccgcggtgccacggtggtgttgcacggcgattccttccctgaagcgctggcctattcgctgaaactggtcgagcaacaaggcttcgtctacatccatccgtatgacgaccccgacaccattgccgggcaaggcactgtggcgatggaaatcctccgtcagcagccggggaagctggacgcgatctttgtgccggtcggtggcggcggcttgattgcagggattgcagcgtacgtgaaatacctgcggcctgagatcaaggtcatcggcgtcgagcccgacgactccaactgcctgcaagcggcgatggcggcgggcgagcgcgtggtgttgagccaggtcgggctgtttgccgatggcgtggcggtggcgcagatcggttatcacacctttgaagtgtgccgtcattacgtcgatgaagtgatcaccgtcagcaccgacgaaatctgcgcggcgatcaaggacatctacgacgacacccgctcgatcaccgagcctgcgggtgcgctgggtgttgcaggcatcaagaagtacgtcgagcagcgcggcgtgaccggccagacgctggtggccatcgactccggcgccaacgtcaactttgaccgcctgcgccacgtggccgagcgtgccgaactgggcgaaggccgcgaggcgatcattgccgtgaccattcccgagcagccgggcagcttcaaggcgttctgcgaagccatcggcaagcgccagatcactgaattcaactaccgctaccacaccgaccgtgaagcccatatcttcgtcggcgtgcagactcacccggagaacgacccacgcagcgcgctggtcgccagtctcaccgggcagggttttccggtgctggacctgaccgacaacgaactggccaaactgcacatccgccacatggttggcgggcatgccgagcgggtcaacgatgaggtggtgttgcgtttcgagttcccggagaggccgggcgcgctgttcaacttcctcaaccggctgggcgggcgctggaccatctcgatgttccactaccgcaaccacggggcagcggatggccgggtggtggcgggtctggtggtgcccgaggaagagcggcacctggtaggcgcggcgctggacgagattggttatcggtattgggacgagagcgagaacccggcgtatcggctgtttttgggctga

SEQ ID NO: 53312 - protein, 507 aa, Pseudomonas syringae pv. tomato str. DC3000
MTDLLNHYARKILTSRVYDVAVETPLHGARQLSERLGNQVLLKREDLQPVFSFKIRGAYNKLAQLTAEEAARGVVTASAGNHAQGLALAAKELGILATIVMPRTTPEIKVEGVRSRGATVVLHGDSFPEALAYSLKLVEQQGFVYIHPYDDPDTIAGQGTVAMEILRQQPGKLDAIFVPVGGGGLIAGIAAYVKYLRPEIKVIGVEPDDSNCLQAAMAAGERVVLSQVGLFADGVAVAQIGYHTFEVCRHYVDEVITVSTDEICAAIKDIYDDTRSITEPAGALGVAGIKKYVEQRGVTGQTLVAIDSGANVNFDRLRHVAERAELGEGREAIIAVTIPEQPGSFKAFCEAIGKRQITEFNYRYHTDREAHIFVGVQTHPENDPRSALVASLTGQGFPVLDLTDNELAKLHIRHMVGGHAERVNDEVVLRFEFPERPGALFNFLNRLGGRWTISMFHYRNHGAADGRVVAGLVVPEEERHLVGAALDEIGYRYWDESENPAYRLFLG

SEQ ID NO: 53313 - DNA, 1548 bp, Vibrio parahaemolyticus RIMD 2210633
  CDS (1)..(1548)
atgatggaatctcaacccgaaaaaaaagcgaatcaatctggcgcagactatctgcgccaaatccttcgcgcacctgtttatgaagtcgcaacagtaacgccgctgcaagaaatgcctcgtttatcggcacgtatcgggaataacgtgcagatcaagcgtgaagaccgccaacccgtacactcgttcaaactgcgcggtgcctacaatatggtggcaagcctaactgaagcacagaaagccgcgggggtgattgcagcatcggcaggcaaccacgctcaaggcatggcactgtctggcagcaagctaggtatcaaaaccacgattgttatgccaaaaaccacaccagacatcaaagtcgatgcggtacgcagtttcggtggcaatgtggtgttgcacggcaacaactttgatgaagccaaagccgaggccgaacgcttgtcagaacaacacggttatacgttcgtgcctcctttcgaccacccgttggtgatcgcaggtcaaggcaccatcggcatggaaatgctgcagcaaaatggtcatctcgactacatcttcgtgccagttggaggcggtggcttggccgctggtgtagcggttctggtcaagcaactgatgccagaaatcaaagtcatcgccgtcgaacctgaagactcgtcttgtctgaaagcggcgcttgatgctggtgaacctgtcgtactagaccaagtcagcatgtttgctgatggtgtggcggtaaaacgcatcggtgaagaaacgttccgcttgtgtcagaaatacattgatggtcatgtggcggtttcaagcgatgaaatctgcgctgccgtaaaagacatttttgaggatactcgagcgattgctgaaccatccggggcgcttgcgcttgctggcttgaagaagtttgttgagcaaaaccaactggaaaataagaaccttgccacggtgctgtctggcgcgaataccaactttcatggtttacgctatgtttcagagcgttgtgaattaggtgagaagcgtgaaggtctattagccgtgacgattccagaacgccaaggcgctttctttgaattctgtaatctgattggcggccgcgctgtcaccgagtttaactaccgttacaacgatgatgaactggcgaatatctttgttggtgtacgcctgcaaggcggtcaggaagagctggataacatcattcgcgatctacgcgaaggtggctacccagtcgtggatttgtccgacgatgaaatggccaaactgcacattcgttacatgatcggtggcaagccctcgaaacaactgaaagagcgtctctatagctttgaatttcctgagtatccaggcgcactattgaagttcttaagcacgcttggcacccattggaacatcagcctattcaactaccgcaaccacggcgccgactacggacgtgttctgtgtggtttcgagttagatgaaagcgatttagcccaattttcagcgcatttacgagaacttggctaccaatgtaaggatgaaaccgataatccatcctacaagtttttcttgtcttaa

SEQ ID NO: 53314 - protein, 515 aa, Vibrio parahaemolyticus RIMD 2210633
MMESQPEKKANQSGADYLRQILRAPVYEVATVTPLQEMPRLSARIGNNVQIKREDRQPVHSFKLRGAYNMVASLTEAQKAAGVIAASAGNHAQGMALSGSKLGIKTTIVMPKTTPDIKVDAVRSFGGNVVLHGNNFDEAKAEAERLSEQHGYTFVPPFDHPLVIAGQGTIGMEMLQQNGHLDYIFVPVGGGGLAAGVAVLVKQLMPEIKVIAVEPEDSSCLKAALDAGEPVVLDQVSMFADGVAVKRIGEETFRLCQKYIDGHVAVSSDEICAAVKDIFEDTRAIAEPSGALALAGLKKFVEQNQLENKNLATVLSGANTNFHGLRYVSERCELGEKREGLLAVTIPERQGAFFEFCNLIGGRAVTEFNYRYNDDELANIFVGVRLQGGQEELDNIIRDLREGGYPVVDLSDDEMAKLHIRYMIGGKPSKQLKERLYSFEFPEYPGALLKFLSTLGTHWNISLFNYRNHGADYGRVLCGFELDESDLAQFSAHLRELGYQCKDETDNPSYKFFLS

SEQ ID NO: 53315 - DNA, 1545 bp, Salmonella enterica subsp. enterica serovar Typhi Ty2
  CDS (1)..(1545)
atggcggaatctcaacctctgtcagtcgcgccggaaggggcggagtatctgcgcgcggtgctacgcgcgccagtatacgaagcggcgcaggtgacgccgctgcaaaaaatggaaaagctctcgtcacgtctggacaacgttattctcgtcaaacgcgaagaccggcagccggtacatagctttaagctgcgcggcgcttacgcgatgatggccggattgaccgaagaacaaaaagcccacggcgtgattaccgcgtcggcggggaaccatgcacagggcgtggcgttctcctccgcgcggcttggcgtgaagtctctgatcgtcatgccaaaagcaacggcggatattaaagtcgatgcggtacgcggttttggcggcgaagtgctgttgcacggcgctaattttgatgaagcgaaagcgaaagctattgagctggcgcagcagcagggttttacctgggtgccgccgtttgatcacccaatggtgatcgccgggcagggcacgctggcgctggaactgcttcagcaggattcgcatctcgatcgtgtctttgtgccggttggcggcggcggcctggcggcgggcgtagcggtactgatcaaacaattgatgccgcaaatcaaagtgattgccgtcgaagcggaggattccgcctgcctgaaagcggcgttggaagccggtcatccagtggatctcccgcgcgttgggttatttgctgaaggcgtggcggtaaaacgcatcggcgacgaaaccttccgcctgtgccaggaatatctcgacgacattattacagtcgatagcgacgcgatctgcgcggcgatgaaagacctgtttgaagatgtgcgtgcggtggcggagccgtccggcgcgctggcgctggcggggatgaaaaaatatatcgcccagcacaatattcgcggcgaacgcctggcgcacgtcctttccggcgccaacgtcaacttccacggcttgcgctatgtgtctgaacgctgcgagctgggggaacagcgcgaagcgttactggcggtgaccattccggaagaaaaggggagcttcctcaaattctgccagttgcttggcgggcgtatggtcaccgaatttaactaccgttttgccgacgcgaaacatgcctgtatttttgtcggcgtacgcgtcagtcaggggctggaggaacgaaaagagattatcacccaactgtgcgacggcggttatagcgtagtggatctctccgacgatgaaatggcgaagctgcatgtgcgctatatggtcggcgggcgcccctccaagccattacaggagcgtttgtatagtttcgaatttccggagtcgcccggcgcgttgctcaaattccttcatacgcttggcacgcactggaatatttcgctattccattaccgcagccacggtaccgattatggccgcgtgctggcggcgttcgagttaggcgatcatgagccggatttcgaaacccggctgcatgaactgggctatgaatgccatgatgagagcaataacccggcgttccggttctttctggcgggttaa

SEQ ID NO: 53316 - protein, 514 aa, Salmonella enterica subsp. enterica serovar Typhi Ty2
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKHACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 53317 - DNA, 1056 bp, Enterococcus faecalis V583
  CDS (1)..(1056)
atgtatgaaggtttgttaaaacagtatcaagcgtatttgcccgtaacagaaaaaacaccaatgatttctttagccgaaggaaatacgccactgattcctttacctaatttatccaaagaattaggtattcaattatatggaaaatacgaaggcttaaatcccactggctcattcaaagatcgcgggatggtgatggctgtagcaaaagcggtagaagaaggtgccaaagcgattgtttgtgcttctacaggaaatactagtgccgccgctgctgcgtatgccacaagagcaggcattaaagcgtatgtagtgattccagaagggaaaatcgcactgggaaaattggcgcaagctattatgtatggggcggacattatttcgattccaggtaactttgatgaagcattaaaagcggtgcgagagattgcgaaaactgaggcagttgcgctagttaattcagtgaatccttatcgcttagaagggcaaaaaacagcagcttttgaagtttgtgaacaattaggtcaagcgcccgatgtcttagcgattccagttggaaatgccggcaatatttccgcttactggaaaggctttaaagaatggcatgaaaaacaaggaacaactttaccaagaatgcatggttttgaagcagaaggtgccgcagcgatcgtgaaaggccaagtgattgagcaacctgaaaccgtggcaacagcgatccggattgggaatcctgctagttggcaattagcagaacaggcacgggatgaatccggtggtttcattgatgccgtgacagatcaagaaattttaacggcttaccgaaaaattgctgctcaagatggggttttcattgaacctggttcggctgcttcattagctggagttattcaacatgttaaaagcggtaaaatcaaagcaggtgaaaccgtcgtggcagtctttactggtaacggactgaaagatcctgatacagcaatggagacagaagtagctatttcaaaaatgagtgacgtggaagaaatgcgtctgcacttacgaaaaggagtcgcaacactatga

SEQ ID NO: 53318 - protein, 351 aa, Enterococcus faecalis V583
MYEGLLKQYQAYLPVTEKTPMISLAEGNTPLIPLPNLSKELGIQLYGKYEGLNPTGSFKDRGMVMAVAKAVEEGAKAIVCASTGNTSAAAAAYATRAGIKAYVVIPEGKIALGKLAQAIMYGADIISIPGNFDEALKAVREIAKTEAVALVNSVNPYRLEGQKTAAFEVCEQLGQAPDVLAIPVGNAGNISAYWKGFKEWHEKQGTTLPRMHGFEAEGAAAIVKGQVIEQPETVATAIRIGNPASWQLAEQARDESGGFIDAVTDQEILTAYRKIAAQDGVFIEPGSAASLAGVIQHVKSGKIKAGETVVAVFTGNGLKDPDTAMETEVAISKMSDVEEMRLHLRKGVATL

SEQ ID NO: 53319 - DNA, 1059 bp, Bacillus cereus ATCC 14579
  CDS (1)..(1059)
atgtataaaggactattgaaacaatatgcttcttatttaccggtgaatgaaaacacacctgatgtcagtttaatggaaggaaatacacctcttattccgttattaaatatatcaaagcaattagggattcagctatatggtaagtacgaaggagcgaatccgacaggttcttttaaagatcgtggtatggtgatggcagttgctaaggcgaaagaagaaggttcagaagcaatcatttgtgcatcaacaggtaatacatcagcatcagctgcagcatatgcggcacgtcttgggatgaaatgtataatcgtaatccctgaaggaaagattgcgcatggaaaattagcgcaagcggtcgcttatggagctgaaattatttcaatagaagggaatttcgatgatgcacttaaggctgtaagaaatattgctgcagaagagccgattacattagtaaattcagtgaatccttatcgaattgaaggacaaaaaacggcagcatttgaaatttgtgaccaattgcaaaatgcaccagatgttctagctatccctgttgggaacgcagggaatattacagcatattggaaaggtttctgtgaatatgagaaagaaaaaggttataagaagccaagaattcatggttttgaagcagaaggagcagctgcaattgtaaaagggcatgtaattgaagaacctgaaacaattgcaacagcgattcgcatcggtaacccagcaagttggtcgtatgcagtagaggctgccgagcagtcttgtggtgaaatagatatggtatcagatgaagaaattttacatgcgtataggttattagcaaaaactgaaggagttttcgctgaaccaggatcaaatgcttcattagctggcgtaattaaacatgttaaatctggaaaaatcaaaaagggagaaacagttgttgcagtattaactggaaatggtttgaaggatcctgatatcgctatttcttcaaatcaactagacatcgcaagtttgtcaaatgatatagaacagattaaagatcatattaaaggggtgattatgtcgtga

SEQ ID NO: 53320 - protein, 352 aa, Bacillus cereus ATCC 14579
MYKGLLKQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQNAPDVLAIPVGNAGNITAYWKGFCEYEKEKGYKKPRIHGFEAEGAAAIVKGHVIEEPETIATAIRIGNPASWSYAVEAAEQSCGEIDMVSDEEILHAYRLLAKTEGVFAEPGSNASLAGVIKHVKSGKIKKGETVVAVLTGNGLKDPDIAISSNQLDIASLSNDIEQIKDHIKGVIMS

SEQ ID NO: 53321 - DNA, 1002 bp, Bacillus cereus ATCC 14579
  CDS (1)..(1002)
atgataactagaaaactaccattacatatagacgatattaaaaaagctcacaaaattctagatagaaatgctcgtaaaacgccattagtaaaatctttttacttgactagtaaaacgggtggagaaattcatttgaaattagaaaatatgcaattaacgggttcttttaaatttcgtggcgcatttaataaaatgtcgcggctcacggatcaagaaaaagaaagaggtgtaattgcatgttcagcaggtaatcatgcacaaggagttgcattatctgctcatttactcggtattaagagtaaaattgttatgccaatttctgcacctcaggcaaaagttgaagcaacaaaaggatatggatctgaagtgattttacatggtgaaacctttgatgatgcaaaggtaaaatgtgaagaaattataagggaaacaggtgaaacatacttacatccatatgatgatgtagaggtaatggctggtcaaggtacaattggattagacattcttgatgatatgtgggatgtagatactgtcattgtaccaataggtggaggcggaattatttctggtatttctgtagcattgaaatcttttaatccatccattaatataattggtgtccaagcagataatgttcatggaatgaaggcatcttacgataaaggagcaatcgtagaacactatgaggcgcctactattgcagatggttgcgcagttaaaataccaggtgaattaacatttgaaattgtaaaagaattagtagatgatattgtaactgtatcagaaaaagagctggaagtagcgatgaaagatttattacaacgtgggaaagctgttgtagaaggtgcaggtgcattagcaactgctgcacttcttgcaggaaaagttgatagttatataaaagggaaaaaagtagtggctgttatatctggtgggaacgtggacttacagcgcatatcaagtgtatgtgagcacttttttgtcgctaatgaagtgaaatag

SEQ ID NO: 53322 - protein, 333 aa, Bacillus cereus ATCC 14579
MITRKLPLHIDDIKKAHKILDRNARKTPLVKSFYLTSKTGGEIHLKLENMQLTGSFKFRGAFNKMSRLTDQEKERGVIACSAGNHAQGVALSAHLLGIKSKIVMPISAPQAKVEATKGYGSEVILHGETFDDAKVKCEEIIRETGETYLHPYDDVEVMAGQGTIGLDILDDMWDVDTVIVPIGGGGIISGISVALKSFNPSINIIGVQADNVHGMKASYDKGAIVEHYEAPTIADGCAVKIPGELTFEIVKELVDDIVTVSEKELEVAMKDLLQRGKAVVEGAGALATAALLAGKVDSYIKGKKVVAVISGGNVDLQRISSVCEHFFVANEVK

SEQ ID NO: 53323 - DNA, 1512 bp, Nitrosomonas europaea ATCC 19718
  CDS (1)..(1512)
atggtaaatgattatctcgaaaggatactgactgcgcatgtctatgacgttgccagcgagacgccccttgatttcgctccgtcattatctgctcgtatccataaccgcgtattgctcaaaagagaggacatgcagcgggttttttccttcaagctgcgcggcgcctataacaaaatggccaggctctccccggatgtactgcaacagggtgtggtggccgcttcagcgggtaatcatgcacagggggtggcactggccgcacaaaagctgggctgttctgccaccatcgtgatgccggccaccacaccgcaaatcaaaatcaatgcggtgatggcaatgggtgcagccgtgctgctgcaaggagattcctataatgatgcctacgaatatgcacggaatctcgccgaagaaaaagaagctgaatttgtccatccttacgacgatcccgatgtaattgccggacagggcacgattgccatggaaattctgcgccagcatccgggcaggattcacgcaatttttgtaccgatcggtggcggagggctgatttcaggcattgccgcgtatgtgaaacggttgcgaccggatatcaaggtgatcggagtggagccggttgattcaaatgccatgtaccgctccctgcaggcaggctatcgtgtcgaactctcccaggtggggctgtttgcggatggcgtggctgtccgcctggtaggcgaggaaaccttccggctgtgccgtgagctggtggatgacatcatcctggtggattcggatgccatttgtgcagcgatcaaggatattttcgaggatacacgctccatcgttgaaccttcgggagcactttcaattgccgggttgaaggcatacgtcaaacaaaaaaacttgctgcacgaagtcctggttgcgattgcttccggcgcgaacatgaattttgaccgtttgcgtcatgtttctgaacgggcagaacttggtgagcagcgcgaagctatcctcgcagtcacgatccctgaaaaaccgggcagcttcaaaaaattctgcaatctgctgggcgctcgtaatatcactgaattcaattaccgctatgcggaccccgagatggcgcatgtctttgtcggtgtatcagtgcgcaatcgggaggaatcgttacatttgatcgagattctgcaggaaaacggtttgaaaaccgaagacatgaccgataacgaaatggccaaactgcatatccgtcacatggtgggcgggcgcagcagagaagtcatgcatgaaattttgtatcgcttcgaattccctgatcgcccgggtgcactcatgaattttctgaatcacatgagcgaccactggaacatcagcctgtttcactatcgtaatcatggtgccgatttcggccgtgtgctgatcggtatacaagttccgccggaagaaaaacaggaattcagggagttcctcgataaactgggctacagcttctgggatgaaaatgacaacccggcttaccagctttttctcgcctga

SEQ ID NO: 53324 - protein, 503 aa, Nitrosomonas europaea ATCC 19718
MVNDYLERILTAHVYDVASETPLDFAPSLSARIHNRVLLKREDMQRVFSFKLRGAYNKMARLSPDVLQQGVVAASAGNHAQGVALAAQKLGCSATIVMPATTPQIKINAVMAMGAAVLLQGDSYNDAYEYARNLAEEKEAEFVHPYDDPDVIAGQGTIAMEILRQHPGRIHAIFVPIGGGGLISGIAAYVKRLRPDIKVIGVEPVDSNAMYRSLQAGYRVELSQVGLFADGVAVRLVGEETFRLCRELVDDIILVDSDAICAAIKDIFEDTRSIVEPSGALSIAGLKAYVKQKNLLHEVLVAIASGANMNFDRLRHVSERAELGEQREAILAVTIPEKPGSFKKFCNLLGARNITEFNYRYADPEMAHVFVGVSVRNREESLHLIEILQENGLKTEDMTDNEMAKLHIRHMVGGRSREVMHEILYRFEFPDRPGALMNFLNHMSDHWNISLFHYRNHGADFGRVLIGIQVPPEEKQEFREFLDKLGYSFWDENDNPAYQLFLA

SEQ ID NO: 53325 - DNA, 1002 bp, Bacillus anthracis str. Ames
  CDS (1)..(1002)
atgataactaaaaaactaccattacatatagacgatattaaaaaagctcaaagcattctggatagaaatgctcgtaaaactccattagtaaaatcattttatttgactagtaaaacgggtggagaaattcacttgaaattagaaaacatgcaattaacaggttcgtttaaattccgtggtgcgtttaataaaatgtcacagctgacagatcaagaaaaagaaagaggagtaattgcttgttctgctggtaatcatgcgcaaggaattgctttatctgctcatttacttggtattaagagtaaaattgttatgccgatttctgcaccgcaggcgaaagttgatgcgactaaaggatatggatctgaagtagttttacatggtgaaacctttgatgatgcgaaggcaaaatgtgaggagattattagggaaacaggtgaaacatacttacatccatatgacgatgtagaagtaatggcaggtcaaggtacaataggattagatattcttgatgatatgtgggatgttgatacggtcattgtaccaattggtggaggaggaattatttctggaattgctgtcgcattaaaatcttttaatccgtcgattcatataattggtgtgcaagcagaaaatgttcatgggatgaaggcatcttatgacaaaggcaaaattatagaacattatgaggcacctacgatagcagatggttgcgcggtaaaaatacctggcaatttaacttttgaagttgtaaaagaattagtagatgatattgtaacggtatcagaaaaagagctggaagtagcgatgaaagacttattacaacgcgggaaagctgttgtagaaggtgcaggcgcattagctactgctgctctacttgcagggaaagtggatacatatattaaagagaaaaaagtagtagcagttatatctggtgggaacgtagacttacagcgcatatcgagtgtttgtgaacaattttttgtggcgaatgaagtggaatag

SEQ ID NO: 53326 - protein, 333 aa, Bacillus anthracis str. Ames
MITKKLPLHIDDIKKAQSILDRNARKTPLVKSFYLTSKTGGEIHLKLENMQLTGSFKFRGAFNKMSQLTDQEKERGVIACSAGNHAQGIALSAHLLGIKSKIVMPISAPQAKVDATKGYGSEVVLHGETFDDAKAKCEEIIRETGETYLHPYDDVEVMAGQGTIGLDILDDMWDVDTVIVPIGGGGIISGIAVALKSFNPSIHIIGVQAENVHGMKASYDKGKIIEHYEAPTIADGCAVKIPGNLTFEVVKELVDDIVTVSEKELEVAMKDLLQRGKAVVEGAGALATAALLAGKVDTYIKEKKVVAVISGGNVDLQRISSVCEQFFVANEVE

SEQ ID NO: 53327 - DNA, 1227 bp, Helicobacter hepaticus ATCC 51449
  CDS (1)..(1227)
atgaaaaagcagatatatgaaaaagtaataaaagccaagcaacgtttagaaaatgtgattattccctcgcctttaagctatgcacctatgctctctcttttagctcaagctgatatttatcttaaaaaagagaatctgcaactgacgggagcatttaagattcgtggagcgttcaataaaattgcctctttggttgaacaatctactcattcccaaatacagggcgttatcgctgcaagtgctgggaatcacgcgcaaggtgttgcctatgctgcaaagcattttggtataaaagccgtgattgtaatgcccgaagctactcctttacttaaggtaagtgcgacaaaagctcttggtgcggaagtggttttaagtggagataattatgatgaagcctatgctaaagctttgcaggttgctaaagagcgtgatttagtgtttattcacccttttgctgacgaggaggtgattgcagggcagggcagtattgcgcttgagatgatacaagaatgtgaggatttaaatgtagtagttgtgcctattggtggaggtggtttgattagtggtatagggagtgtgtataagcaactatatccgaatgtaagagttataggtgtagtggcaagtggtgcagacgctatgaaacgctcttttgagagtggtgctatccaaaaaatagaatctgtgcggagcattgctgatggtatagctgtgcgtgatgttaatgaggagaattttgcgcttgtgcaagaatgtgttgatgaaatagtgagcgtagatgatgaagaaattgcaaatgctattttatttttgattgaaaaacaaaaacttgttgttgagggtgcaggagcagcgagtgtagcaagtattttgcacaaaaagtttgcacttacaaagcaagataaagtagcacttgtgctaagtggaggaaatattgatattactttgcttaatgttattattgaaaaaggtttattgaaatctaatcggaagatgaagcttgaagtcgtgctcatagataagcccggtagtttgcaagggctaacaaatattttaagtaaagtgggtgcaaatatcgttcagattgaatatgataggacttctgttatgcttaaatatggagatgcacttgtaacaatggcattagagacaaaaaatgaagaacacaaagtgctcattcgcgagcaacttcaacattatggttatcattttaatgagattaattag

SEQ ID NO: 53328 - protein, 408 aa, Helicobacter hepaticus ATCC 51449
MKKQIYEKVIKAKQRLENVIIPSPLSYAPMLSLLAQADIYLKKENLQLTGAFKIRGAFNKIASLVEQSTHSQIQGVIAASAGNHAQGVAYAAKHFGIKAVIVMPEATPLLKVSATKALGAEVVLSGDNYDEAYAKALQVAKERDLVFIHPFADEEVIAGQGSIALEMIQECEDLNVVVVPIGGGGLISGIGSVYKQLYPNVRVIGVVASGADAMKRSFESGAIQKIESVRSIADGIAVRDVNEENFALVQECVDEIVSVDDEEIANAILFLIEKQKLVVEGAGAASVASILHKKFALTKQDKVALVLSGGNIDITLLNVIIEKGLLKSNRKMKLEVVLIDKPGSLQGLTNILSKVGANIVQIEYDRTSVMLKYGDALVTMALETKNEEHKVLIREQLQHYGYHFNEIN

SEQ ID NO: 53329 - DNA, 1248 bp, Rhodopirellula baltica SH 1
  CDS (1)..(1248)
atgtcccctctgatcgccgccgacaaaattgaagcggctcgcaagcgaatcgccaaagtggttcgccacacgccattgatgcgaaacgctcggctctctgcactttatgatgcggagattttgctcaaacgtgaggacttgcaggaagttcgcagctacaaaattcgtggcgcgtacaaccggatgtcgcaactcagtgatgcacaacgtgccgcgggagtcgtttgcgctagtgccggaaatcacgcgcaaggattcgcctacgcctgccatgccatggggattcaggggcgagtttttatgccggcggtcacgccgaagcaaaaggtcgacaaagtcaagctgtttggacaggaacacgttgaggtcatcttgattggtgacacctttgacgacgccgccgcggaggctcatcgcgcagctgaggaaggcctgacgtacattcctccgtttgatgatcccgcgatcattgagggacaaggcaccgttggtgctgaaattttagaggaccattccgagccaattgatatggtgctcgttgccgtcggtggcggcggtctgatctcgggattgggcagcatcttcaaacagctttcaccgaaaacgaagatcatcggcattgaacccaccggtgcaccagcgatgcatgatagccttcgagcaggcgaggtgatcacgctggaaaagatcgacaacttcgttgatggagccgcggtcaggcgtgtcggagatttgaatttcaagatcgctcaacatgtgattgacgaaatgattttggtgccggaaggaaaggtgtgcagcgtgatgttgcagctctacaacgacgaaggtttggtcgtggaaccggctggcgcgttgtcgatcgccgcactggaccagctcgcatccgaaatttgcggcaaaactgttgtctgcgttgtcggcggaagcaacaacgacatcactcgcaccgaagaaattcgtgaccgagcaatgttgtacgaaggtttgcagcactacttcatcatcaagtttccgcagcgagccggggctttgcgagagttcctcaacaatgtgcttgggccaaccgacgacatcacacactttgagtacacacgaaagcacaatcgcgaaaccgggccggcgctcgttggtttgcaggtcgcccaccgcgacgactaccaaggcttgctcgaccggatggccgccagcaatatcgaataccaagtcgtcaacgaacaacgcatgctgttcgagttgttggtgtaa

SEQ ID NO: 53330 - protein, 415 aa, Rhodopirellula baltica SH 1
MSPLIAADKIEAARKRIAKVVRHTPLMRNARLSALYDAEILLKREDLQEVRSYKIRGAYNRMSQLSDAQRAAGVVCASAGNHAQGFAYACHAMGIQGRVFMPAVTPKQKVDKVKLFGQEHVEVILIGDTFDDAAAEAHRAAEEGLTYIPPFDDPAIIEGQGTVGAEILEDHSEPIDMVLVAVGGGGLISGLGSIFKQLSPKTKIIGIEPTGAPAMHDSLRAGEVITLEKIDNFVDGAAVRRVGDLNFKIAQHVIDEMILVPEGKVCSVMLQLYNDEGLVVEPAGALSIAALDQLASEICGKTVVCVVGGSNNDITRTEEIRDRAMLYEGLQHYFIIKFPQRAGALREFLNNVLGPTDDITHFEYTRKHNRETGPALVGLQVAHRDDYQGLLDRMAASNIEYQVVNEQRMLFELLV

SEQ ID NO: 53331 - DNA, 1545 bp, Candidatus Blochmannia floridanus
  CDS (1)..(1545)
atgatgaagaagtatcaggaatcattttcttgtcaggaaatgtgtccatcagagtatttgaaaattgctttgcattctcatgtatatgaagttgcacaagttactccgttgcaggtgatgcataagttatcgagtagacttaaaaatatagtgttagttaaacgtgaagatagacagccagtacatagttttaagttacgtggggcttatgctatgctttcgaatcttaccgaaaaacaacaatcgtctggggtaatcacagcttctgccggtaatcatgcccaaggagtggcattttcagctagtcatttaggaattagttctgtagttgtaatgcctgtgaatacggctgatataaaaattgatgcagtacgtcattttggaggaaaaccattgttgtttggatcaaattttgatgaagctaaagttaaagctatttatttagctgataagaattgtttgacttttattcctccttttgatcatccgtttgttattgcaggtcaaggtactgtggcgatggagttattacaacaagattcgcatttagatcgtatttttgtgccagtaggcggaggtggattagcagcaggtattgctgtattaattaaatatcttatgccaaaaattaaagttattggagtggaatcagaagaatcagcatctttatgtgcagctttggaagctgggtttccagtatatttaagtaaggtgggattatttgcagagggagtggcagtacgatgtataggtcatgaaacatttcgtttgtgtcaaaaatatcttgatgatgttattactgtagataatgattcaatttgtgctgcaataaaagatctatttgaagatgttcgagctatagctgaaccatcaggtgcgttagcgttagctggaatgaagaaatatattcagcgacatgcgatacatggagaaaaattagtacatgttctttccggggctaatattaattttcatgaattaagatatatttcagagcgttgtgaactaggagaacaaagagaggcgttaatggtagttactattccagaaaaaaaaggtagttttttagaattttttaaaattttagaagataaatcagtaacagaatttaattatcgttataatggatctaaaaatgtttgtgtatttattggtgtgcgtttacagaatggacgttgtgaacgagatagtatagtagaaaatattcttaatcatggatttcctgttgtagatttgtctgataatgaaatggctaaattacatgctagatatatggtgggatctcgttctttacagtcttttcgtgagcgaatttttagttttgagtttccagaagctccaggagcattattgaaatttttgaatactttaggaactgattggaatatttctttatttcattatcgtaatcatggtacggattatggtcgagttttagctggatttgaattatctcatcaggaactagaatttgatcagcatttatctaaattagggtatacatgtcatgatgtgactactaatccagtatttcaatttctttag

SEQ ID NO: 53332 - protein, 514 aa, Candidatus Blochmannia floridanus
MMKKYQESFSCQEMCPSEYLKIALHSHVYEVAQVTPLQVMHKLSSRLKNIVLVKREDRQPVHSFKLRGAYAMLSNLTEKQQSSGVITASAGNHAQGVAFSASHLGISSVVVMPVNTADIKIDAVRHFGGKPLLFGSNFDEAKVKAIYLADKNCLTFIPPFDHPFVIAGQGTVAMELLQQDSHLDRIFVPVGGGGLAAGIAVLIKYLMPKIKVIGVESEESASLCAALEAGFPVYLSKVGLFAEGVAVRCIGHETFRLCQKYLDDVITVDNDSICAAIKDLFEDVRAIAEPSGALALAGMKKYIQRHAIHGEKLVHVLSGANINFHELRYISERCELGEQREALMVVTIPEKKGSFLEFFKILEDKSVTEFNYRYNGSKNVCVFIGVRLQNGRCERDSIVENILNHGFPVVDLSDNEMAKLHARYMVGSRSLQSFRERIFSFEFPEAPGALLKFLNTLGTDWNISLFHYRNHGTDYGRVLAGFELSHQELEFDQHLSKLGYTCHDVTTNPVFQFL

SEQ ID NO: 53333 - DNA, 1581 bp, Bordetella parapertussis 12822
  CDS (1)..(1581)
atgtccgataccgccaccgccccgacgaccgccgagccgcgcaccgcgccgccggcgcgcgccgatctgcttgcccactacgcccgcaagacgctttccgcgccggtctacgacgtcgcgctggagacgccgctgcaagcggcgccgcgcctgtcgcgccagctggattgccgcgtgctgctcaagcgcgaagacctgcagccggtgttctcgttcaagatccgcggcgcctacaaccgcgtcgcgcagttgagcgccgaggagcgccgccgcggcgtcatcgccgcctcggccggcaaccatgcgcaagggctggcgctggccgccgcgcgcctgggcattccggcgctcatcgtcatgccgcgcaccgcgcccgagctgaagatcgacggcgtgctggcgcacggcgcgcaggtggcgctgcatggcgacgcctttccggcggcgctggcgcacgcgcaggcgctggctgaacgcgagggcagggtgttcatcccgccgtacgacgatcccgacgtgatcgccggccagggcacggtgggcatggagatcctgcgccagcatccgggccgcctggacgccattttcgtgccggtcggcggcggcagcctgatcgcgggcgtggccgcctacgtcaagcatgtgcgtccggagatccgcatcatcggcgtcgagccggtggattcgaactgcctgcaggccgcgctggcggcgggccggcgcgtggtgctcgaccgcgtgggcaccttcgccgacggcgtggcggtggcgcagatcggccatcacaatttcgagatctgccgcgaccatgtcgacgaggtgatctgcgtcaccaacgatgaaatctgcgccgccatcaaggacatctacgacgatacccgctccatcaccgaaccggccggcgcgctggcggtggcgggcctgcgcaagtacgccgagcgcggcgaggcggccgggcgcaccctggtggcgatcgactcgggcgccaacatcaacttcgaccgcctgcggcacgtggccgagcgcgccgcgctgggcgagcagcgcgaagccttgatcgcggtgaccatccccgagcggccgggcagctttaaggccttctgcgcggcattggggccgcgccagatcaccgaattcaactatcgctaccatcccggcgacgaggcgcagatcttcgtcggggtgcggacccatcccgagcacgaccggcgcgatgcgctgctggccgggctgcgcggccagggcttcgcggtgcaggacctcagcgacgacgaactggccaagctgcacgtgcgccacatggtgggcgggcgcgccaaccagatcgacgacgagcaggtgttccgcttcgagttccccgagcgtcccggcgcgctgttcgacttcctgagcaaactgggcggccgctggaacatcaccatgttccactaccgcaaccacggctcggccgacggccgcgtggtggccggcctgcaggtgccggccgacgagcgccacctggtgccgcaggcattgacgcgcatcggctatccgttccgggacgagacggccaatccctcgtatcgcctgttcatccggtga

SEQ ID NO: 53334 - protein, 526 aa, Bordetella parapertussis 12822
MSDTATAPTTAEPRTAPPARADLLAHYARKTLSAPVYDVALETPLQAAPRLSRQLDCRVLLKREDLQPVFSFKIRGAYNRVAQLSAEERRRGVIAASAGNHAQGLALAAARLGIPALIVMPRTAPELKIDGVLAHGAQVALHGDAFPAALAHAQALAEREGRVFIPPYDDPDVIAGQGTVGMEILRQHPGRLDAIFVPVGGGSLIAGVAAYVKHVRPEIRIIGVEPVDSNCLQAALAAGRRVVLDRVGTFADGVAVAQIGHHNFEICRDHVDEVICVTNDEICAAIKDIYDDTRSITEPAGALAVAGLRKYAERGEAAGRTLVAIDSGANINFDRLRHVAERAALGEQREALIAVTIPERPGSFKAFCAALGPRQITEFNYRYHPGDEAQIFVGVRTHPEHDRRDALLAGLRGQGFAVQDLSDDELAKLHVRHMVGGRANQIDDEQVFRFEFPERPGALFDFLSKLGGRWNITMFHYRNHGSADGRVVAGLQVPADERHLVPQALTRIGYPFRDETANPSYRLFIR

SEQ ID NO: 53335 - DNA, 1218 bp, Bordetella parapertussis 12822
  CDS (1)..(1218)
gtgatcgatcttgccgccatccagaccgcccgggacatcctgcggggacaggtcctcaatacgccgttcacgcattcccgcacgctgtccgatatcctcggcgccgaaatctggctgaagttcgagaacctgcagttcaccgcctcgttcaaggagcgcggcgccctcaaccggatgctcaacctgaccgaggccgagcgcgccgccggcgtgatcgccgtgtcggccggcaaccatgcccagggcgtggcgtaccacgcgcagcgcatgggcgtgccggcggtgatcgtcatgccgcgcttcactcccacggtcaaggtggccaacacgcggcgcttcggcgccgaagtcgtcctggccggcgacaccttcgacgacgccaaggcgcgcggctacgaactggcgcgcgagcgcggcctggtcatgatccatccctacgacgatccagccgtgattgccgggcagggtacggtggcgctcgaaatgctgcaggcgcgcccagacctggacgccatcgtggtgggcatcggcggcggcggcctgatcgcgggcatcgccaccgccgccaaggccatcaagccggacatcgagatcatcggcgtgcagaccgagcgctttccgtccatgtacgccgccgtcaagggcgtggccatggaaagcggccactacacgatcgccgagggcatcgccgtcaagtcacccggcacgctgacccaggagatcgtcacgcgcctggtcgaccacatcgagctggtcaacgaaagcgatatcgagcatgccatcgtggtcctgctggaaatcgagaagaccgtggtcgaaggggccggcgcggccggcctggcggcgctgctgcggctgcaggaacgccgcgacgagcggttccgcggcaagcggctggggctggtgctcacgggcggcaacatcgatcccctgatgctgggcgagctgatcgagcgcggtatggtgcgcgccgggcgcctggcgcgcatccgggtcgacctgcgcgacctgccgggcgcgctggcgcaggccaccaagctgatcgccgacgcgcacgccaacattaccgaggtgcatcaccagcgcgccttcaccaccttgccagtgcgcaatgtcgaggtcgatttcgtgctgcagacgcgtggccatgaccacatccaggaagtcatcgcggtgctcaatgccgcgggcttcgcggccagcaaccacgatcactga

SEQ ID NO: 53336 - protein, 405 aa, Bordetella parapertussis 12822
MIDLAAIQTARDILRGQVLNTPFTHSRTLSDILGAEIWLKFENLQFTASFKERGALNRMLNLTEAERAAGVIAVSAGNHAQGVAYHAQRMGVPAVIVMPRFTPTVKVANTRRFGAEVVLAGDTFDDAKARGYELARERGLVMIHPYDDPAVIAGQGTVALEMLQARPDLDAIVVGIGGGGLIAGIATAAKAIKPDIEIIGVQTERFPSMYAAVKGVAMESGHYTIAEGIAVKSPGTLTQEIVTRLVDHIELVNESDIEHAIVVLLEIEKTVVEGAGAAGLAALLRLQERRDERFRGKRLGLVLTGGNIDPLMLGELIERGMVRAGRLARIRVDLRDLPGALAQATKLIADAHANITEVHHQRAFTTLPVRNVEVDFVLQTRGHDHIQEVIAVLNAAGFAASNHDH

SEQ ID NO: 53337 - DNA, 969 bp, Bordetella parapertussis 12822
  CDS (1)..(969)
atgcagccccaattgcccacttatgccgacgtcgaacaggcggccgccacgctggctggcgtggcgcatcgcacccccgtgctgacctcggccaccgccgacgccatggcgggcgcgcaggtctttttcaagtgcgagaacttccagcgcatgggggcgttcaagttccgcggcggctacaacgccatcgcccgcctgacgcccgaacagcgccgcgccggcgtggtgacgttttcgtcgggcaaccatgcccaggccatcgccctggccgcgcgcctgcagggcgtgcaggccaccatcatcatgccgcaggacgcgccggcggccaagcgcgcggccaccgagggctacggcggccggatcgtcacctacgaccgctacagcgaggaccgcgaggccatcgcgcgccggctgcaggaagaaaccggcgccacgctgatcccgccctatgaccacgccgacgtgatcgccgggcaggggaccgccgccaaggaactgttcgacgaggtcggcgaactcgactacctgttcgtgtgcctgggcggcggcggactgctggcgggctcggccctggcggcgcgggccctcagcccggcctgccgcgtctacggcgtcgagccggcggccggcaacgacagccagcactccttgcgcaagggcgagatcgtcaccatcgccgcccccaagtcgatcgccgacggcgcggtcacgacgcacctgggccggctgaccttcgccatcatccagcagcaggtggcggacatcctgaccgtcagcgatgccgaactggtgcaaagcatgaggttcttcgccgagcgcatgaaaatggtggtcgaacccaccggctgcctggccgccaccgccgcgttgcgcaaactcatccccgaggcggccggcaagcgcgtcggcgtcatcatcagcggcggcaacgtcgacctgccggtctacgcgcgcctgctggccgactga

SEQ ID NO: 53338 - protein, 322 aa, Bordetella parapertussis 12822
MQPQLPTYADVEQAAATLAGVAHRTPVLTSATADAMAGAQVFFKCENFQRMGAFKFRGGYNAIARLTPEQRRAGVVTFSSGNHAQAIALAARLQGVQATIIMPQDAPAAKRAATEGYGGRIVTYDRYSEDREAIARRLQEETGATLIPPYDHADVIAGQGTAAKELFDEVGELDYLFVCLGGGGLLAGSALAARALSPACRVYGVEPAAGNDSQHSLRKGEIVTIAAPKSIADGAVTTHLGRLTFAIIQQQVADILTVSDAELVQSMRFFAERMKMVVEPTGCLAATAALRKLIPEAAGKRVGVIISGGNVDLPVYARLLAD

SEQ ID NO: 53339 - DNA, 987 bp, Bordetella bronchiseptica RB50
  CDS (1)..(987)
atgctcgacgtgacctccgacacctccgccgtacccgacagttccgccatcgcctacctgcacgcccagctgcagcgctgggtgcgcgccacgccgatcctggagaaaaccgatttcgagccggtggccggcatcgcggtgtgcttcaagttcgaactgctgcaggccagcggcaccttcaaggcgcgcggcgccttctcccacctgctggcgctggacgacgcgcaacgccaggccggcgcgacctgcgtctcggccggcaaccatgccgtggccgtcgcctacgcggccatgcggctgggcctgtcggccaaggtagtcatgatcaagaccgccagcccggcgcgcgtggcgctgtgccgccagtacggcgccgaggtcgtcctggccgacgacggcccgcaggccttcgagacggtgcgccgcatcgagaacgaggaaggccgctacttcgtgcatccgttcaatggctaccgcacggtgctgggcaccgccacgctgggccacgaatggctgcagcaggccggcgagctcgatgcggtcatcgtgcccgtcggcggcggcgggctgatctcgggcgtggccaccgcgatcaagctggccgcaccgcaatgccaggtcatcggcgtcgaacccgaaggcgccgacgccatgcaccgcagcttcgcggccggcggcccgatcaggatgggcccgatgcacagcatcgccgacagcctgatggcgccgcacaccgagcagtacacctacgacctgtgccggcgccacgtcgaccggctggtcaaggtggacgaccacgcgctgcgcgccgccatgcggctgctgttcgaccagctcaagctggccaccgagccggcctgcgcggccgccaccgccgcgctggccgggcccttgcgcaacgacctggccggccggcgcgtgggcgtgctgctgtgcggcaccaacaccgatccggccaccttcgcgcgccacctgggcgcggactga

SEQ ID NO: 53340 - protein, 328 aa, Bordetella bronchiseptica RB50
MLDVTSDTSAVPDSSAIAYLHAQLQRWVRATPILEKTDFEPVAGIAVCFKFELLQASGTFKARGAFSHLLALDDAQRQAGATCVSAGNHAVAVAYAAMRLGLSAKVVMIKTASPARVALCRQYGAEVVLADDGPQAFETVRRIENEEGRYFVHPFNGYRTVLGTATLGHEWLQQAGELDAVIVPVGGGGLISGVATAIKLAAPQCQVIGVEPEGADAMHRSFAAGGPIRMGPMHSIADSLMAPHTEQYTYDLCRRHVDRLVKVDDHALRAAMRLLFDQLKLATEPACAAATAALAGPLRNDLAGRRVGVLLCGTNTDPATFARHLGAD

SEQ ID NO: 53341 - DNA, 1509 bp, Bordetella bronchiseptica RB50
  CDS (1)..(1509)
atgtccaccgactacctcaaacgcatcctgacctccaaggtctacgacgtcgccgtcgaatcgccgctggagcgcgcgcccctgctgtcgcagcgcatcgcgaacaacgtgctgctcaagcgcgaggacacccaggcggtattcagcttcaagctgcgcggcgcctacaacaagatggccaacctgacgccggcggcgcgcagccgcggcgtgatcgccgcctcggcgggcaatcatgcccagggcgtggccctggcggccaccaggctgggctgccgcgcggtcatcgtcatgcccaccaccagcccgcaggtcaaggtcgacgccgtgcgccggctcggcggcgaggtcgtgctggccggcgacagcttcaccgacgcctacgaacacgcgcagcagctggaaaagcgcgaaaagctgaccttcgtgcatcccttcgacgatcccgacgtgatcgccggccagggcaccatcggcatggaaatcctgcgccagcatccgggcgagatcgaggcgatcttcgtggccatcggcggcggcggcctgatcgccggcgtggccgcctacatcaagcagttgcggccggaaatcaagatcatcggcgtgcagaccgaagactccgacgccatggtccgcagcgtacgcgccggccggcgcgtgcagctcagcgatgtcggcctgttctcggacggcacggccgtcaagctggtgggcgccgaaacgttccggctggcgcgccagtacgtggacgacttcgtggtggtcaataccgacgcgatctgcgcggccatcaaggacgtgttccaggacacccgcagcgtgctggagcccgccggcgccatggcggtggccggcgccaagcagtacgcggccgagcacaagctcaagggcaagaccctggtggcggtggcatgcggcgccaacatgaatttcgaccggctgcgcttcgtggccgagcgcgccgaagtgggcgaaatgcgcgaggcggtgttcgccgtcaccatgcccgagcagcgcggcagcttccgccgcttctgcgagctggtcggcaaccgcagcgtcaccgagttcaactaccgcatctccgatgccgagcgtgcgcacgtcttcgtgggcgtgcaggtctccacgccggccgaaccggaaaagatcgccgccaacttccgccggcacggcttcgacaccctggacctgacgcacgacgaactggccaagacgcacctgcgccacatggtcggcggccattcggcgctggcgcgcaacgaactgctctaccgcttcgagttccccgagcgcccgggcgcgttgatgcgctttctcaacgccatgaaccccgactggaacatcagcctgttccactaccgcaaccagggcgccgactacggcaacatcctgatcggcatccaggttccgcccaccgacaagaaactgttcaagaccttcgtcgccgaactgggctacccgcactggaacgaaacggacaacccggcgtacaggctgttcctgtag

SEQ ID NO: 53342 - protein, 502 aa, Bordetella bronchiseptica RB50
MSTDYLKRILTSKVYDVAVESPLERAPLLSQRIANNVLLKREDTQAVFSFKLRGAYNKMANLTPAARSRGVIAASAGNHAQGVALAATRLGCRAVIVMPTTSPQVKVDAVRRLGGEVVLAGDSFTDAYEHAQQLEKREKLTFVHPFDDPDVIAGQGTIGMEILRQHPGEIEAIFVAIGGGGLIAGVAAYIKQLRPEIKIIGVQTEDSDAMVRSVRAGRRVQLSDVGLFSDGTAVKLVGAETFRLARQYVDDFVVVNTDAICAAIKDVFQDTRSVLEPAGAMAVAGAKQYAAEHKLKGKTLVAVACGANMNFDRLRFVAERAEVGEMREAVFAVTMPEQRGSFRRFCELVGNRSVTEFNYRISDAERAHVFVGVQVSTPAEPEKIAANFRRHGFDTLDLTHDELAKTHLRHMVGGHSALARNELLYRFEFPERPGALMRFLNAMNPDWNISLFHYRNQGADYGNILIGIQVPPTDKKLFKTFVAELGYPHWNETDNPAYRLFL

SEQ ID NO: 53343 - DNA, 1545 bp, Prochlorococcus marinus str. MIT 9313
  CDS (1)..(1545)
atggacgattatctacagaggattctgagggcacgtgtctatgacgtagcccatgaaacccccctggaactggccaaaaacctcagtcgccgttttcagaacaagatctggttgaaacgtgaggacctacagccagtcttctcattcaagctgcgtggtgcgtataaccgcatgtcccttctcagccaagaagagttgcagcgtggcgtgattgcttcaagtgctggaaaccacgctcagggagtggcactgagcgcctcttatctcaattgcagagctgtgattgtgatgcctatcaccacacccgaaatgaaggtacgggcagtccgtgctcttggcgctgaagtcgcacttcatggagagacctacgacgaggcctatcaagaggccatgcgtcgcagtgaaaaagatggactcacgtttatccacccgtttgatgatccagaggtgattgctgggcaagggacgattgctctagaaatcctgcgccagatccaagatccaccagatgcaatctatgtcgcagttggcggtggcggactgatcggagggattgccacctatgtcaaaagcttgtggccgcaagtcgaaattatcggtgtcgagccctacgacgctgcagcaatgaagctctctcttgaggctggtgaacgtattcagctgcccaatgttggcctatttgccgacggagtcgctgtacgtcaagtaggcaaactcaccttctcattagcccagatgcacgtagacgcgatggtgacggtaagcactgatgaaatctgtgcagcgatcaaagatgtttttgaagatacccgctcaattcttgaaccagctggcgcactggcaattgctggcatgaaggcagatatcgccaaacgtgatcttcaagaccgcactcttgtggccgtggcctgtggcgcaaacatgaactttgaacggcttcgttttgtcgccgaaagagcagagctaggggaagaaagggaagcaatactcgctgtggaaatcccagaacaggcaggcagcctgcgaaagctctgcaatgtccttgcagggaaaaatctcaccgaattcagttaccgaatggcagaaggggatagagcacaaatattcatcggggtacaggttttagacctggatgatcgaaccaagcttttaacgcgactgcagtcgtcaggattcgcatgccttgatctcagcaacgacgagctcaccaaagggcaccttcgtcacatggtgggtggtcggcttcctgcctcagccaaaaccctttgccgagatggatgtcgcgaactgctctatcgctttgagttccctgagcgaccaggagctcttatgacctttgttagtgcccttcaccctgaatggagtatcagcatcttccactaccgcaatcacggagcagatgtcggcaggatcgttgtaggtgtgttggttcaggacaacgaaatggacgattggcagcgctttcttgaagatctgggctacccaaactgggaagaaacaaacaaccccgcctactgcttatttctgggtgcacagaccgtttga

SEQ ID NO: 53344 - protein, 514 aa, Prochlorococcus marinus str. MIT 9313
MDDYLQRILRARVYDVAHETPLELAKNLSRRFQNKIWLKREDLQPVFSFKLRGAYNRMSLLSQEELQRGVIASSAGNHAQGVALSASYLNCRAVIVMPITTPEMKVRAVRALGAEVALHGETYDEAYQEAMRRSEKDGLTFIHPFDDPEVIAGQGTIALEILRQIQDPPDAIYVAVGGGGLIGGIATYVKSLWPQVEIIGVEPYDAAAMKLSLEAGERIQLPNVGLFADGVAVRQVGKLTFSLAQMHVDAMVTVSTDEICAAIKDVFEDTRSILEPAGALAIAGMKADIAKRDLQDRTLVAVACGANMNFERLRFVAERAELGEEREAILAVEIPEQAGSLRKLCNVLAGKNLTEFSYRMAEGDRAQIFIGVQVLDLDDRTKLLTRLQSSGFACLDLSNDELTKGHLRHMVGGRLPASAKTLCRDGCRELLYRFEFPERPGALMTFVSALHPEWSISIFHYRNHGADVGRIVVGVLVQDNEMDDWQRFLEDLGYPNWEETNNPAYCLFLGAQTV

SEQ ID NO: 53345 - DNA, 1530 bp, Synechococcus sp. WH 8102
  CDS (1)..(1530)
atgaccgactatctccagcggatcctgcgggctcgcgtctacgacgtcgcgcgggagacgccgcttgaccctgccccaaacctcagtcgccgacttggcaatgaggtgctgctgaagcgcgaagacctgcaaccggtgttctcgttcaagcttcgcggtgcttacaaccgcatggcccagctcacgccggaggaactcagtcgtggcgtgatcgcctccagcgcaggaaaccatgcccagggcgtggccctaagtgccaaaaaactcggctgccgcgccgtcatcgtgatgcccgccaccacacccgaggtgaaggtgcgggccgtgcgcaccattggcggggaagtcgtgctccatggggagacctacgacgaatgttcagcagaagcgagacaacgctgcgctgatgagggactcacctacatccatccctttgacgacccggaagtgatcgccggccagggaaccatcggtctggaaatcatgcggcagagccctgaaccgccggatgccatttatgtagcggtcggcggcggcggactaattgccggaatcgcggcttacgtcaaacagctgtggcccagcaccgagatcgtcggcgttgaaccggttgatgcggacgccatgacccagtcgttagagaagggagtacgggttgagctggcccaggtgggcctgttcgccgacggcgttgcggtccgcagggtgggggagcacacctttgccctggcccaacaatttgttgaccgcatggtgcgggtcgacaccgatgcgatctgtgccgccatcaaggacgtttttgaagacacgcgctccatcctcgaaccggctggagcacttgccgtggctgggctgaagcaggacgtggccgattgccaaatgacggaccgccgactggtggcggtggcctgcggcgccaacatgaacttcgatcgcctgaggttcatcgccgaacgctccgaactgggagaggaacgcgaggcgatgctggcggtggagatccctgagcaaccgggaagcctcagaaccctgtgtgatcacctacgcagccgcagcctcaccgaattcagttaccgaatgagtgagggcgcatcagcccacatcttcatcggcgtgcaggtgaacggcgcacaggatcgttaccagctcgtggatggactccagcagcagggcttctcctgtcttgacctcagcgacaacgaattgtccaaggttcacctccgccacatggttggcggtcgtcttccatccacttcgcaggacagttgcgctgggggctgcctcgaactgctgtaccgctttgaatttccagagaggccgggggcactgatgcgcttcgtcagcgctctcaatcccggttggagcatcagcatcttccactaccggaaccatggagctgacgtgggtcggatcgtggtgggtgtgctgataccggtggaagaacagccgcagtggacggccttcctcaatgagcttgggtatccctattggaatgaaaccgacaatccggcttacaccctgttcctctga

SEQ ID NO: 53346 - protein, 509 aa, Synechococcus sp. WH 8102
MTDYLQRILRARVYDVARETPLDPAPNLSRRLGNEVLLKREDLQPVFSFKLRGAYNRMAQLTPEELSRGVIASSAGNHAQGVALSAKKLGCRAVIVMPATTPEVKVRAVRTIGGEVVLHGETYDECSAEARQRCADEGLTYIHPFDDPEVIAGQGTIGLEIMRQSPEPPDAIYVAVGGGGLIAGIAAYVKQLWPSTEIVGVEPVDADAMTQSLEKGVRVELAQVGLFADGVAVRRVGEHTFALAQQFVDRMVRVDTDAICAAIKDVFEDTRSILEPAGALAVAGLKQDVADCQMTDRRLVAVACGANMNFDRLRFIAERSELGEEREAMLAVEIPEQPGSLRTLCDHLRSRSLTEFSYRMSEGASAHIFIGVQVNGAQDRYQLVDGLQQQGFSCLDLSDNELSKVHLRHMVGGRLPSTSQDSCAGGCLELLYRFEFPERPGALMRFVSALNPGWSISIFHYRNHGADVGRIVVGVLIPVEEQPQWTAFLNELGYPYWNETDNPAYTLFL

SEQ ID NO: 53347 - DNA, 1530 bp, Chromobacterium violaceum ATCC 12472
  CDS (1)..(1530)
atgagcaacaagcaagactatctggaacgcatcctcacctcgcgggtgtacgacgtggcggtggaaacgccgctggagctggcgcccaatctgtcgcgccgttaccgcaaccacatcctgctcaagcgcgaggatctgcagccagtgttctcgttcaagctgcgcggcgcttacaacaagatggccaagctgacgccggagcagcgcgcgcgcggcgtgatcaccgccagcgccggcaaccacgcccagggcgtggcgctgtcggccagcaagctcggctgcgaggcggtgatcgtgatgccggtcaccacgccgcagatcaagatagacgcggtgaagcagcgcggcggccaggtggtgctgtcgggagactccttcaacgaagcctacctgcatgcggtgaagctggccgaggagagcggccgcacctacatcccgcctttcgacgacccggacgtgatcgccggccaggggacggtgggcatggaaatcctgcgccagcatccggatgatctggatgccgtattcgtcgccatcggcggcggcggcctggcggccggcgtggccagcttcatcaaacggctgaagcccgagatcaagatcatcggcgtgcagcctgtcgactcggacgcgatgcgccagtccatagagaagggcgagcgggtcgagctgaaggatgtgggtttgttcgccgacggcgtggcggtgaagctggtgggcgaagagaccttccgcatctgccgcgagctgctggacgagatcatcctggtggattccgacgccatctgcgcggcgatcaaggatatttttgaagatacccgctccatcgtcgagccggccggcgcgctggcggtggcgggcgccaaggcctacatcgagcgcgagggctgcgagggccagtcgctggtggcgatctcctgcggcgccaacatgaatttcgaccgcctgcgccatgtctcggagcgatccgagctcggcgagcggcgcgaggccatcattgccgtcaccattccggagaagccgggcagctttaagcgcttctgttcggtgataggcggccgcaacatcaccgagttcaactaccgtttcgccgaccccagcgtcgcccatgtgttcgtcggcgtgcagatcgccggcaaggaggatgtggaaaagctgttgcgcgacttgcgcgcggcggagctggatggcatcgacctgaccgacaacgagctggccaagctgcacatccgccacttggtcggcggccacgcgccgcaactgaaggacgaacgcgtgctgcgcttcgagtttcccgaccgtcccggcgcgctgatgcgctttttggaggcgatgcgcaccgactggaacatcagcctgttccactaccgcaaccatggcgcggactatggccgggtgctggtcggcatccaggtgccgtccggcgacgcccaggcctttcagcaattcctcgacacgctcggatatccttatatagaggaaaccgaaaatccggcctatcgattgttccttggcaagaccatccgttga

SEQ ID NO: 53348 - protein, 509 aa, Chromobacterium violaceum ATCC 12472
MSNKQDYLERILTSRVYDVAVETPLELAPNLSRRYRNHILLKREDLQPVFSFKLRGAYNKMAKLTPEQRARGVITASAGNHAQGVALSASKLGCEAVIVMPVTTPQIKIDAVKQRGGQVVLSGDSFNEAYLHAVKLAEESGRTYIPPFDDPDVIAGQGTVGMEILRQHPDDLDAVFVAIGGGGLAAGVASFIKRLKPEIKIIGVQPVDSDAMRQSIEKGERVELKDVGLFADGVAVKLVGEETFRICRELLDEIILVDSDAICAAIKDIFEDTRSIVEPAGALAVAGAKAYIEREGCEGQSLVAISCGANMNFDRLRHVSERSELGERREAIIAVTIPEKPGSFKRFCSVIGGRNITEFNYRFADPSVAHVFVGVQIAGKEDVEKLLRDLRAAELDGIDLTDNELAKLHIRHLVGGHAPQLKDERVLRFEFPDRPGALMRFLEAMRTDWNISLFHYRNHGADYGRVLVGIQVPSGDAQAFQQFLDTLGYPYIEETENPAYRLFLGKTIR

SEQ ID NO: 53349 - DNA, 966 bp, Chromobacterium violaceum ATCC 12472
  CDS (1)..(966)
atgaatgacttgtaccagtacatactcgatgcccatcgggcattgcggccgcaggtcgccgtcacgcctctgagccacagcccggcattgtcggcgctgaccggctgcgaagtgtatttgaagtgcgagcacctgcagcacaccggctccttcaagttccgcggcgccagcaacaagatccggctgctggacgccgcgtcgcgccggctgggcgtggccacggtgtccagcggcaaccacggcctgggcgtggcgctggccggcaagctggccggcgtgccggtcacggtgtacgcgtcggccgcggcgtccgaggtgaagctggacgcgatccgcgcccacggcgcgaaggtggtcgtcatcgacgcgccaatgctggaagtggagctggaggccgcgcggctcgccgagcgggccgggctgcccttcgtctcgccgtacaacgacgtcgacgtcatcgccggccagggcacgatagggatggagctggccgagcagcatcccggcctggtggcggtgttcgcgtcggtgggcggcggcggcatgatttccggcatcggctccgcgctggagatgatgagcccgagtaccgagatcgtcggctgctggccgcgccattcccaggcgctgtaccagagcatgctggccggcgagatcgtcgaatacgaggagctggacaccatttccgacggcaccgccggcggcgtggagcccggcgccatcaccctgcccatcgcgcagcgggtgataggcaagaccgcgctggtggacgaggcggcgatcaaggcggcgatgcgcaagatcgccgaggccgagcgttggatcgtcgagggcgcggccggcgtcgcgatggcggggctgttccagctggccgaggcatatcgcggccggccggtggcggtggtgctgtgcggccgcaacatcaagctggagactttcctggaggcttgccatgaagctgcttga

SEQ ID NO: 53350 - protein, 321 aa, Chromobacterium violaceum ATCC 12472
MNDLYQYILDAHRALRPQVAVTPLSHSPALSALTGCEVYLKCEHLQHTGSFKFRGASNKIRLLDAASRRLGVATVSSGNHGLGVALAGKLAGVPVTVYASAAASEVKLDAIRAHGAKVVVIDAPMLEVELEAARLAERAGLPFVSPYNDVDVIAGQGTIGMELAEQHPGLVAVFASVGGGGMISGIGSALEMMSPSTEIVGCWPRHSQALYQSMLAGEIVEYEELDTISDGTAGGVEPGAITLPIAQRVIGKTALVDEAAIKAAMRKIAEAERWIVEGAAGVAMAGLFQLAEAYRGRPVAVVLCGRNIKLETFLEACHEAA

SEQ ID NO: 53351 - DNA, 1212 bp, Wolinella succinogenes DSM 1740
  CDS (1)..(1212)
atgattccattatctaaaatcgttgaggcgcatgagcgtgtcaaaaaagtgatccaaaaaaccaaactcgcctacgcgccaagactaagtgagttaagcggagccaatgtctatctcaaaaaagagaatctccaacacacgggcgcctacaagctaagaggcgcttataatagaatcgccaccctgagccaagaggagcgagccaagggagtgattgccgctagtgcggggaatcacgctcaaggagtggcctatagcgccaaacaatttgggattcgtgcggtgattgtgatgcctgaggcaactccattgcttaaagtcacgggtgtgaagcgcttgggggctgaggtgatcttagcgggcaacaactacgatgaggcctatgcccatgcactagagtgcgccaaggagcaggagctgtgctttatccacccttttgctgatgatgaggtgatcgcagggcaggggacggtggctttggagatgatcgaggagaagagcaacatccaaaccgtagtgcttcctatcgggggcggggggctcatctcgggcgtggcagcggcgtataagcagatgcttcccaatgtgagaatcattggtgtgacggccaagggagcgccagccatgcacgattctttccatgccaagaaaatcgtttctgtcaaaggcgtgaagacaatcgccgatggaatcgccgtcagagatgtcactcctagaaattttgagtacatcttagagggcgtggatgatgtggtgcaagtggatgatgaggagatcgctaacgcggtcttgtatctattagagaatcaaaagcttgttgttgaaggcgcaggagcggttggtgtggcggctttgttgcacgagaagttgcccgtgagcaagggtgagaatgtcgctatcgtgctaagcggcgggaatatcgatgtgacgatgctcagtgtcatcatcgagaagggtctcatcaaatcccagcgcaagatgaagtttagcgtcatcttggtggacaagcctggaagcctcaaagggctcacggatattctctcgcaagtgggggctaatattgtgcgaatcgactatgatcgcacctctacctctttggcttacggggatgccaatgtcactatcgcgctagagaccaaggggggagagcaccaggaggagattcgccaagagctctggaaatatcactatcgattcgtcgaaatcgattag

SEQ ID NO: 53352 - protein, 403 aa, Wolinella succinogenes DSM 1740
MIPLSKIVEAHERVKKVIQKTKLAYAPRLSELSGANVYLKKENLQHTGAYKLRGAYNRIATLSQEERAKGVIAASAGNHAQGVAYSAKQFGIRAVIVMPEATPLLKVTGVKRLGAEVILAGNNYDEAYAHALECAKEQELCFIHPFADDEVIAGQGTVALEMIEEKSNIQTVVLPIGGGGLISGVAAAYKQMLPNVRIIGVTAKGAPAMHDSFHAKKIVSVKGVKTIADGIAVRDVTPRNFEYILEGVDDVVQVDDEEIANAVLYLLENQKLVVEGAGAVGVAALLHEKLPVSKGENVAIVLSGGNIDVTMLSVIIEKGLIKSQRKMKFSVILVDKPGSLKGLTDILSQVGANIVRIDYDRTSTSLAYGDANVTIALETKGGEHQEEIRQELWKYHYRFVEID

SEQ ID NO: 53353 - DNA, 1188 bp, Gloeobacter violaceus PCC 7421
  CDS (1)..(1188)
atgtttgcttttatcagccatttgatttgcccgcgctgcgacagccgctttgatccgcgcaaagtccacaacctttgcactgcctgcgcttcgcctttgttggtcgagtacgacctcgaacaggtccgtgcctcggtggataaagagacgctcgcccgccgcggcgagtcgatgtggcgctaccgggaactgctgcccgtgatggacccggcccatatcgtgagcttcggcgaagggttcacaccactgctacccatcgacgcgctcacccgaacctggggattggagacagtctggatcaaagacgacgggctcaatcctaccggctccttcaaggcgcggggtgcctcctgcggcatctcgaaggctaaagaactcggtatccgggaggtggccctgcccacggcgggcaacgcgggcggtgcctgggcctgctacggggccgccgccggtttgcgcgtgcacgtggcgatgcccagggacgccccggccgtcaaccagctcgaatgccgtctgtacggcgcggatctgacattagtggacgggttgatttcggacgcgggaaaattgattgcccagggggtgcgcgagcatggctggttcgacgtctcgacgctcaaggagccttaccgcatcgagggcaagaagaccctgggtcttgaacttgccgagcagatgaactggcagttgcccgatgccatcctctacccggccgggggcggcgtcggaatcatcggcatctggcggggcttgcagcaattgaaagcgatgggctgggtgacgggaagtctgccccggctcattgtcgtgcaggcagaaggctgcgctccgctggtcaaggcgttcgaggagggccgcaccgagtccgaattctggccggatgcccggacttttgcctccggactgcgcgtacctaaggccctgggcgattttctggtgctgcaggcggtgcgcgagaccggcggcaccgccatcgccgtcagcgacgagcagtgcggcgagatgatgaaacttttggccggtcgcaccgggatatttgcagcaccggaaggagccgccaccctggctgccgccaaaatcctgcgcgagcgcggcgatctggcttcccgcgatcgggtggtgctcatcaacaccggctccgctctcaagtacccggaggcaatgagcgaggcactggcgatgcggtag

SEQ ID NO: 53354 - protein, 395 aa, Gloeobacter violaceus PCC 7421
MFAFISHLICPRCDSRFDPRKVHNLCTACASPLLVEYDLEQVRASVDKETLARRGESMWRYRELLPVMDPAHIVSFGEGFTPLLPIDALTRTWGLETVWIKDDGLNPTGSFKARGASCGISKAKELGIREVALPTAGNAGGAWACYGAAAGLRVHVAMPRDAPAVNQLECRLYGADLTLVDGLISDAGKLIAQGVREHGWFDVSTLKEPYRIEGKKTLGLELAEQMNWQLPDAILYPAGGGVGIIGIWRGLQQLKAMGWVTGSLPRLIVVQAEGCAPLVKAFEEGRTESEFWPDARTFASGLRVPKALGDFLVLQAVRETGGTAIAVSDEQCGEMMKLLAGRTGIFAAPEGAATLAAAKILRERGDLASRDRVVLINTGSALKYPEAMSEALAMR

SEQ ID NO: 53355 - DNA, 996 bp, Gloeobacter violaceus PCC 7421
  CDS (1)..(996)
atgtcctcatccgcccccactttgccggtgagtttcggcgatatccaggcggctgctgaccgtttgaggggagtcgctcaccgcacgccggttctgacttcgcgtacggtggacgacctgactggagcgcaggtcttcttcaagtgcgaaaatttccaacgcatgggggcgttcaagttccggggagcctacaatgccctctcgcaactggacaaagcgcaaaggcggcgcggggtgctcgcctactcctccggcaaccacgcccaggcgattgccctggcgggacaaatcctggagattccaacgacgatcgtgatgcccagcgacgctccggcggtcaagcggcgtgccaccgaaggttacggcggcgaggtgatcctttacgagcggtctgaaaccacccgcgaagccctcgccgaccaactggcgcgcgaacggggactggcggtgatcccgccctttgaccacccccaggtggtagcagggcagggaaccgccggattggaacttttcgagcaggtgggggcgctcgatgtgctcgtcgtctgctgcggcgggggcggcttgctctcaggatgcgccatcgccgcggcggccgtgagccccggttgtcaggtagtcggggtcgaacccgcgcaggcggacgatgcgatgcgctcgttttatacgggcgtcctgcacacagtccacaaccccgccacgatcgccgatggggcgcgcactccatcgctgggagccgtcacctttccactggtgcgccactacgttcatcagatggtgaccgtggaggaggaagcgatcgtgcgggcgatgctgtttttgtgggagcggctcaagatcgtcgtggagcccaccggtgcccttggggcggcagcccttttcgaaggccgggtgcaggcagcggacaggcgcgttggagtcattattagcggtggcaacgtcgatttgcagcttctccatgaattcatacgcgatatcgataaggggtacagttaa

SEQ ID NO: 53356 - protein, 331 aa, Gloeobacter violaceus PCC 7421
MSSSAPTLPVSFGDIQAAADRLRGVAHRTPVLTSRTVDDLTGAQVFFKCENFQRMGAFKFRGAYNALSQLDKAQRRRGVLAYSSGNHAQAIALAGQILEIPTTIVMPSDAPAVKRRATEGYGGEVILYERSETTREALADQLARERGLAVIPPFDHPQVVAGQGTAGLELFEQVGALDVLVVCCGGGGLLSGCAIAAAAVSPGCQVVGVEPAQADDAMRSFYTGVLHTVHNPATIADGARTPSLGAVTFPLVRHYVHQMVTVEEEAIVRAMLFLWERLKIVVEPTGALGAAALFEGRVQAADRRVGVIISGGNVDLQLLHEFIRDIDKGYS

SEQ ID NO: 53357 - DNA, 969 bp, Photorhabdus luminescens subsp. laumondii TTO1
  CDS (1)..(969)
atgaaaaatatttctgtttatgatgatgtcattgccgccgcccggcgaatagaagcttatgcttaccgtacgccagtcctgacttcccgcactgctaatgaaatgacaggagccaggttatttttcaaatgtgaaaattatcagcgaatgggagcctttaaatttcgtggtgcttttaatgcgttatcacaatttaatgatgaacagcgccgcaatggggttgtcacttattcatcgggtaatcatgctcaggcaatttcattggcggctcgtatactgaatatttcggcgacaatcatcatgccgttcgatgcgccagtggctaaggtcgccgcgaccgaaggttatggtggcaaaattgttttctatgatcgttatacggacgatcgtgaacaaattagccgtgaattatcagaaaagcagggattgaccttaattcctccctatgatcatccgcatattattgccggacagggaactgcggcaaaagagttgtttgaagaggtcggtgaactgaatgcgttgtttgtctgtctcggtggaggagggctgctttcaggcagtgcgcttgcagctcgccatttctctcctgaatgtaaaatttatggtgtagaaccggaaaccggtaatgacgctcagcaatcatttcgtcagggcaaaattattcacatcgatacgcctaaaactattgctgatggcgcacaaactcaacatcttgggcaatatactttcgatattattcgaaaaaatgttgatgatattttcactgtttctgatgaagaattggtggatgcaatgcgattttatgcagaaagaatgaagatgattgtcgaaccgaccggctgcttgagttttgccgctgcccgcaaaatgtgtgagtcattgcgaggccaaaaggtagggattattgtcagtggcggtaatgtggatatcgaacgttactgctcgttgctggcaaaacaaccttag

SEQ ID NO: 53358 - protein, 322 aa, Photorhabdus luminescens subsp. laumondii TTO1
MKNISVYDDVIAAARRIEAYAYRTPVLTSRTANEMTGARLFFKCENYQRMGAFKFRGAFNALSQFNDEQRRNGVVTYSSGNHAQAISLAARILNISATIIMPFDAPVAKVAATEGYGGKIVFYDRYTDDREQISRELSEKQGLTLIPPYDHPHIIAGQGTAAKELFEEVGELNALFVCLGGGGLLSGSALAARHFSPECKIYGVEPETGNDAQQSFRQGKIIHIDTPKTIADGAQTQHLGQYTFDIIRKNVDDIFTVSDEELVDAMRFYAERMKMIVEPTGCLSFAAARKMCESLRGQKVGIIVSGGNVDIERYCSLLAKQP

SEQ ID NO: 53359 - DNA, 1560 bp, Photorhabdus luminescens subsp. laumondii TTO1
  CDS (1)..(1560)
atggctgcatgtcttcccttaacttcctcaccaaatggtgcagagtatttgaaagcagcattaagcgcgcctgtttatgaagttgctcaggtgactcctttgcaggaaatggagaaaatttctgcccgcttgggaaatactattttggtaaagcgggaagatcggcaacctgttcacagtttcaagctccgtggtgcgtatgccatgattgcgagtttgactgaggaacaaaaaaaccgaggagtgattaccgcgtcagccggtaaccatgctcagggggttgcactttctgccaatcgtttgggaattaactctttgattgttatgccggttactactgcggatattaaagtcgatgcggtccggagtttcggtggtaaggctctgttgtatggtgctaattttgatgaggctaaagctaaagcgatagaaatggcacaacaggagggctatacctttgttcctccgtttgatcatcctgctgtaatcgcaggtcaggcaacactggcgatggaacttttgcaacaggatgtgcgtctggatcgaatctttgtacctgtcggtgggggggggttgattgctggcgttgctgtgttgattaagcaactgatgccagaaattaaaattattggggtggaagcggaagattcagcttgcctgaaagcagcaatggaggctggacatccggtagatttaccacgagttggtttgtttgctgaaggtgttgcggttaagcgtatcggtgatgaaacatttcgtttgtgtcagcaatatgtagatgatgttatcacggtagacagtgatgctatttgtgccgcggtaaaagatctgtttgaggatgtgcgtgcgattgctgagccatccggtgcattggcacttgctggattgaaaaagtatgttcagcagcatcagcttagaggtgagcgactggcacatattctttctggcgctaacgtaagcttccacgggttacgttatgtctctgagcgttgtgaattgggcgagcagcgggaagcattgctggcagtgactattcctgaacagaaagggagtttcctgagtttttgccagaaattgggcgatcgggtggtaacagagtttaattatcgttatacggatgcagatcctgatcaggcttgtcttttcgttggtgttcgcctgagtcgtggtgaggtagaacgacgggaaattatcgaggaattgcgtaccgcaggatatcaggttgccgatctctctgatgatgagatggcgaaattacatgttcgctatatgatcggcggtcgtccatctaagccattgaaagagcgcttatttagttttgaatttcctgaatcaccgggggctttgctaaagttcctccaaactttgggaactcactggaatattacgttattccattatcgcaattatggtacagattatggtcgggtgttagccgcatttgaattgtcaggagcggaagtgcgttttaagcgtcatcttgatgcattaggctatgcgtatcatgatgagacggatacccctgcgtttaaattctttttgatgtgccaaaacatttaa

SEQ ID NO: 53360 - protein, 519 aa, Photorhabdus luminescens subsp. laumondii TTO1
MAACLPLTSSPNGAEYLKAALSAPVYEVAQVTPLQEMEKISARLGNTILVKREDRQPVHSFKLRGAYAMIASLTEEQKNRGVITASAGNHAQGVALSANRLGINSLIVMPVTTADIKVDAVRSFGGKALLYGANFDEAKAKAIEMAQQEGYTFVPPFDHPAVIAGQATLAMELLQQDVRLDRIFVPVGGGGLIAGVAVLIKQLMPEIKIIGVEAEDSACLKAAMEAGHPVDLPRVGLFAEGVAVKRIGDETFRLCQQYVDDVITVDSDAICAAVKDLFEDVRAIAEPSGALALAGLKKYVQQHQLRGERLAHILSGANVSFHGLRYVSERCELGEQREALLAVTIPEQKGSFLSFCQKLGDRVVTEFNYRYTDADPDQACLFVGVRLSRGEVERREIIEELRTAGYQVADLSDDEMAKLHVRYMIGGRPSKPLKERLFSFEFPESPGALLKFLQTLGTHWNITLFHYRNYGTDYGRVLAAFELSGAEVRFKRHLDALGYAYHDETDTPAFKFFLMCQNI

SEQ ID NO: 53361 - DNA, 1530 bp, Vibrio vulnificus YJ016
  CDS (1)..(1530)
atgtcattaacccaacaaactggcgcagactacctgcgccagatactacgcgctccagtgtatgaagtggcaaccgtcacccctttgcaagagatgccgcgtttatcggcacgtattggtaacaatgtgcagatcaaacgtgaagaccgccagccggtgcattcgtttaagttacgtggcgcttacaatatggtggccaatctgtcgcaagcgcagaaggacgcgggggtgattgctgcctctgcgggcaaccatgcgcaaggcatggctctgtcaggaacgcgccttggcattgaaaccaccatcgtgatgcctcgcacgacgccggatatcaaagtcgacgcggtgcgcggttttggcggcaaagtcgtcttgcacggcagcaacttcgatgaagccaaagccgaagccgagcgtctttcgcaagagaaaggttacacttttgtcccacctttcgatcatcctttagtgattgctgggcaaggcaccatcggcatggaaatgctgcagcaaaacggccatctcgaccacattttcgtccctgttgggggcggtggtttagccgctggtgtggcggtgttggtgaaacagctgatgccagagatcaaagtcattgcggtggaacctgaagattctgcctgcctcaaggcggcattggatgcaggtgagcctgtggtgctggatcaagtcagtatgtttgctgatggtgtggcggtaaaacgcattggcgatgaaactttccgtctatgccagcactacattgacgatcacgtcaccgtctccagtgatgaaatctgcgcggcggtcaaagatattttcgaagacacccgtgcgattgctgagccttccggagcactggcgctggcggggctgaaaaagtatgccgagaaacacaaactcaaaggacacaacttgggtaccgtgctttcgggtgccaataccaacttccacggtttacgttatgtttccgagcgttgtgagctgggtgaaaaacgcgaaggcttgcttgcggtgaccattccagagcgcaaaggggcattttttgagttctgccatttgattggtggccgtgcggtgacggagttcaactaccgttacaacgacgactcgctggccaatatttttgtcggtgttcgtctgcaaaatggtcaagaggagttggatggtatcattcgcgacttacgcgaaggcggctacccagtggtggacctttctgaggatgaaatggccaagctgcacgtacgctacatgattggcggtaaaccctccaaaccactcaaagagcgcttatacagctttgagtttccagaatacccaggcgcactgcttaagttcctgagcacactgggcacacactggaacattagcctatttaactaccgcaaccatggggccgattatggccgcgtactgtgtggttttgagcttgatgagagtgatttatcccgcttttcggcgcatttgcgcgaacttggctaccaatgcaaagatgtcacggataacccatcctaccgtttctttctttcctaa

SEQ ID NO: 53362 - protein, 509 aa, Vibrio vulnificus YJ016
MSLTQQTGADYLRQILRAPVYEVATVTPLQEMPRLSARIGNNVQIKREDRQPVHSFKLRGAYNMVANLSQAQKDAGVIAASAGNHAQGMALSGTRLGIETTIVMPRTTPDIKVDAVRGFGGKVVLHGSNFDEAKAEAERLSQEKGYTFVPPFDHPLVIAGQGTIGMEMLQQNGHLDHIFVPVGGGGLAAGVAVLVKQLMPEIKVIAVEPEDSACLKAALDAGEPVVLDQVSMFADGVAVKRIGDETFRLCQHYIDDHVTVSSDEICAAVKDIFEDTRAIAEPSGALALAGLKKYAEKHKLKGHNLGTVLSGANTNFHGLRYVSERCELGEKREGLLAVTIPERKGAFFEFCHLIGGRAVTEFNYRYNDDSLANIFVGVRLQNGQEELDGIIRDLREGGYPVVDLSEDEMAKLHVRYMIGGKPSKPLKERLYSFEFPEYPGALLKFLSTLGTHWNISLFNYRNHGADYGRVLCGFELDESDLSRFSAHLRELGYQCKDVTDNPSYRFFLS

SEQ ID NO: 53363 - DNA, 1341 bp, Corynebacterium diphtheriae NCTC 13129
  CDS (1)..(1341)
gtgttaggaagcagtagtaccccgtggttaaaattgttgcccatgagtaaagaagcagaaaaccagcaggtcactttcggcgcaattcacgccgctgatattcaaatggcacagtctcgaatttctgcttctattgcaccgacgcccctgcagcattgcccacggttgtcgcaaatgacgggatgcgaagtctatctcaagcgcgaagaccttcaagacgttcggtcctataaaatccgtggtgctgtcaatgcgatctcgcaactgacagaggaacaacgagtggctgggatcgtggcggcgtcggcaggcaatcatgctcaaggtgtggctttcgcctgccgaaccatgggtatcaaaggtcgaatctacgttccggcagcaacgccaaagcaaaaacgcgaccgtatcatggtccatggtggcgacgctgtagaactcgtagtcaccggtgccaattttgatgaagcggcagctgctgcacgtgagtacgctcgcgttgaaggcgcaacgatggtggaaccattcgataaccgcgataccgttatcggccaaggaactgtagcagcagagatcttggcacaattaacaacgctgggtaaaacacttgataccgtcgtcgtgcccgttggtggtggtggattgctttccggcgttgtcagctatcttgctgatatggcgccacgcaccgcgatcgttggagtagaaccagaaggtgcggcatccatgcgcgccgctctggatgcgcacggtcctgtgaccttggataatgttgacccatttgtcgacggtgccgctgtgaaacgtatcggtgatcttaactatcacatcatcgaacacaaccaaggccgtattcaccccatcagcgttaatgaaggtgctgtatgtactgagatgcttgacttgtatcaaaacgagggcatcattacagaacctgcaggggcgctgtcagttactggattgaaagagctgtcacttggaagcagggacgtagttgtctgcatcatctctggtggtaacaacgatgtgctgcgttatggggaaatcatggagcgctccctcgttcatcgcggactcaagcactacttcctcgtcaatttcccacaggagccagggcagctacgtactttcctgaacgacatcttgggcccagatgacgacatcactttgtttgaatatctcaaacgcaacaaccgtgaaaccggaacagcgctcgtaggacttcaactcggagttgcttccgaacttgacggtttgctcgagcgaatgaatgcttcgcggattgattgccggcgactagaacctggaacgccagagtatagttacctcgttaatttgtaa

SEQ ID NO: 53364 - protein, 446 aa, Corynebacterium diphtheriae NCTC 13129
MLGSSSTPWLKLLPMSKEAENQQVTFGAIHAADIQMAQSRISASIAPTPLQHCPRLSQMTGCEVYLKREDLQDVRSYKIRGAVNAISQLTEEQRVAGIVAASAGNHAQGVAFACRTMGIKGRIYVPAATPKQKRDRIMVHGGDAVELVVTGANFDEAAAAAREYARVEGATMVEPFDNRDTVIGQGTVAAEILAQLTTLGKTLDTVVVPVGGGGLLSGVVSYLADMAPRTAIVGVEPEGAASMRAALDAHGPVTLDNVDPFVDGAAVKRIGDLNYHIIEHNQGRIHPISVNEGAVCTEMLDLYQNEGIITEPAGALSVTGLKELSLGSRDVVVCIISGGNNDVLRYGEIMERSLVHRGLKHYFLVNFPQEPGQLRTFLNDILGPDDDITLFEYLKRNNRETGTALVGLQLGVASELDGLLERMNASRIDCRRLEPGTPEYSYLVNL

SEQ ID NO: 53365 - DNA, 996 bp, Rhodopseudomonas palustris CGA009
  CDS (1)..(996)
atgccggccatgacccattccgctgtgctgcccgtttccgtcgccgatatcgatgcggctgccgaggtgctcgcgcccgtcgcggtgcggacgccgctgctgtcgtcgccggcgctcgatgccgccaccggcgcgcgcgttttccttaaaccggaagtcttgcagcgcaccggctcgttcaagtttcgcggcgcctacaacaaactggcgtcgctgtcgccggagctacggcgtgccggcgtggtcggattcagctccggcaatcacgcccagggcgtcgccgcggcggcgcagctgctcggcgtccacgccaccatcgtgatgccgtcggatgcgcctgcctcgaagcgcgaacgcaccgccggctttggcgccgaggtggtgctgtatgatcgcgaccgcgaggatcgcgaagcgatcgctcgcgacattgccgagcgcagcggcgcgacgttggtgcggccgttcgacgatccgatggtgatcgccgggcagggcacggtcggccgcgagatcgccgaggaccttgctgcgctggggctcgcgccggatctggtggtggcgccggcctccggcggcgggctgatcgccggcacagcgcttgccgtcaaggcgcggtttccccaggcgctggcgatgtcggctgagccggagggcttcgacgaccacgcccgctcgctggtggcgggacgccgcgagtccaatccggccggcggacgcacgatctgcgatgcgttgatgatgtcgatcccgggcgaggtcaccttcgcgatcaatcgcgtgctgctcgccggcggcgtggccgcgtccgatgccgaggtcggcactgcggtcggcttcgcattccgcgagctgaagctggtggtggagccgggcggagcggtggcgctcgcggcattgctcgccggcaagctcgacgtccgcggcaagaccgtcgcgatcgtgctgtcgggcggcaatgtcgatgctgacctgttcagccgcctgatcgcctga

SEQ ID NO: 53366 - protein, 331 aa, Rhodopseudomonas palustris CGA009
MPAMTHSAVLPVSVADIDAAAEVLAPVAVRTPLLSSPALDAATGARVFLKPEVLQRTGSFKFRGAYNKLASLSPELRRAGVVGFSSGNHAQGVAAAAQLLGVHATIVMPSDAPASKRERTAGFGAEVVLYDRDREDREAIARDIAERSGATLVRPFDDPMVIAGQGTVGREIAEDLAALGLAPDLVVAPASGGGLIAGTALAVKARFPQALAMSAEPEGFDDHARSLVAGRRESNPAGGRTICDALMMSIPGEVTFAINRVLLAGGVAASDAEVGTAVGFAFRELKLVVEPGGAVALAALLAGKLDVRGKTVAIVLSGGNVDADLFSRLIA

SEQ ID NO: 53367 - DNA, 1209 bp, Geobacter sulfurreducens PCA
  CDS (1)..(1209)
atgctcccctacacactgattcaggaagccgacgaccgactcaggaagcgggttcgtcgcaccgagctcatccactcccatcacttcagcgagaaactgggaatcccgatctatttcaagtgcgagaacctccagcgcaccggtgcgttcaagatccgaggcgccctgaacttcatgacgtcgcagccgcgggaggcactggcaaagggtgtcattaccgcttctgccggtaaccatgcccaaggagtcgcgttctcggccgacctgctgggagtgccgtccacggtgttcatgccggaaagcacgccgccgcagaaggtctttgccacccgtgactacggcgccgaggtggtactcaccggccgcaacttcgacgaggcatacgctgcagcggtccaggcgcaggaggaacggggcgccctcttcgtccacccctttgacgacccgctcgtgatggccgggcaaggcaccatcggcctggaagttctccaggagcttcccgatgtagccaatatcctcgtccccatcggcggcggcggtctcatcgcgggcatcgccacggccatcagagaaacccacccccacgtgcggatcatcggcgttgaaacagcggcggccccatccgcccactattcgctgcaaaaggggaagatcgtccaggtccccgtgacggtcacccttgccgacggcatcgcggtcaagaagccaggggtgaacacctttcccatcatcagggacttggtggacgaggtggtcttggtggaagaagaggagatcgcccttgccatcgtggcgctgctggagcgaaccaagctcttggtcgagggggccggggccgttccgttggccgcgcttctcaaccggcgggtgactgatctttcgggaaaaacggtctgcgtgctgtcgggcgggaatatcgacgtgaagaccatctcagtagtggtggaacggggtctggtggctgccgggcgctacctgaagctgaaggtggagctggacgatctccccggtgccctggcgcgacttgcgacggaaattgccgaggctaaagccaacatctccatcatcacccatgaccggcgctcgaaatcgctccccatcggcaagaccgaggtcctcatcgagctggagacccgggggttcgagcacattcaggaggttatctctcacctgcagggggtggggtatctggtggatgtgctgaaataa

SEQ ID NO: 53368 - protein, 402 aa, Geobacter sulfurreducens PCA
MLPYTLIQEADDRLRKRVRRTELIHSHHFSEKLGIPIYFKCENLQRTGAFKIRGALNFMTSQPREALAKGVITASAGNHAQGVAFSADLLGVPSTVFMPESTPPQKVFATRDYGAEVVLTGRNFDEAYAAAVQAQEERGALFVHPFDDPLVMAGQGTIGLEVLQELPDVANILVPIGGGGLIAGIATAIRETHPHVRIIGVETAAAPSAHYSLQKGKIVQVPVTVTLADGIAVKKPGVNTFPIIRDLVDEVVLVEEEEIALAIVALLERTKLLVEGAGAVPLAALLNRRVTDLSGKTVCVLSGGNIDVKTISVVVERGLVAAGRYLKLKVELDDLPGALARLATEIAEAKANISIITHDRRSKSLPIGKTEVLIELETRGFEHIQEVISHLQGVGYLVDVLK

SEQ ID NO: 53369 - DNA, 1212 bp, Bdellovibrio bacteriovorus HD100
  CDS (1)..(1212)
atgaaagtcagctttgcagacatccaaaaagcccgtgaacttctgaaagacatcatctgtccaaccgagatgagtcattccatcagcgccagcaacctgcttaaaagcgaagtgtacctgaagtttgaaaacactcagcgcacgggaagttttaaattccgcggggcctataacaaaatctccaatctgacagccgacgaaaaagcccgcggtgtggtcgccagctctgccggaaatcacgcgcaaggtgtcgccctgtcagcgaaactggccggagtcaaatccaccatcgtgatgccggagacagcctcgatcagcaaagcttccgcgacccgtgattacggcgccaacgtcgtgcttaaaggcgagatctacgacgaggctttcgaacatgcccagaaactggaaaaagaacacggctacaccttcgtgcacccttatcaggacccttatgtgatcgctggccagggaaccatcgggatcgagatcctggaaaaggttccagacctggatacggtgattgtgcccatcgggggtggcggtctgatcagtggtgtggcgttggcggtgaaggccatcaatccaaagatccgcgtgatcggtgtgcaaagcgaccgctctccgggaatggcgcatctttataacaaacagcctttgtcccagatcaaacgtgccgccacgattgctgacggcattgcgatcaaaaacccttcccaggtgatgctggacagtttcatttccaagtatgtcgatcaggtggtgacagtcagtgatgacgagatcgctgaagcgattgtgttcctgatggaaagagccaaaaccgtagctgaaggctctggcgcagcggcgatggcagctgcgatgtcccgcggactggatctgggtaaaaagacctgtgtgattatcagcggtggaaatatcgatctgaacatcgtttcaaagatcatcgaccgtggtcagattctgcgcggacgcctgtgtgagttgtccgtgattgtggatgaccttccggggaatttgagccgtttgactcaggcaattgcctctcaaaaagccaacatcctggaagtgcgtcacgaccgtgtgtcgaaggggctttcactgcgtgaaacccgcatcgacttcgttctagagactacgagcattgaacatgttgaacggattaagcgggctcttgaggaaactggagccaaggttatccaaagcacctaa

SEQ ID NO: 53370 - protein, 403 aa, Bdellovibrio bacteriovorus HD100
MKVSFADIQKARELLKDIICPTEMSHSISASNLLKSEVYLKFENTQRTGSFKFRGAYNKISNLTADEKARGVVASSAGNHAQGVALSAKLAGVKSTIVMPETASISKASATRDYGANVVLKGEIYDEAFEHAQKLEKEHGYTFVHPYQDPYVIAGQGTIGIEILEKVPDLDTVIVPIGGGGLISGVALAVKAINPKIRVIGVQSDRSPGMAHLYNKQPLSQIKRAATIADGIAIKNPSQVMLDSFISKYVDQVVTVSDDEIAEAIVFLMERAKTVAEGSGAAAMAAAMSRGLDLGKKTCVIISGGNIDLNIVSKIIDRGQILRGRLCELSVIVDDLPGNLSRLTQAIASQKANILEVRHDRVSKGLSLRETRIDFVLETTSIEHVERIKRALEETGAKVIQST

SEQ ID NO: 53371 - DNA, 1227 bp, Mycoplasma mycoides subsp. mycoides SC str. PG1
  CDS (1)..(1227)
atgtcgcatccattttcagtagatgaaattaaacaaattcatcaagaaatttctaaaataattcattatacacctttacattatgcagataaattatcagctttaactggtaataatatttatttaaaattagaaaatttacaaaaaacaggaagctttaaattaagaggagcaactaataaaattaataaactaactaatgaagaaaaagaacatggaattattgcagctagtgctggaaatcatgcacaaggtgtagcttatgcagctactaatttagggttaaaatcaacaattgttatgcctgaaaatgccccaatggcaaaaattcaagcaacagaaaaatatggtggaaaagttgttctaagtggaagattttttgatgatgctttagctaaagcaattgaattaaaagaaaaagaaaatctaactttaattcatgcttttgatgatattgaaattattaaaggtcaagctactattacatatgaaattgatcaacaaattaaaaacatcgattattgtttagtaccaattggtggtggtggattaatgagtggtattgctacttatttaaaacaagttaatccaaatattaaaatgattggtgttgaagctgctaatgttaattcctatcaacaagcaaaagctttgagtagaccagtgatggttgattctaaaccatcaatagcagatggaattgctgttaaaaaagttagtgatttaactttttcaatattaaatcaatatgttgatgatgtagttgttgtaagtgaagaagaaattgctgaagcaatgttatttttaatggaaaattgtaagtttgtaactgaaggttcaggagcagttactgctgctgctttaatgtttgataaattaaatattaaaaatcaaaataaaacaatagttggtttagttagtggtggaaatattgatattgcaatggttggtaatattattaataaagctttaattaaaactaatagaagattagtattatcagttaatataacatcagataataaagaaatactaaaaataattaatattattaattcttgtggagctaaaatttttaaaataaaaactaatagagatattatgtatttagaattaagtgaaattcatgcaacatttattattgatttatcaaatactgatcaacaacagcaaatcattgacaaaattattcaagctaattacaaaattacaagcattacagattaa

SEQ ID NO: 53372 - protein, 408 aa, Mycoplasma mycoides subsp. mycoides SC str. PG1
MSHPFSVDEIKQIHQEISKIIHYTPLHYADKLSALTGNNIYLKLENLQKTGSFKLRGATNKINKLTNEEKEHGIIAASAGNHAQGVAYAATNLGLKSTIVMPENAPMAKIQATEKYGGKVVLSGRFFDDALAKAIELKEKENLTLIHAFDDIEIIKGQATITYEIDQQIKNIDYCLVPIGGGGLMSGIATYLKQVNPNIKMIGVEAANVNSYQQAKALSRPVMVDSKPSIADGIAVKKVSDLTFSILNQYVDDVVVVSEEEIAEAMLFLMENCKFVTEGSGAVTAAALMFDKLNIKNQNKTIVGLVSGGNIDIAMVGNIINKALIKTNRRLVLSVNITSDNKEILKIINIINSCGAKIFKIKTNRDIMYLELSEIHATFIIDLSNTDQQQQIIDKIIQANYKITSITD

SEQ ID NO: 53373 - DNA, 1683 bp, Eremothecium gossypii
  CDS (1)..(1683)
atggttttcaatgcctgcggaagacgcagcggcaaccttgtgagttccgctttaagaacgggccggaggtactccggcacgttacataaactttacactcagttgaaaccacaagaactacttccagacaatacgccggattatgtgcggatgatactgcgctcctcagtttacgatgttatcgaggaatcgcctatgtctgaagcgaaactgctctcggccaagctggatacaaatgtgtgcctgaagcgtgaagacctgctgcctgtgttctcattcaaactacgaggcgcgtataatatgatatccaacctagacgaataccagaagagcgcaggtgtcatcgcgtgctctgcgggaaaccacgcgcagggtgttgcgttctccgcacgggaattgggtatacgagcaatgattgtgatgcccacttcgacgccgtctatcaaatacaacagtgtcgcagcgatgggggcggaggtagtattgtacgggaaagacttcgatgaggcgaaagccgagtgtgcccggcttgcgcagcttcacaagctcaccgatatacccccctttgaccacccatatgtcattgctggccagggaaccatcgcaacggaaattctccggcaagtgcacaatgccagtcagattggcgcggtgttctgcggcgtgggcggagggggtctgatagccggcattgggtcgtacctgaaacggattgcgccacatatcaaaatcataggtgtcgagacgcatgacgcccccactctgcacaccgctctgaagcagggacgccgcacaatgctgcctgcggtcggctgtttcgcagatggcacgtccgtgcgaatgatgggcgaggaaacgttccgtgtagcacgcgatgttgtcgatgaggtggtgctggtcaacacggacgagctttgcgccgcaatcaaggatatattcgaggacacaagagcgattgttgagccttccggcgcgctgggggttgcaggtctaaagaagtacatagccagccatcaagacgccgagaacagtcgccacacctatgtccccgtgctatcgggcgcgaacatgaatttcgaccgcttacgcttcgtcagcgagcgcgcggtgctaggcgaaggcaaggaggtgttcctggccgtcactatcccggacgtgcctggctcctttaagcgcatgaaccagatcatccacccccgcgccgtaacagagttctcctaccgctacaatgagcatgctcgccgcaaccaagacggcaccgcccgggcctgtatctacacctcttttagcgtggccgaccctgccgccgaggtgcccgacgttctcactcgtcttcgcgcgctcggcttcgatgcccgcgatatttccgcgaacgagctcgccaagtcccacgcgcgctacctcgtcggcggtgccgcccgtgtcccgaacgagcggctctttgccttcgagttccccgagcggcctggcgcgctgaccaacttcctcgctggtctcgactcctcctggaacatcacgctgttccattaccgcaaccacggcgcggacgtgggccgcgtacttgtaggcatcgcagtcccttctgacgaatactcggccttcgatgcgttcctgagcgggctcggctacgcctaccaagaagaaaccggtaaccctgtctatcgcgagtttctgctctgctaa

SEQ ID NO: 53374 - protein, 560 aa, Eremothecium gossypii
MVFNACGRRSGNLVSSALRTGRRYSGTLHKLYTQLKPQELLPDNTPDYVRMILRSSVYDVIEESPMSEAKLLSAKLDTNVCLKREDLLPVFSFKLRGAYNMISNLDEYQKSAGVIACSAGNHAQGVAFSARELGIRAMIVMPTSTPSIKYNSVAAMGAEVVLYGKDFDEAKAECARLAQLHKLTDIPPFDHPYVIAGQGTIATEILRQVHNASQIGAVFCGVGGGGLIAGIGSYLKRIAPHIKIIGVETHDAPTLHTALKQGRRTMLPAVGCFADGTSVRMMGEETFRVARDVVDEVVLVNTDELCAAIKDIFEDTRAIVEPSGALGVAGLKKYIASHQDAENSRHTYVPVLSGANMNFDRLRFVSERAVLGEGKEVFLAVTIPDVPGSFKRMNQIIHPRAVTEFSYRYNEHARRNQDGTARACIYTSFSVADPAAEVPDVLTRLRALGFDARDISANELAKSHARYLVGGAARVPNERLFAFEFPERPGALTNFLAGLDSSWNITLFHYRNHGADVGRVLVGIAVPSDEYSAFDAFLSGLGYAYQEETGNPVYREFLLC

SEQ ID NO: 53375 - DNA, 990 bp, Yersinia pestis biovar Medievalis str. 91001
  CDS (1)..(990)
ttgaaaataaaatttaaaggaatcgagatgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgatcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 53376 - protein, 329 aa, Yersinia pestis biovar Medievalis str. 91001
MKIKFKGIEMNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPDLDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 53377 - DNA, 1380 bp, Anopheles gambiae str. PEST
  CDS (1)..(1380)
atggtctctgcggcggattatctacgcaaggtgctgctctcccccgtctacgaggcggcgcgggtcacccccctgcaaaccctgaagaaactctccgagcggctcggcaatcacgtcagcctgaagcgggaggacctgcaaccggtccactccttcaagctgcgcggcgcctaccacaagatcgccaccctgaccgaggagcagaaggagcgcggcgtcatcgccgcctccgccggcaaccacgcccagggggtcgccctgtcggccgccaagctcggcatcaaggcgatcatcgtgatgcccaagaccacgccggacatcaagatcgacgcagtgcgccgtcagggcggcaacgtcatgctgtttggcaacagcttcgacgaggcctacggcgagagccgccgtctcgctgaattggaaggctacaccctgatcccgccgtttgacgacgtcgaggtgatcgccggccagggcaccatcggcaaggagctgctggagcaggatacccacctcacccacgtcttcgtgccggtggggggcggcgggttggccgccggggtggcggtctatatcaagcagctgctgccggatgtgaaggtgatcggggtggaggcggagggttctgcctgcctcaaggccgcgctggcggccggcgagccggtcaatctggagcgggtctcgctgtttgcggacggggtggcggtcaagcgcatcggcgaggagaccttccgcctgtgcaaccagtatctggacgaggtggtgaccgtctccaacgaccagatctgcgccgcactgaaagacatcttcgacgactgccgcgccattgccgagccgtcgggcgccctgtccctggcgggtctcaaggcctacagcgagcgggagcaggccaaggggggccggatggcggccattttgtccggcgccaatgtcaacttccacagcctgcgctatgtgtcggagcgctgcgagatcggcgagaagcgcgagggcatgctggcggtgaccatccccgagcgcaagggggccttcctcgacttctgccgtcagctcgggccgcgcatggtgaccgagttcaactaccgttatgcagatgccgagcaggcgtcgctgttcgtctcggtgcgcctcaccggcggtgacgaggagctgggccagatcatcgatcagctcggtggcaacggctatccggtggtcaacatgaccgagagcgagctggccaagaaccacaccctgggctgtcgctggaacatcagcctgttccactaccgcaaccacggtgccgactatggccgggtgctctgtgccttcgagctgccggacgaggacgtggcggcttttcacgactacctgcgcgagattggctacggctggaaagagtag

SEQ ID NO: 53378 - protein, 459 aa, Anopheles gambiae str. PEST
MVSAADYLRKVLLSPVYEAARVTPLQTLKKLSERLGNHVSLKREDLQPVHSFKLRGAYHKIATLTEEQKERGVIAASAGNHAQGVALSAAKLGIKAIIVMPKTTPDIKIDAVRRQGGNVMLFGNSFDEAYGESRRLAELEGYTLIPPFDDVEVIAGQGTIGKELLEQDTHLTHVFVPVGGGGLAAGVAVYIKQLLPDVKVIGVEAEGSACLKAALAAGEPVNLERVSLFADGVAVKRIGEETFRLCNQYLDEVVTVSNDQICAALKDIFDDCRAIAEPSGALSLAGLKAYSEREQAKGGRMAAILSGANVNFHSLRYVSERCEIGEKREGMLAVTIPERKGAFLDFCRQLGPRMVTEFNYRYADAEQASLFVSVRLTGGDEELGQIIDQLGGNGYPVVNMTESELAKNHTLGCRWNISLFHYRNHGADYGRVLCAFELPDEDVAAFHDYLREIGYGWKE

SEQ ID NO: 53379 - DNA, 1431 bp, Anopheles gambiae str. PEST
  CDS (1)..(1431)
atgtctcccacgatgcaagtgtcatccgtaacgacgcaaatggcttccgcgaagctgacagctcgcccgtcggcggcagagcggccgacagcagcaggccaaaatgggcacgaggccggagtgaatggtgcacccgccggcgccccaacagccgcaacgaccgagccggaaatcgtcgatccgttttgcaatgcggacaatccgcagataatcaccttccaggacgtaacgtccgcggcgttcaaaatcagaaaaggtgtcgagctgacgccgtgcgtgaaatcacacttctccgacctgatcgacatggacatctacctgaagaaggaatttctgcagtttactggcagcttcaaggagcggggagcgcgctacgcgttgctaatgctgtcggacgagcagaaaaaaacgggcgtcatctcggcctccctcgggaatcatgcgcagggtctgtcctatcacggctggaagctgggcatcccggtgacggtcgtgatgccgctgaaggcttcgctgatgaaaatccagaaatgccgtaactatcacgctaatgtcgtcgtacagggagcggacatgggcgaggctaaaaggattgcactgaaaatggcacacgaccggggactcacgtacattaacgggtacgaccatccgcacatcatgtccggtcagggcacgatcgggctggagatcgtggagcaggtcagcgacatcgacgccgtcgtggtgccggtcggtggcggcggactgattgccggtgttgcaactgccatcaaaaatctcagcccaaataccaaaatcatcggtgtcgagtcggagaagtgtcccagcttcacgcgagcgctcgagaacaagagcccagtgtttgtcgcgaaccaggaaacgctggcggacgggttggcagtgccgcaggtagggtacaacgcgtacgccacgaccgtgccgctgctggacaaaatgatcgtcgtgaaggaggagtggattgcgctggcgattctgcgactggtcgagctggaaaagtgcgtggtggagggagcgggtgccgccggcctggcagccattttggccggccatctggatgaattcattggaaaacgagtggtgctgctaatttgcggaggcaatatcgatacgaccatgttcggcaaatgtctcgagcgtggcatggctgccgagggccgtttgcagagattcaccgtcaccgtcagcgatggaccgggcggtgtagctaagctgtgcaatctgctcgccagcctgggcgtttccatcaaggacataatgcacgaacgtgccttcattcgtgatattcaccatgtagaggtgaaagtgatttgtgaaacacgtgactgggaacattcaaaggaaatgcgcagggtgctacaggaaacgtatagcaaagttcacttctatgacatgccaatggcgatcacctag

SEQ ID NO: 53380 - protein, 476 aa, Anopheles gambiae str. PEST
MSPTMQVSSVTTQMASAKLTARPSAAERPTAAGQNGHEAGVNGAPAGAPTAATTEPEIVDPFCNADNPQIITFQDVTSAAFKIRKGVELTPCVKSHFSDLIDMDIYLKKEFLQFTGSFKERGARYALLMLSDEQKKTGVISASLGNHAQGLSYHGWKLGIPVTVVMPLKASLMKIQKCRNYHANVVVQGADMGEAKRIALKMAHDRGLTYINGYDHPHIMSGQGTIGLEIVEQVSDIDAVVVPVGGGGLIAGVATAIKNLSPNTKIIGVESEKCPSFTRALENKSPVFVANQETLADGLAVPQVGYNAYATTVPLLDKMIVVKEEWIALAILRLVELEKCVVEGAGAAGLAAILAGHLDEFIGKRVVLLICGGNIDTTMFGKCLERGMAAEGRLQRFTVTVSDGPGGVAKLCNLLASLGVSIKDIMHERAFIRDIHHVEVKVICETRDWEHSKEMRRVLQETYSKVHFYDMPMAIT

SEQ ID NO: 53381 - DNA, 1167 bp, Neurospora crassa
  CDS (1)..(1167)
atggccgaccccagcaccacccctccccttacccgtgcctccgtcctcgccgctcactccctcataaagccctacattcacgagacgcccgtgcttacgaataccactttcgaccaactcgcttccacccctcgtactcccgaagagctgcaaggaacggaatgggaggctaccgaaagaccggcgaacccaaagattcggttctggttcaagtgcgagaatttccagcggattggcgcgttcaaggctagaggagcgtttcatgctgtggagaggttgaagcaaactgaggggttagaggggttgaagaagggcggagtagtgacgcatagttctggtaaccacgcccaagccctttccctcgctgcccgcgagaacggcatcccggcgcacatcgttatgcctaccatctcgcctccgcccaagatcgctgccaccaagggttacggcgccaacataacctttagcggaagcacgagtaccgagcgtgaagcagttacaagggaggtgattgagaagacgggtgcgaggctggtgccgccttatgatcacccagacatcatcctcggccaaggcaccgccgccctagagctccaacgccaagtcgccgcctctctctccacctccggcaccaccaccaccaccaaccgtcgtcgtcttaacgcgataataaccccctgcggcggcggtggtctcctctccggcaccgctctcgcctgttccgacctctccccttccgatccctccacacccggtccaatcctggtcttcggcgccgaaccctccttctcgggcgcggacgacggtcgtcggggttactactcgggcactcgcatcgagagcgtcaaatccttgacgattgccgatgggctgcggactcctctgggggcgtatccgtggagtatcatctatgagcggaagctggtggcgggcatgtacagtgtgggcgaggaagagatcaagaaggcgctgaggctggtttatgagaggatgaaggttgttgttgagccgagcgcggtagtggggttggcggtagcgttatttaatgaggagtttaggagtatggtggagagggaagggggggaggaagggtgggatttgggggtggtgtttagcggagggaatgttgagctggcggcgttggggaggttgtttggtgaggaatag

SEQ ID NO: 53382 - protein, 388 aa, Neurospora crassa
MADPSTTPPLTRASVLAAHSLIKPYIHETPVLTNTTFDQLASTPRTPEELQGTEWEATERPANPKIRFWFKCENFQRIGAFKARGAFHAVERLKQTEGLEGLKKGGVVTHSSGNHAQALSLAARENGIPAHIVMPTISPPPKIAATKGYGANITFSGSTSTEREAVTREVIEKTGARLVPPYDHPDIILGQGTAALELQRQVAASLSTSGTTTTTNRRRLNAIITPCGGGGLLSGTALACSDLSPSDPSTPGPILVFGAEPSFSGADDGRRGYYSGTRIESVKSLTIADGLRTPLGAYPWSIIYERKLVAGMYSVGEEEIKKALRLVYERMKVVVEPSAVVGLAVALFNEEFRSMVEREGGEEGWDLGVVFSGGNVELAALGRLFGEE

SEQ ID NO: 53383 - DNA, 1773 bp, Neurospora crassa
  CDS (1)..(1773)
atggcttcgacacttagtgcacagccgttgctcgtcaacggtgcttccctgcaggtagtcaacggtctcaacagcgagaggccagcgagcccgtcttcggttggcaacctcgcactgaccgagtacagcgcgatgccatcgccgccatcggaggatgccacggccaacaagatgaagcgcattgttcctgatgagttcctgcttcctaacggtcatccagattacttgcgcctcatcattacctcttacccacgtgtccgcgaagtttgcagtgaggtgcccctaacccgggctgtcaacctgagcaaccgcctcgagtgcaatgtcctactcaagcgtgaagatgaacagcccgtcttcagctttaaacttcgtggcgcctacaacaagatggcccatctcgaccccaaggagtcctggaagggggtagtctgctgcagtgccggcaaccacgcccaaggagttgcatactctgcccgtaagctgaagatccccgccactgtcatcatgcccaagggcactcccagcatcaagcacctcaacgtttcccgtatgggtagccacgtcgttctccatggtgccgacttcgacgaagcaaaggaggagtgtgctcgaagggccaagctggacggcctcatcaacatcccgcctttcgatgatccgtacgtaattgccggccaaggaaccatcggcatggaaattttgtcacagaccaatctgcagaagctacaggccatcttctgtgctgtcggcggtggtggcttgattgctggtgttggggtctacgtgaagcgtattgcccctcatgttaagatcatcggcgtcgagacgtacgatgcagacgccatgacccagtcgctcgctaagggcgaacgtgtccttcttcaagatgtgggtttgtttgccgatggtgccgccgtcaagacagttggtgaggagaccttccgtatctgtcaagaagtcgtcgacgagatggtccaagtcaccacggacgaggcttgtgccgccatcagagacatgttcgaggacacgcgctctatcatcgagcctgctggcgcgctggccgttgccggactcaagaagtgggttgctgccaacccatccgctgaccccacccggtccgtcgtcgccatcacctcaggcgcaaatatggactttgatcgcctgggctttgtctcagcgcgtgccaaatatggcgaaggcaaagaggccctcctctctgttaccatccccgagcgccccggcgcttttgccgaattagtcaacgccatcatgccacatgccatcaccgagttcagctaccgatacgctaccgaatccaaggcaaacgtcatggttggcatttctctggccgattccggcagccgccgggcagagcaactgcagaccatcatcggccgtatcaaacaatcaggtgacatggacgtaacagatctgtccgccgacgagcttgccaagagccatcttcgatacatggttggcggccgctcaaatgtccccaaggaaaggctttacacattccgctttcccgagcggccaggcgccctcgagcgttttttgcgactactgagaccaaagtacaacattagcctcttccaatatcgaaactacgggggagatattggccaggtattgacgggtattcagtgccctgacgaggaagttggcgaactacaaagcttttttaaggagatcggatacccatgggaagactcggacccgcactacaaatatgtgggtctcccctcctcgaacttttgtgagaggagatag

SEQ ID NO: 53384 - protein, 590 aa, Neurospora crassa
MASTLSAQPLLVNGASLQVVNGLNSERPASPSSVGNLALTEYSAMPSPPSEDATANKMKRIVPDEFLLPNGHPDYLRLIITSYPRVREVCSEVPLTRAVNLSNRLECNVLLKREDEQPVFSFKLRGAYNKMAHLDPKESWKGVVCCSAGNHAQGVAYSARKLKIPATVIMPKGTPSIKHLNVSRMGSHVVLHGADFDEAKEECARRAKLDGLINIPPFDDPYVIAGQGTIGMEILSQTNLQKLQAIFCAVGGGGLIAGVGVYVKRIAPHVKIIGVETYDADAMTQSLAKGERVLLQDVGLFADGAAVKTVGEETFRICQEVVDEMVQVTTDEACAAIRDMFEDTRSIIEPAGALAVAGLKKWVAANPSADPTRSVVAITSGANMDFDRLGFVSARAKYGEGKEALLSVTIPERPGAFAELVNAIMPHAITEFSYRYATESKANVMVGISLADSGSRRAEQLQTIIGRIKQSGDMDVTDLSADELAKSHLRYMVGGRSNVPKERLYTFRFPERPGALERFLRLLRPKYNISLFQYRNYGGDIGQVLTGIQCPDEEVGELQSFFKEIGYPWEDSDPHYKYVGLPSSNFCERR

SEQ ID NO: 53385 - DNA, 1467 bp, Rattus norvegicus
  CDS (1)..(1467)
atgccctcaggtaggattctccggtctccagtggtcgaacttcttggtcagagatggggagtctttgaacttggccaaggagccacgctgcgttgtgtgtcggaagaactggatccccaacagcttaacctgccccgtccttgttcccacctggtggctcagaagtcattcaaggaagagcccctcctctccctcatcacggccagcaactgtgtgactttagcaatggacttggtttctccgaacacgttccggatcattggaatgtttttgttcaggaccccagaatcaagagctgtccctttaacaaggaggaggggccagggcctgatagcggaagctgatctggtagcctgtcgtcagcgttctgttggaatggagggagcctcggcagagtgtgtcagggcagagcctttccacagggtcacacccctgctggagagctgggcgctgtctcaggtggcaggcatgcctgtcttcctcaaatatgagaacgtgcagatagctggctcctttaagatccggggcatcggacatttctgtcagcaggtgaaggaggatggccaagaggggatgcagacatctggtgtgctcctcaggccccacagtagcctgggtgacatacttatgtctgaagcagtcacgggccaggaggttgtgttctccgattggcttgacataaatcagcaagggggcaacgcaggcattgcggccgcatactccgctcagaagctgggcatccccgtcaccatcgtgctcccagagagcacctccaagcaggtggtgaggcggctggagggagagggggccgaggtccagctgactgggaaggtctgggatgaagccaatgtaagggcacaagaactggccaccagggacggctgggtgaacgtctccccgtttgaccatcccctgatatgggaaggcaatgccagcctagtgcgggagctcaaggagtccctgaggacgcctccaggtgccgtggtgctggccgtggggggtggagggctcctggccggtgtggttgctggcttactggaggtaggctggcagcatgtgcccatcgttgccatggagacccggggggcacacagtttcaacgcggctttgctggcgggcaggctggtcactctgccagacatcaccagcgtagccaggagcctgggagccaagactgtggctgcacggaccttggagtgtgcaaaggagtgtgaagtcctctctgaggtggtagaagaccgggaggctgtcagagctgtgcagaggttcctggacgatgagcgcatgctggtggagcctgcctgcggtgctgccctggctgctgtctactcaggcatcctggggaggctccagactgagggccgcctgagccctgccctggattccgtcgtggtcatcgtgtgtggtggcaacaacatcagtagccaacagcttcaggagctgaaaacacagctgaactgcagctga

SEQ ID NO: 53386 - protein, 488 aa, Rattus norvegicus
MPSGRILRSPVVELLGQRWGVFELGQGATLRCVSEELDPQQLNLPRPCSHLVAQKSFKEEPLLSLITASNCVTLAMDLVSPNTFRIIGMFLFRTPESRAVPLTRRRGQGLIAEADLVACRQRSVGMEGASAECVRAEPFHRVTPLLESWALSQVAGMPVFLKYENVQIAGSFKIRGIGHFCQQVKEDGQEGMQTSGVLLRPHSSLGDILMSEAVTGQEVVFSDWLDINQQGGNAGIAAAYSAQKLGIPVTIVLPESTSKQVVRRLEGEGAEVQLTGKVWDEANVRAQELATRDGWVNVSPFDHPLIWEGNASLVRELKESLRTPPGAVVLAVGGGGLLAGVVAGLLEVGWQHVPIVAMETRGAHSFNAALLAGRLVTLPDITSVARSLGAKTVAARTLECAKECEVLSEVVEDREAVRAVQRFLDDERMLVEPACGAALAAVYSGILGRLQTEGRLSPALDSVVVIVCGGNNISSQQLQELKTQLNCS

SEQ ID NO: 53387 - DNA, 1212 bp, Magnaporthe grisea 70-15
  CDS (1)..(1212)
atggcagacccggtaacttcgcctcccctcgagagagcctcgatattcgccgcgcacgagctcataaaaccctacgtgcaccggacccccgtgctcaccaatgcgaccctcacggcactggcctcgaccccgcggaccgccgaggacctgcgcggcaccaggtgggccgaccgggccgaccgccccgctcggccggtgctgcggctgtggttcaagtgcgagaactttcagcgcatcggcgccttcaagccgaggggggcgttccacgccgtcgagcgcctcaagcttatccccgggtggctcgagggtcaggggaggactaacggcgtcgtgactgctagctctggcaaccatgctcaggcactagcccttgcggcgcgcacagctggaataccagcacacatcgtgatcccaagcatcgcgccggcaccaaagctggcggcgacgaaggcgctaggggcaaccatctaccgcagcggaagcactggtgctgagcgcgaagcggtggcggccaaggttgttgcagacactggaggccgctatattcctccttatgatcacccggacatcattctgggccagggaacgctgggacttgagatgcaggagcaggttgaggcgctcatggccggcggggatgcagctgcgacaggcggtgatttcactcggcgaggtcaaacctcaggaacgcagggccaagctggaggtcagaagaagggcctcaatgccataatcgcgccatgcggcggcggtggtatgctctcgggtgtagcattatcctgcgagggaaccggcatccgcgtctttggcgccgagcccgagttccagggggcggacgagtgcaagcggtcctttgaggcgggcaagcgcatcgacacggtcaagtcgctaacgatcgccgacggactacggactgcggttggtaaatacccgtggtccatcatctacgagcgccgcctagtgtcgcaaatgttcaacgtgaccgaggacgagatcaaggacgccctgcggctgatcttggagcgcttcaagctagtcgtcgagcctagtgctgctgtgccggtggctgtcgcactattcaacgaggatttcagggccatggtcgagaccgaggccggcgagaacgggtgggatctgggcatcgttctcagtggtggcaacgttagtttggagatgcttgggaagctgttccccgagggcttgcctgcctag

SEQ ID NO: 53388 - protein, 403 aa, Magnaporthe grisea 70-15
MADPVTSPPLERASIFAAHELIKPYVHRTPVLTNATLTALASTPRTAEDLRGTRWADRADRPARPVLRLWFKCENFQRIGAFKPRGAFHAVERLKLIPGWLEGQGRTNGVVTASSGNHAQALALAARTAGIPAHIVIPSIAPAPKLAATKALGATIYRSGSTGAEREAVAAKVVADTGGRYIPPYDHPDIILGQGTLGLEMQEQVEALMAGGDAAATGGDFTRRGQTSGTQGQAGGQKKGLNAIIAPCGGGGMLSGVALSCEGTGIRVFGAEPEFQGADECKRSFEAGKRIDTVKSLTIADGLRTAVGKYPWSIIYERRLVSQMFNVTEDEIKDALRLILERFKLVVEPSAAVPVAVALFNEDFRAMVETEAGENGWDLGIVLSGGNVSLEMLGKLFPEGLPA

SEQ ID NO: 53389 - DNA, 1857 bp, Magnaporthe grisea 70-15
  CDS (1)..(1857)
atggcggcgccctcagatctagaggtcacggcgacaaaaatcaacggttcttcctgccaggagaccgtcaccaatggtgacggtatcaacggccccaatggctgcagcgtggcgcccgcaacgcctgcgacgcccaccactccagttatgactgtaacgcgcccctcgcggacgcccagcttgaccggtctttcactcacagagtacagcgccaacccatcaccaccggcggagagcaaacgtcgaaaggcaaagaaggtgatacctgacgactacatactgccaagtggacaccctgactatctccgcctgatcttgacttccaaggtctacgaggtatgcaaggagacgtcactcacccatgccgtcaacctcagcaacaggctcgagtgcaaagtccttctgaagagggaggatgagcagcccgtcttcagcttcaagctgcgcggtgcatacaacaagatggctcacctcgaccgcgctcaatcatggcggggtgtcgtctgctgctcagctggcaaccacgctcagggggtagccttttctgcccgcaagctcaagatccccgccaccatcgtcatgcccgagggcacgccaagcatcaagcaccttgccgtggctcgtatgggtggccatgtcgtgctgcacgggcccgatttcgacgcggccaaggaggagtgcgcccggcgcgagaagcacgacgggcttatcaacatcccgccctttgacgatccctatgtcatcgccggccagggcaccattggcatggagctgctccgccagaccaacctgcagaagctagaggccatcttctgctgtgtgggcggaggcggtctcatcgccggcataggtgtctacgtaaaacggattgcaccgcacatcaagatcatcggcgtcgagacccatgacgccaacgctatgactcagtcgttggccaagggtgagcgtgtactcctcaaggacgtcggcctctttgcagatggtgccgccgtcaggacagtaggcgaagagaatttccgcatctgccaggaggtcatcgatgagatggtccaggtgactacggacgaggcgtgcgctgccatcaaggacatattcgaggataccaggtccgtcgtcgaacccgccggggctctggctctggccggactcaagaagtgggtcgcggccaacccgtccaccgactcgagccgttcccttgtcgccataactagcggtgcaaacatgaactttgaccggctgcgcttcgtagcagagcgtgccaacgttggtgagggccgcgaggcgctactggcggcccgcattcccgagaagccgggttctttcgccaagctcatcgaagccatcatgcccaacaacgtcaccgagttcacttaccggtacactgatggcgaggtggccaacataatgctgggactctcgctgacagcgccagtagcgcagcgtgcccaccagctgcagctactcatgggccgcatcgcagaggccggtatggaggtgacggacctgtcgggtgacgaactggccaaaagccacgtgcggtatcttgttggaggacgggccaaagtgcccaacgaaaggctgtacatgtttgagttcccggagcggcccggcgcgctggagaagttcctggcaacgctgcggccgcgttacaacatcagcctgttccagtaccgtaactacggcagcgacgtcggcaagatcttggcgggcatccagtgcccagacggagaaatgccggagctggtcaaattcctcaaggagattggatacccgtggtttgactgcacgcaatcggaggtggccaagacctttttgggtggtccaggggtcaacgaagagggggcagtccctctttag

SEQ ID NO: 53390 - protein, 618 aa, Magnaporthe grisea 70-15
MAAPSDLEVTATKINGSSCQETVTNGDGINGPNGCSVAPATPATPTTPVMTVTRPSRTPSLTGLSLTEYSANPSPPAESKRRKAKKVIPDDYILPSGHPDYLRLILTSKVYEVCKETSLTHAVNLSNRLECKVLLKREDEQPVFSFKLRGAYNKMAHLDRAQSWRGVVCCSAGNHAQGVAFSARKLKIPATIVMPEGTPSIKHLAVARMGGHVVLHGPDFDAAKEECARREKHDGLINIPPFDDPYVIAGQGTIGMELLRQTNLQKLEAIFCCVGGGGLIAGIGVYVKRIAPHIKIIGVETHDANAMTQSLAKGERVLLKDVGLFADGAAVRTVGEENFRICQEVIDEMVQVTTDEACAAIKDIFEDTRSVVEPAGALALAGLKKWVAANPSTDSSRSLVAITSGANMNFDRLRFVAERANVGEGREALLAARIPEKPGSFAKLIEAIMPNNVTEFTYRYTDGEVANIMLGLSLTAPVAQRAHQLQLLMGRIAEAGMEVTDLSGDELAKSHVRYLVGGRAKVPNERLYMFEFPERPGALEKFLATLRPRYNISLFQYRNYGSDVGKILAGIQCPDGEMPELVKFLKEIGYPWFDCTQSEVAKTFLGGPGVNEEGAVPL

SEQ ID NO: 53391 - DNA, 1035 bp, Magnaporthe grisea 70-15
  CDS (1)..(1035)
atgggatcctactcagtagagcctgtgaagccatgggttgagaccccatgcttgtactctccccaagtctcgcgcgcagctggctgcaacatctacctcaaattagacaacctccagccctcgggctcgttcaagtccaggggtatcggcaacatgatgcaacgcgccatagccctgacgccgagggacgacgtgcacttctactgcccatcaggcggaaacgccggcctggcctgcgccacgtctgccgcatcactcggcaagcccgccactatcgtcgtcccgatcaagaccccggcccacatggtcgagaagcttgaggcgctaggagcagaggtgctccgccggggcggcagcatcgccgaggcggacgcgtacctcaagtcgcagctgctgataaacgacccgaacggcgtctacgtctcgccctttgaccaccctgacatctgggagggcgcctcgagcatcgtcgacgagatcacgacccagatgaggctgcagccgggagggcccaaggaggccgacggcatcgtctgcaacgttggcggcggcggcctgctgatcggcatcatggacgggctggaccgcatctactgcggccgcccgcagaaccagccccgggtgctggccgtcgagacgcgcggtgccgagagcctcgacgccagcatccgtgccggcgagctggtgacgctgccaaacattacttccatctgctcgtcgctgggcgtagctagagtggcaccccgcgcttacgagtggaccaaggccgcggccggtcagctcgccacgacggtggtggacgacgccgatgccgtcatggggtctgtcaagttcctggacgacgcgaggctgctcgtcgaggttgcctgcggcgctaccatttcggttgtgtacaacggccaactgaggcagaagctggggaagggcctgagcgacgccgagtgggccgagaagaacatagtgctggtggtgtgcggtgggtctcacaccactctcgaggcactgttgaggtacagggaagagtttggagtataa

SEQ ID NO: 53392 - protein, 344 aa, Magnaporthe grisea 70-15
MGSYSVEPVKPWVETPCLYSPQVSRAAGCNIYLKLDNLQPSGSFKSRGIGNMMQRAIALTPRDDVHFYCPSGGNAGLACATSAASLGKPATIVVPIKTPAHMVEKLEALGAEVLRRGGSIAEADAYLKSQLLINDPNGVYVSPFDHPDIWEGASSIVDEITTQMRLQPGGPKEADGIVCNVGGGGLLIGIMDGLDRIYCGRPQNQPRVLAVETRGAESLDASIRAGELVTLPNITSICSSLGVARVAPRAYEWTKAAAGQLATTVVDDADAVMGSVKFLDDARLLVEVACGATISVVYNGQLRQKLGKGLSDAEWAEKNIVLVVCGGSHTTLEALLRYREEFGV

SEQ ID NO: 53393 - DNA, 1746 bp, Gibberella zeae PH-1
  CDS (1)..(1746)
atgccttctgctgatcccatcgtggccgtccctgccaatggcgctgtcaatggcaccgccaatggaacaaatgacgactctcgtccgcagacgccgatgaccggaatggccttgaccgagtatagcgcaaacccctcgacaccgtccgcagagaagcaggctcgcctcaaagagattgttcccgaggaatacctcctccctactggataccctgactaccttcgtctcatcgccggcgctacttctcgagtctacgaggcctgcaaagtcactcccctcacccacgccatcaacctgagcaaccggctcgaatgcaatgtcctcctcaagcgtgaagacgagcagcccgttttcagcttcaagctgcgcggcgcttacaacaagatggcccatctcgaccccaagaagagctggaagggcgtagtctgctgctccgccggtaaccatgcccagggcgtcgcctattccgctcgcaagctcaagatccccgcgaccatcgtcatgcccgaagcgactcccagtatcaagcatctcaacgttgcccgtctcggcggccatgtcgtgttgcacggcgctgactttgacgccgccaaggaggagtgtgctcgacgagaggtccaggatggactcatcaacatcccccctttcgacgacccctatgtcattgctggtcagggcactatcggaaacgaattgttcggccaggtcaacatggccaaggtggaggctatcttctgctgtgtcggcggcggcggtctcattgctggaatcggtctctatgtcaagcgcatggctccccacgtcaagatcatcggtgtcgaggctcaggatgccaacgccatggcgcaatcgctaaagaagggcgagcgagttcttctcaaggaggtcggcctgttcgctgacggcgccgctgtcaagattcccggagaggaaactttccgcatctgcaaggaggttatcgacgatgttatcgaggtgtcaaccgacgagatctgcgccgctatcaaggacatgtacgacgacacccgttcaggtctcgagcccgccggtgccctttccatcgccggtctcaagaaatacgtcagccagaacccctcggacgattcgaagcgcaaccttatcgctgtgacgtccggcgccaacatgaactttgatcgcttgagatttgtcgctgaacgtgccaccatgggtgagggcaaggaagctcttctttctgtccagatccccgagcgtcctggtgctttctccgaactcatcaacaacatcatgccccacggtgtcacagagttcagctaccgatactccacagacgaagtcgccaacatcctcatcggtgtctccctcacagcccccgcccaccaacgatccgaagaactccgctccctcatcgaccgcatccaatcaaacaacatgaccgtgacagacctctcaaacgacgagctcgccaagagccacatccgatatctcgtcggtggacgatccggcgtccccaatgagcgcctctacatgttcaccttccccgagagaccaggagctctcgagaagttcctcgtcacgctccgtcccaagttcaacatcagcctgttccagtaccgtaactacggcggcgacgttggcaagatcgttaccggaatcctatgtcctgacgaagaggtcaccgagcttcacaactttttgcgcaagatcggttatccttacgaggactgcaccgagtcaccagtattcaagacatttttgcgatcatga

SEQ ID NO: 53394 - protein, 581 aa, Gibberella zeae PH-1
MPSADPIVAVPANGAVNGTANGTNDDSRPQTPMTGMALTEYSANPSTPSAEKQARLKEIVPEEYLLPTGYPDYLRLIAGATSRVYEACKVTPLTHAINLSNRLECNVLLKREDEQPVFSFKLRGAYNKMAHLDPKKSWKGVVCCSAGNHAQGVAYSARKLKIPATIVMPEATPSIKHLNVARLGGHVVLHGADFDAAKEECARREVQDGLINIPPFDDPYVIAGQGTIGNELFGQVNMAKVEAIFCCVGGGGLIAGIGLYVKRMAPHVKIIGVEAQDANAMAQSLKKGERVLLKEVGLFADGAAVKIPGEETFRICKEVIDDVIEVSTDEICAAIKDMYDDTRSGLEPAGALSIAGLKKYVSQNPSDDSKRNLIAVTSGANMNFDRLRFVAERATMGEGKEALLSVQIPERPGAFSELINNIMPHGVTEFSYRYSTDEVANILIGVSLTAPAHQRSEELRSLIDRIQSNNMTVTDLSNDELAKSHIRYLVGGRSGVPNERLYMFTFPERPGALEKFLVTLRPKFNISLFQYRNYGGDVGKIVTGILCPDEEVTELHNFLRKIGYPYEDCTESPVFKTFLRS

SEQ ID NO: 53395 - DNA, 1098 bp, Gibberella zeae PH-1
  CDS (1)..(1098)
atggcagacatctcaacttgccctcccctaacaagggactctgttatcgaggcacatcgcctaattgagcctcatgtgcatctaactccagtcatgacaagcagctacattaacaaacttgcttcaacgccaagagaccccgcctcttttgctaatcaaaaaaatctcccgcagcttgccaaacctcagttcaggctgtggttcaaatgcgagaacttccaacgtgctggggcctttaaagcacgtggagctttccacgctattgaaagattaaagttggagcctggatgggctgagaatggtgggaaggaaaaaggcgttgctacacatagctcgggtaatcatgcccaagcgcttgcactagctgcccgagaaaacggcatgcctgctcatgtcgtgatgccttcaatcactattccaagcaaggtcgctgctaccaagggctacggggcaaatgtcatcttcagcactttgaccgatcgccttgctgttgctgaaaacgttgtagcagaaacaggcgcacgccttgttccgccatatgatcaccccgatattattctagggcagggcaccatgggcctcgaactgcagcaacaggtcaaaggcctcaacggcatcattacaccctgcagtggtggcggaatgttgtcgggagtagcattgagttgcgaaaacacagggatcaaagtcttcggagccgaaccttcgtttcaaggcgcggatgatgccaagcggggaatggaacaaggtgaaagaatcacctatgtggatagtatgtccattgctgacgggctgcgctcctacttgggcgtttatccgtggagcatcctctacgagcgaaaacttgtccatggcatgtacagcgtgtcagaagacgagatcaaggcggccatgaagttgatattggagagaatgaagttattcgttgaaccaagtgccgctgtaccacttgcggtagtattgttcaacgaggagttccggtccatggttgagaaagaggcgaaaggggatgtttgggacttgggcattgtgctaagtgggggaaataccacaacagacggcattgcagatctctttccgagcgatgtatacacatag

SEQ ID NO: 53396 - protein, 365 aa, Gibberella zeae PH-1
MADISTCPPLTRDSVIEAHRLIEPHVHLTPVMTSSYINKLASTPRDPASFANQKNLPQLAKPQFRLWFKCENFQRAGAFKARGAFHAIERLKLEPGWAENGGKEKGVATHSSGNHAQALALAARENGMPAHVVMPSITIPSKVAATKGYGANVIFSTLTDRLAVAENVVAETGARLVPPYDHPDIILGQGTMGLELQQQVKGLNGIITPCSGGGMLSGVALSCENTGIKVFGAEPSFQGADDAKRGMEQGERITYVDSMSIADGLRSYLGVYPWSILYERKLVHGMYSVSEDEIKAAMKLILERMKLFVEPSAAVPLAVVLFNEEFRSMVEKEAKGDVWDLGIVLSGGNTTTDGIADLFPSDVYT

SEQ ID NO: 53397 - DNA, 1026 bp, Gibberella zeae PH-1
  CDS (1)..(1026)
atgggatctctagactctggcgcaaaattgccatggattaagacaccatgtatcatcagcactcaattatcccgccttacaggctgcaatgtctatctcaagcttgaaaatcttcaaccttcagggtccttcaagactcgtagcattagtagtctcatgacccaagctgctgccgcagccacaggtcctgttcatttttactgctcttcaggcggcaatgccggtctggcatgcgcaacatcagctatttcgctcggtcataaagccacaattgttatgcctaccattgttagcccgctcatgaaaagcaagctacttgatctgggagtagaagtgcaccagaaaggcaagaactgggctgagtgcgataagtacatgcgcgaagagctggtggccaacgatccttcagctatctatgtcgcaccattcgacgatcctcgactctgggatggagcggcaactatggtggatgagattcgggatcagctcgaggatcgtgtcgatggcatcgtctgcagcgttggcggtggcagtttagttaacggtttaatgcaaggcatcgagagccgtccctggctgggaacaaagcctgccgttctggccgttgagactgagggagccgacagtctcaatgccagtgtcctcgctggagagcacgtaacgctgcccgagatgacttcgatcgcaacgtctctcggtgctacaagagtgtcggagcagacatggaagtggagtcagcatccttcagggatgatgaagagtcttgttgtgtctgacgcagatgctgccataagtactgtgcgatttgcggacgatgcactacagctggttgaagtagcatgtggtgcagcattggcgattgcttatcggggagacctaagggatgttctcggaaagggcttgtctgatgaagaatggagtaagacgaacgtggtgtttgtggtttgtggtggctctggtatcacgttgagtatgttgtctgagtaccgggaaaagtactctggacagtcatccatcaaggtctga

SEQ ID NO: 53398 - protein, 341 aa, Gibberella zeae PH-1
MGSLDSGAKLPWIKTPCIISTQLSRLTGCNVYLKLENLQPSGSFKTRSISSLMTQAAAAATGPVHFYCSSGGNAGLACATSAISLGHKATIVMPTIVSPLMKSKLLDLGVEVHQKGKNWAECDKYMREELVANDPSAIYVAPFDDPRLWDGAATMVDEIRDQLEDRVDGIVCSVGGGSLVNGLMQGIESRPWLGTKPAVLAVETEGADSLNASVLAGEHVTLPEMTSIATSLGATRVSEQTWKWSQHPSGMMKSLVVSDADAAISTVRFADDALQLVEVACGAALAIAYRGDLRDVLGKGLSDEEWSKTNVVFVVCGGSGITLSMLSEYREKYSGQSSIKV

SEQ ID NO: 53399 - DNA, 1197 bp, Gibberella zeae PH-1
  CDS (1)..(1197)
atggcagacatctctaaaactcctcctctgactcgtgactcagtcattgaggctcacaaactcatcggccaatacgtccactatacgccagttctcaccaaccggaccatcacagaacttgcctcaacccctcgtacagcagaggaacttgagggaactcgctatgctggaagaacacccgcccgaccggtgttgagactctggttcaagtgtgagaatatgcagcgcataggcgctttcaaagctagaggcgcttttcatgctgttgagagattaaagcaggaacctggatggttggaaggagggggtaaagagaagggcgttgtcacgcatagttctgggaatcatgcccaggcgttagcccttgctgctcgtgagagtggcatcaatgctcatatcgtcatgcctgagatctccaaccccaagaagatcgccggcacaaaaggctatggtgctcgcgtgattttcagcggaagcacatcaactgaacgtgaagccatggctgaaaaggtaattgccgaaacaggtgctcgccttatcccaccttatgaccacccagatatcatgcttggtcaaggaactatgggattggagttccagcagcaagtcgccgagttgatgacgactgatgctgtggttgatggccaacgaaaactgtttcgtgcaccttcgactgggagggacaatgaggcaccacgtacaaagaaggaaaagccaggcttgaatgccatcatgacaccgctgggtggaggtggcatgctctcgggtgtagctctcagttgcgagggcactggaatccgcgtctttggatcggagccatcctttgaaggagctgatgatggcaagcgtggatacgagtcaggttctcgaatcacagcagtcaagactcttaccgttgccgacggactgcgcactcctgtaggggcccatccttggtcggtcatctacgaacgtcgtttggtgtcaggcatatacagtgtcaccgaagatgagatcctgtcagctatgaagctggtatttgagcgattcaagctcgtcgttgagcccagtgcttgcgttccgctggccgtggcgctgtacgatgaagattttagatccatggttgagaaggaggctggagaagagggatgggatctcggcttggtgtttagcggtggtaatgttggtcttgatgctattggcaagctctttgcgtag

SEQ ID NO: 53400 - protein, 398 aa, Gibberella zeae PH-1
MADISKTPPLTRDSVIEAHKLIGQYVHYTPVLTNRTITELASTPRTAEELEGTRYAGRTPARPVLRLWFKCENMQRIGAFKARGAFHAVERLKQEPGWLEGGGKEKGVVTHSSGNHAQALALAARESGINAHIVMPEISNPKKIAGTKGYGARVIFSGSTSTEREAMAEKVIAETGARLIPPYDHPDIMLGQGTMGLEFQQQVAELMTTDAVVDGQRKLFRAPSTGRDNEAPRTKKEKPGLNAIMTPLGGGGMLSGVALSCEGTGIRVFGSEPSFEGADDGKRGYESGSRITAVKTLTVADGLRTPVGAHPWSVIYERRLVSGIYSVTEDEILSAMKLVFERFKLVVEPSACVPLAVALYDEDFRSMVEKEAGEEGWDLGLVFSGGNVGLDAIGKLFA

SEQ ID NO: 53401 - DNA, 2019 bp, Ustilago maydis 521
  CDS (1)..(2019)
atgtacgacaagcaagtacaagtggtgactcaatcctcagatcctccaagcatccctttccgccatacgctgcggagcatcgaccttgttttggtccgggaaacgcgcagcttgatacagccaccaactatggcggacaccgcttcgacgtcgtcgtcttcggcggcgtacctttcgggacccttcccctcggctcgagcactgaccgagaacgatgtcacaccgtcagtgccacccactcggtcagaggagaaatctgcgcctacgcatctctacacggatctgccgcctcatctgatgcaggcagacaacacacccgactatctgcggctcatcctcaatgcggacgtctacgatctagtaaagcagacaccgctacaggcgggagtcaacctgtcgtccaagttgggctgtcaagtgcttctcaagcgcgaagatttgcagcccgtgttcagcttcaagctgcgtggtgcgttcaacatgatgcagcagctcgattcggagcaaaagtggaagggggtgatcgcttgttcggctggcaaccacgcgcagggtgtagctatggcgggtgcgcatctcaagatcccgtgtacgattgtgatgcccaagggtacaccggagatcaagacggcgaatgtcaagaggctgggtgccaaagtggtgctgttcggacaggatttcgatgaggccaaggcagagtgtacgcggctgtccaaggcgtatgggttgacgattatcccgccgtttgatcatcctcgcgtgatcgcaggtcagggtacgatcgctgtcgagatctgccgtcagacagacatgtcgcaagtcgacgctatcttctgctgcgtaggtggcggaggcttgctggccggtgtggcggcttacattaaacgcatcgctccgccgcatgtcaaggtgatcggtgtcgagacgttcgatgcggatgcactggctcagtcgctcgaagctggacatcgcgttctattgaatgaagtcgggcttttcgccgacggtaccgcggtgcgcatcgtgggcgaggaatgtttccgcatctgccgcgataccgtcgacggcgtggtgcgtgtaacgaacgacgaaatctgcgccgctatcaaggacacgtttgaagacacacgctctatcccggaaccgtcaggtgctctcgccgtcgccggtatgaagcgctacattgccgcgcacaatctgcaaggctcgggcaagaaattcgtcgcgctcgtctcgggcgccaacatgaactttgggcgcttgcgcttcgttgcagaacgtgccgagctaggcgaaaacaaagaagcgctcttgagcgtcgagatcgcggaagaaccgggcgcgttcttgaagctgcacaaccatatcaacccgaggatggtgaccgaattcagttatcgatacggcgatagcagcaaggcacagatcttactgtcattcatgctgaacggcaccaacgcgcgtgctgctagcgcgagcagcgaatcgcaatcgcatgcgagcggcgccgtacctgtacctgaagtggtgacgaatacggcctcgactggtgatgcgtcgatctcgtcgtcaagcgcatcgatcgatacagatgtgaaccagctcgctcagtcggtggcgccatcgacactgtcgacgtcgagcgaactcgcgtcgatccttgccgctctcactgcggacggcatgacaccgatcgacctgtcaggcgacgaagtgtccaagtcgcacctccgctacctcgtcggcggcaagacgagcgtcgccaacgaacgcattttccgcttcgagtttccggaacgtcccggtgcgctgcgcaagttcttggtcggaatgcagagcggctggaacatcagcttgttccattaccgaaaccacggtgctgacatgggcaagatcttgctaggcatccaagcgccgaaacaagatgagatcaagtttgaaaccttcctcaaggagctcggataccagtatcatgaagagaccaacaaccctgtgctgaggagatatctcgcacaataa

SEQ ID NO: 53402 - protein, 672 aa, Ustilago maydis 521
MYDKQVQVVTQSSDPPSIPFRHTLRSIDLVLVRETRSLIQPPTMADTASTSSSSAAYLSGPFPSARALTENDVTPSVPPTRSEEKSAPTHLYTDLPPHLMQADNTPDYLRLILNADVYDLVKQTPLQAGVNLSSKLGCQVLLKREDLQPVFSFKLRGAFNMMQQLDSEQKWKGVIACSAGNHAQGVAMAGAHLKIPCTIVMPKGTPEIKTANVKRLGAKVVLFGQDFDEAKAECTRLSKAYGLTIIPPFDHPRVIAGQGTIAVEICRQTDMSQVDAIFCCVGGGGLLAGVAAYIKRIAPPHVKVIGVETFDADALAQSLEAGHRVLLNEVGLFADGTAVRIVGEECFRICRDTVDGVVRVTNDEICAAIKDTFEDTRSIPEPSGALAVAGMKRYIAAHNLQGSGKKFVALVSGANMNFGRLRFVAERAELGENKEALLSVEIAEEPGAFLKLHNHINPRMVTEFSYRYGDSSKAQILLSFMLNGTNARAASASSESQSHASGAVPVPEVVTNTASTGDASISSSSASIDTDVNQLAQSVAPSTLSTSSELASILAALTADGMTPIDLSGDEVSKSHLRYLVGGKTSVANERIFRFEFPERPGALRKFLVGMQSGWNISLFHYRNHGADMGKILLGIQAPKQDEIKFETFLKELGYQYHEETNNPVLRRYLAQ

SEQ ID NO: 53403 - DNA, 1131 bp, Ustilago maydis 521
  CDS (1)..(1131)
atggtctcgttcaaagacattcaagaggcgcacgtccgtgtctcaccgtacactcactatacgcccgtactcaccaaccaggcgatcgaccaactcgcgaccgagtcactctttggccctgccacatctgcttctccttcgcccagacctcgcatacgtctcgcctttaaagccgagcatcttcagcgcgtaggagcattcaagtaccgaggcgctaccaactctgtgcttgtccacctcggcgcagctaaagcgcaacacgatgcctcggcatccaaatcgaccaagttcagcccgggcaagctggttgttgtaacgcattccagcggaaaccatgctgctgcgcttgcgtgtgctgccaagtcggccggctgtgtcgcagcggttgtgatgccgaacaacgcgcccaagccgaagaaggaggcggttgctgggtacggcgccagaatcacgttctgcgagccaacgctcgaggcacgtgaatcgacggccgaggctgtcatgcaggattacgagaagcaggggtatatcgtgcgctttgtacatccgtatgatgagccattagtgattgctgggcagggaacgatggcgctcgaattgctggatcaggctgcacaactggaggagtgggcaacttgctcgcatgcagctgatcgcataccgtcaaacgcaagaccactgcatggtacaagaaacgtcgctccctccggcccgaaggcggagtcagtatggcgaaagagagacatgtcggaagctgcgctcgatatcatcatcgctcccgttggaggcggaggaatgctctctggtgtcgctaccgcaatcaagggagccgacgaccgaatcgttgtcatcggcgctgagcccgacctagtcgacgacgctttccactcataccaaacaggttcagtacaacagccaccgcagcctccgaaaaccatctgcgatggactcctcacctcgctctcgcctctgacactcgaacacatccgaaatcacgtcgatggcatcgtcacggctcgtgaagaaaacgtgctgaaagccttacagctgcactggacccgacagaagcagtttgtcgaaccaagcgctgccgcttcaatcaagctgcagagcaggcaggtggtgctttga

SEQ ID NO: 53404 - protein, 376 aa, Ustilago maydis 521
MVSFKDIQEAHVRVSPYTHYTPVLTNQAIDQLATESLFGPATSASPSPRPRIRLAFKAEHLQRVGAFKYRGATNSVLVHLGAAKAQHDASASKSTKFSPGKLVVVTHSSGNHAAALACAAKSAGCVAAVVMPNNAPKPKKEAVAGYGARITFCEPTLEARESTAEAVMQDYEKQGYIVRFVHPYDEPLVIAGQGTMALELLDQAAQLEEWATCSHAADRIPSNARPLHGTRNVAPSGPKAESVWRKRDMSEAALDIIIAPVGGGGMLSGVATAIKGADDRIVVIGAEPDLVDDAFHSYQTGSVQQPPQPPKTICDGLLTSLSPLTLEHIRNHVDGIVTAREENVLKALQLHWTRQKQFVEPSAAASIKLQSRQVVL

SEQ ID NO: 53405 - DNA, 1086 bp, Aspergillus nidulans FGSC A4
  CDS (1)..(1086)
atggctcctcaactcccgaccccaaattctatacaagaagcttacaccctcataaccccgtacatccaccgcaccccgctccttacaaatcgcaccctcaacgccattgcttcagcccggcagtcacccgatgcgctacgcggaacacctttcgaaggctcgaccccagcgcaccccaagataaacttcttcttcaaatgcgagaactttcaacgcatcggcgcgttcaaggcccgcggcgcatttcacgcgctgctgaggctgattgagcgtgagggcgaggagaatgcccttgcgctcgcctcctcaactctcgggattcccgcgtatattgtcatgccgaaaatcagcactccctccaagatcgcagggacgcagtctcacggcgcagaagtgattttcagcggctcaacgagtgtagagcgggaagcggtagttgcggacgtccaagcgcgcacaggggcgattcttgtcccaccgtatgacgattaccatattatttgcggccaggggacgacgggactagagatgcatgcacagtatcttgatgctgtgcgcgagaagcctgagttgagtgtacatgagtccgagtctccgtccgctagggaaggtctagatgcggtgattacgccgattggaggaggcggtctcaattccggggttgcaactttcttctcggataagacgacgaaagtctttggcgcggaaccgagcttcgagggcgcggacgattgtcggcgtgggcttgacgctggacagagggttgagagcgtgaagactctgacgattgcggatgggttaagaacgccggtgggcgtgttgaattgggaggttatttcagacaagagcaaagtggcgggtgtgttttccgtcactgaggagcagatcaaggctgcaatgaggcttgttctggaacgaatgaaggtggttgttgaaccaagcgctgttgtgggattggctgtttgtctgtataatgaggagtttcgacggcttgtcgaacgcgaggcgccagccggctgggatgtaggaattgtgtttagtggtgggaatacgacggttgaggcgattgggaaattgtttggttga

SEQ ID NO: 53406 - protein, 361 aa, Aspergillus nidulans FGSC A4
MAPQLPTPNSIQEAYTLITPYIHRTPLLTNRTLNAIASARQSPDALRGTPFEGSTPAHPKINFFFKCENFQRIGAFKARGAFHALLRLIEREGEENALALASSTLGIPAYIVMPKISTPSKIAGTQSHGAEVIFSGSTSVEREAVVADVQARTGAILVPPYDDYHIICGQGTTGLEMHAQYLDAVREKPELSVHESESPSAREGLDAVITPIGGGGLNSGVATFFSDKTTKVFGAEPSFEGADDCRRGLDAGQRVESVKTLTIADGLRTPVGVLNWEVISDKSKVAGVFSVTEEQIKAAMRLVLERMKVVVEPSAVVGLAVCLYNEEFRRLVEREAPAGWDVGIVFSGGNTTVEAIGKLFG

SEQ ID NO: 53407 - DNA, 1764 bp, Aspergillus nidulans FGSC A4
  CDS (1)..(1764)
atgaccgagaacgcgtccatgaatggcgctgcgacaccactttcctcgaggttgagcaatttggctctgacggaatactctgctattccgactcctacttcggagaaggaagaatacaaaggacccgacagtccacccgcgtgggatatccctgatgctttcttacttcccaatggctacccggatgtgcgacatgtccctgctgcctacccaaatcgttctaccgctaacaatcgttatctgcagtatcttaaactgattttgacttcccgcgtctacgagatcactaccgagtcccctctccaccatgcagtcaatctcagtaaccgaatggaatgtcgagtgcttctcaagcgggaagacctgctacctgtattcagcttcaaactccgcggagcatacaacaagatggctcatttgaccgacgagcagcgatggaaaggcgtgattgcttgctcagcaggcaatcatgctcagggtgtcgcgtactctgcccgcaagctcaaaattcccgctaccattgtcatgccctccggcaccccagcgatcaaacacttgaatgtcgctcgccttggcggtagtgttgtccttcatggaaacgatttcgacgctgccaaagaagaagctcaccgccgggaaaagcagcacggtcttacaagcattccccccttcgatgacccgtacgttattgctggacaaggaaccatcggaatggagatcttgcgccaagcgaatctggacaagctggaagctgtcttttgcgccgttggcggaggaggtctgatctccggtgttggcgtttacatcaagcgcattgcgccgcatgtcaaggtcattggtgtggagacccacgacgccaacgcaatggcccagtctcttgatgaaggctctcgtgtgttgctgaacgaggtcggcctctttgcagatggcgctgcggtcaagagtgtggggtcggaatgttggcgcgtggcccgcgaggtagtagatgagattatcttggtttcaaccgatgagacttgcgctgcgatcaaggatgcatttgaggatacacgctcgatcatcgaacccgctggtgcgctggccattgcaggattaaagaaatatgtcgccaagcgccccagccccaacaccagccgtgaactggttgcaatcacctcgggagcaaatatggattttgaccggctgcggtttgttgcggaacgcgctgccttgggggagaaaaaggaagctcttctgagcgtaaaaatccctgaacaaccgggcgctttcgccaagctagtggaggtcgtccttccgcatgctgtaaccgcattcaactaccggtatgctgatgaaacaactgccgatgttctcatgggtatctccttgtccgcttcaacaggtcaagaagacctggctaagattatgacggaattaacccgaaacggcatggactcgaaggatctcagcgatgatgagcttgctaaacggcacctgcgcttcttggttggcggacgcagtgaagtgaaggatgagcgcctgttcatgttcgagttccccgagcgtcccggagcgttagccaaatttctcaggacgcttcgtcctagccagaacatctctctattccactaccggaattacggcggcgatgttggcaaggttctggcgggtattcagtgcccggaatgcgagaaggaacaacttgaggctttcctcaaggaccttggatacccatttaccgaggagacgcaatccgaaacttacaagactttccttcgtcgttga

SEQ ID NO: 53408 - protein, 587 aa, Aspergillus nidulans FGSC A4
MTENASMNGAATPLSSRLSNLALTEYSAIPTPTSEKEEYKGPDSPPAWDIPDAFLLPNGYPDVRHVPAAYPNRSTANNRYLQYLKLILTSRVYEITTESPLHHAVNLSNRMECRVLLKREDLLPVFSFKLRGAYNKMAHLTDEQRWKGVIACSAGNHAQGVAYSARKLKIPATIVMPSGTPAIKHLNVARLGGSVVLHGNDFDAAKEEAHRREKQHGLTSIPPFDDPYVIAGQGTIGMEILRQANLDKLEAVFCAVGGGGLISGVGVYIKRIAPHVKVIGVETHDANAMAQSLDEGSRVLLNEVGLFADGAAVKSVGSECWRVAREVVDEIILVSTDETCAAIKDAFEDTRSIIEPAGALAIAGLKKYVAKRPSPNTSRELVAITSGANMDFDRLRFVAERAALGEKKEALLSVKIPEQPGAFAKLVEVVLPHAVTAFNYRYADETTADVLMGISLSASTGQEDLAKIMTELTRNGMDSKDLSDDELAKRHLRFLVGGRSEVKDERLFMFEFPERPGALAKFLRTLRPSQNISLFHYRNYGGDVGKVLAGIQCPECEKEQLEAFLKDLGYPFTEETQSETYKTFLRR

SEQ ID NO: 53409 - DNA, 1278 bp, Aspergillus nidulans FGSC A4
  CDS (1)..(1278)
atggcgttcgtgaagagaataccctggatcgaaacacccctgattgaatctgcttccttatcaaagacggctggatgcagagtattcctcaaactagacctccttcagccttctggctctttcaaatctagaggaattggaaacctcatctgcaatgcccttcaagacccagccaacagaggcaaagaactccacttctttagctcctctggcggaaacgccggtctggctgccgttatcgcggcgcgtgatctcggctgccgttgtacagttgtcgtgccgtactcgacgaaacctatgatgatcacaaagctgcgggaggccggtgccactgatgtgatccaacatggggacagttggtttgaggccgatacgtatcttcgggagacatttattgagaatcaggaccaaggaggcgatgccgcgacaaagaggaatatctacgttccaccgtttgatcatccgcagatctggaagggtgtcgggactatgattgatgagatcgcacagcaaatgccgcctagggatgtttcgaaaggttcttttcccgcagatgctgtgatttgtagcgttggtggaggtggcctctttaatggtgtggttgaggggctgggtcgacatctggcaactaaaaatggcgatgctcctgggggcaaggtccgcgttttagccgtcgaaactgaaggaactgattccctcgctttgtcccttcgaaaaggtacattgcagccgctcccggctattacgtccctcgctacatcgctaggagcacttcaagtggcgccgcagactctgaagaacgcgcagtgcccgcccgccagagtagatgtcgtcagcgttgtcggctctgatgcggaagctgcccaaggcgtgattcggctcgcggatgaacaccggttgcaagttgaattggcttgtggtatcagtgtagaggttggtggctcggtgaagctgagggattacatgcctgatctgacgccggacagccggatagttattgttatttgtggaggaagcaatgtcactgcggagatggtggtggagtataggaaaaggcttcatgatggttgggatagcgcatacgcggcttttgcgtcgcctgcggtcggatccgtagttcacgcatttgacgccattcttggtagtcaggtccccgtcttatttctaatgtatccatccatatgctccagctgtaaagctgccagcataaacaagaagagcacaatgcactccagctttacttggagaagtagacaaattcagacttcgactgtgtga

SEQ ID NO: 53410 - protein, 425 aa, Aspergillus nidulans FGSC A4
MAFVKRIPWIETPLIESASLSKTAGCRVFLKLDLLQPSGSFKSRGIGNLICNALQDPANRGKELHFFSSSGGNAGLAAVIAARDLGCRCTVVVPYSTKPMMITKLREAGATDVIQHGDSWFEADTYLRETFIENQDQGGDAATKRNIYVPPFDHPQIWKGVGTMIDEIAQQMPPRDVSKGSFPADAVICSVGGGGLFNGVVEGLGRHLATKNGDAPGGKVRVLAVETEGTDSLALSLRKGTLQPLPAITSLATSLGALQVAPQTLKNAQCPPARVDVVSVVGSDAEAAQGVIRLADEHRLQVELACGISVEVGGSVKLRDYMPDLTPDSRIVIVICGGSNVTAEMVVEYRKRLHDGWDSAYAAFASPAVGSVVHAFDAILGSQVPVLFLMYPSICSSCKAASINKKSTMHSSFTWRSRQIQTSTV

SEQ ID NO: 53411 - DNA, 2076 bp, Gallus gallus
  CDS (1)..(2076)
atgcacttatgtgacatggccggggtatgggcttgccttaaactggacatgaagaaggcaccagtgaagccatcccgagctttagtcttagagctgactgcccttttgtctcctcacttctggcagcagcatgctgcagggttatggactcctagggttatgcagaaggactcccatccccatcccactacgcagccatctcgtgtttggaaagccctcaccgcttttgtcacaaaagcctgtgtcccccggtgctgccctaaaggatctctgcacgtgactcaaacaccacaggaagaagttgggccttccttgctacttgtgtcgaccctagtgcatgttgttaactcgtgggccctgcacaagtcggccgctcttcccacccaggcagtgcagggctggcagtgcccgtgggcaagcgtgtccctcctgctgtgctttgcacctggaattacaatgaattttgcagcacagttgatctactccagggtgttaaaaaacagaactcccagggaccgctacagggaagatgaagactacgatcctttctggcaaagttatgctgagcagctgttcttgaaaaaggatgacagtaaagtaaagaaacaagatgccccagcactttgcgatcttcgcctttgtaaggatgggccaataagaaatggacacattgggcagaggccacccccaatcaaccctgaaagactgaaggatttcgttgaggaggattacctcaatggggatgtgaagacgtgggaaatgaagatcgtcagccgtaatgaggagttacttggggatgccctttccctcgtccctcagtcaagcagcaggatcagcctgtccagccacaacaaattgattcgatttgaagacattagtgcagcagctttcaaaatccagtccggtgttcagaaaaccccttgcatgtactccaggctatccaagctgtacggagttgacatctacctaaagaaagagttcctccagtacacgggatctgtgaaggagcgaggtgtactttatcttctgacatcactgcctcaggatcagcaaaggaagggggtgattgtggcttcagatggcaacttttccatggctgttgcttaccatgcttcagagcttcgtatcccagtgtttgtcatcatgtcaaccagcacttcccctgccagagtgaaaacgtgccgtgaatacggtgccatggttatatcctatggcactacagctaaggactcccagatgcatgcaagaaggttggcacaggagaatggctatctctacctggaagaggaggacagtgctgtgtacctgtcgggcctgggcaccatggggctggagatgtatgagcaggtgcccaagctggatgcggtgattttccctgcaggaggccactgtggcttgctggcgggctcggctgctgcactcaaacacctcaacccacgtatttctgtcatcggggttgagtctgaaagctttcctgtattgcagcagtccctgaaggctggccatccagctgaagaccaggcttgcaacaaccaccacttttatggagatgtgagcggactttgcttcggcagcaattctttgcagctgactgggaagcttgtggataaggttgttgctgtgagcgaggaggacgtcctcatttcaatgctgagattgctggagtatgagcgagccacagttgatgcagaaggggccattggacttgcagcactggttgctgggaagctgcctgagttgaagggtaaaagagtggcgattgctatatgcagcggaaatgtggacttgcatttgctgcaacgatgcattgctcgtgccctgacccttgagagcagagtgtgcagattttccctggtgatttctgacagcccagcagatgtttcaaagctactggaggttttggctcgggaggaagcaagagttttggatatcagacaagaacgcacatttgtgacatctgagctcttcactgttgaggtcacctgcaccgtggagaccagagacaagatccacacagcccagctgcggaacgcgctgctggaacgctaccccacagccgcgtggacggagcgatga

SEQ ID NO: 53412 - protein, 691 aa, Gallus gallus
MHLCDMAGVWACLKLDMKKAPVKPSRALVLELTALLSPHFWQQHAAGLWTPRVMQKDSHPHPTTQPSRVWKALTAFVTKACVPRCCPKGSLHVTQTPQEEVGPSLLLVSTLVHVVNSWALHKSAALPTQAVQGWQCPWASVSLLLCFAPGITMNFAAQLIYSRVLKNRTPRDRYREDEDYDPFWQSYAEQLFLKKDDSKVKKQDAPALCDLRLCKDGPIRNGHIGQRPPPINPERLKDFVEEDYLNGDVKTWEMKIVSRNEELLGDALSLVPQSSSRISLSSHNKLIRFEDISAAAFKIQSGVQKTPCMYSRLSKLYGVDIYLKKEFLQYTGSVKERGVLYLLTSLPQDQQRKGVIVASDGNFSMAVAYHASELRIPVFVIMSTSTSPARVKTCREYGAMVISYGTTAKDSQMHARRLAQENGYLYLEEEDSAVYLSGLGTMGLEMYEQVPKLDAVIFPAGGHCGLLAGSAAALKHLNPRISVIGVESESFPVLQQSLKAGHPAEDQACNNHHFYGDVSGLCFGSNSLQLTGKLVDKVVAVSEEDVLISMLRLLEYERATVDAEGAIGLAALVAGKLPELKGKRVAIAICSGNVDLHLLQRCIARALTLESRVCRFSLVISDSPADVSKLLEVLAREEARVLDIRQERTFVTSELFTVEVTCTVETRDKIHTAQLRNALLERYPTAAWTER

SEQ ID NO: 53413 - DNA, 1083 bp, Candida glabrata CBS138
  CDS (1)..(1083)
atgtcagtatacaacaagacaccactaatacgtcagatatttccaagcataccacagatgtacttgaaacatgaatgtttccaaccaagtggaagtttcaaaagcagaggtattggccatctaatatcgaaacaatcacaaagaatattaggcaatggcctgggtaagaagccaatggtattcgccagctctggtggtaatgcaggactagcagcagccacagctgcaaaatttttaaacctaccttgtaccgtcgtcataccaaccgctacgaaacagaggatggcagataagattagagctaccggagctaatgtcattgtttctggtaacttctggaaggaggcagataactacctgaaagataatatcctatctaagttagaagagttacataaaaatgtggaaccaatatatgtacacccatttgataatccagatatatgggaaggtcatgcttcaatggtagatgaaattgttgaagactttaaaaataaaatgatacctcttaacaagataaaagctatagtgtgcagtgttggaggaggcggactttacaatggtataatacaaggcctcgaaaaatataacttagctgacaagatacctattgtaggcgtagagactaaaggttgccatgtattcaatacatctttgagaatgaacaaagtggtgagcttcaagaagatcaccagtattgctacctcgttaggtactgccgacatatctacagaggcctttaaatacgccaaaagatatggtacgaagtctgtggttttaagtgatcaggacgttgtcaagacatgcctaagatacactcatgactttaacatggtaattgaaccagcatgtggcgctgccgtccatttggcttatcacaccgagatcttagaaaaagaactcggcacaaaactaaatgcggatgacattgtactagtagtggcctgtggaggttcatcgaacactgtcgaagatatggaatcgatactacaaagactgtccaccgaggagaataacatcaatatcccaaatgttgcagaaaatattattgtcagaatgcctgaggtgtctgtcctagcttaa

SEQ ID NO: 53414 - protein, 360 aa, Candida glabrata CBS138
MSVYNKTPLIRQIFPSIPQMYLKHECFQPSGSFKSRGIGHLISKQSQRILGNGLGKKPMVFASSGGNAGLAAATAAKFLNLPCTVVIPTATKQRMADKIRATGANVIVSGNFWKEADNYLKDNILSKLEELHKNVEPIYVHPFDNPDIWEGHASMVDEIVEDFKNKMIPLNKIKAIVCSVGGGGLYNGIIQGLEKYNLADKIPIVGVETKGCHVFNTSLRMNKVVSFKKITSIATSLGTADISTEAFKYAKRYGTKSVVLSDQDVVKTCLRYTHDFNMVIEPACGAAVHLAYHTEILEKELGTKLNADDIVLVVACGGSSNTVEDMESILQRLSTEENNINIPNVAENIIVRMPEVSVLA

SEQ ID NO: 53415 - DNA, 1716 bp, Candida glabrata CBS138
  CDS (1)..(1716)
atgatacccaagctgctgtgtggtaacacactgttgagtgcatctgttacaacaagtaggtctgtctatggcttatctaccagatattttactcaggatctcgcaccttcattggttaaactgcattccgagttaaagcctgatgagcttcttactgataacacaccagactatgtgcgtttggtgctaagatcatcggtctatgatgttataaaggaatcgccaatctcacatggtgttggtctatcgtctagactaaacacaaatgtccaactgaaaagagaagatttactaccagtgttctctttcaagctgcgtggtgcatacaacatgatagcgaagttagacgatactcagagaaatcaaggtgtcatcgcatgttccgcaggtaatcatgcacaaggtgtagcatatgccgctagacatttggatattccagcaactattgtcatgcctgtgtctactccatctataaaatatcaaaatgtgtcgagactgggttcacaagttgttctatatggtaatgattttgacgaagctaaagctgaatgtactaaactggcagaagagcgtggtttgactaacatccctccatttgatcatccatatgtcattgctggtcaaggaacagttgcgatggaaatcttgagacaggtctataactcaaataagatcggtgctgtctttgttccagttggtggtggtgggttgattgccggtgttggtgcctatttgaagagagtcactccacacatcaagattataggtgtggaaacacatgatgcagcaactttacacacatctcttcaaagaaataaaagaacaaatctagctagcgttggtacttttgctgatggtacttctgtgcgtattattggtgaagaaacctttagagttgccagagaagttgtcgatgaaattgtattggtcaatactgatgaaatttgtgctgcggttaaggatgtctttgaggataccagaagtattgttgaaccatctggtgctcttgcggttgctggtatgaagaagtatattactcaacttcatccagaaatagatcactctaagcaaacatatgtcccaattttgtcaggtgctaatatgaacttcgatagattaagatttgtttctgagcgtgctgtattaggtgaaggtaaggaagtttttatgctggttaccattcctgacgttccaggctctttcaaaaaaatgcagaaggttattcatccaagagctgttactgagttctgttaccgttataatgaacatcgtcatgaatcttctagtgaggttccaaaggcctatatctatacatctttcagtgtggtagaccgcgaaaaggagattaaacaagtaatgcagcaactgaacaccctcggttttgaagccgtcgatatttctgacaatgaattagcaaaatcacatggtagatatttagttggtggtgcgtcaaaggtcccaaatgaaagaattatttcgttcgaattcccagaaagacctggggccttaaccagattcttggcaggtttaagcgagtcttggaatttgacattgttccattacagaaaccatggtgctgatattggtaaagtattggctggtatttctgtgccacctagagaaaatttaactttccaaaaattcttggaagatttaggctataagtaccaagatgaaacagaaaatatggtatatcaaagactactgaaatattaa

SEQ ID NO: 53416 - protein, 571 aa, Candida glabrata CBS138
MIPKLLCGNTLLSASVTTSRSVYGLSTRYFTQDLAPSLVKLHSELKPDELLTDNTPDYVRLVLRSSVYDVIKESPISHGVGLSSRLNTNVQLKREDLLPVFSFKLRGAYNMIAKLDDTQRNQGVIACSAGNHAQGVAYAARHLDIPATIVMPVSTPSIKYQNVSRLGSQVVLYGNDFDEAKAECTKLAEERGLTNIPPFDHPYVIAGQGTVAMEILRQVYNSNKIGAVFVPVGGGGLIAGVGAYLKRVTPHIKIIGVETHDAATLHTSLQRNKRTNLASVGTFADGTSVRIIGEETFRVAREVVDEIVLVNTDEICAAVKDVFEDTRSIVEPSGALAVAGMKKYITQLHPEIDHSKQTYVPILSGANMNFDRLRFVSERAVLGEGKEVFMLVTIPDVPGSFKKMQKVIHPRAVTEFCYRYNEHRHESSSEVPKAYIYTSFSVVDREKEIKQVMQQLNTLGFEAVDISDNELAKSHGRYLVGGASKVPNERIISFEFPERPGALTRFLAGLSESWNLTLFHYRNHGADIGKVLAGISVPPRENLTFQKFLEDLGYKYQDETENMVYQRLLKY

SEQ ID NO: 53417 - DNA, 1134 bp, Kluyveromyces lactis NRRL Y-1140
  CDS (1)..(1134)
atgtatgtccatatctttccaacttcatatagtcaaacgagtattaatagattaataatgaaagcccaattgttcagcaaaacaccgttattgaaacatcaattcaaaagaagtaaaggccctcaagtgcttttgaagtatgaatttttacagccgagtggtagtttcaaaagtagaggtatcggacatttaatctctacaaaggtagaagaaataaagaaatcctcgcctgaaaaaatcggtcacgtgtttgctagctctggcggtaacgctggattggcggcggcggttgcgtccctcgaattgaacgttccctgtacagtagttgtgtcgaatgcaacacgtccaagaattatagaaaagattcgctcctacggcgcagatgttgttgttcatggtaaccattggaaagaggcagattctttcatgaaggagcaccttatgaagaaacttgattcctttaaatacgagccaatttacagccatcctttcgataatccgctaatttgggaaggccattcctttatggtggatgaaatcatggatgtcttggctagttcaaaaatacctataaccaaaattaaaggtattgtttgcagttttggaggcggaggtctatataacgggttgattttgggtttgcaacggtataatttagctgacaaaattccgatagtatgtgtcgaaacgaagggaacagacgtattgagcgcctctttgcgtgtaggagcaccagtggagtttgaaaaaatatccagttgtgctacttcactagggacagcaaccatatcaacaacggcttaccaaaatgtgaaacgtcacggaagcaagtcagctgtcatctctgatactgaagtgatttcaacttgccttcaattttctaacgataccaacatagttgcggaacctgggtgtggggcaacgttatacttcgggtataatatcgataaactacaaaatattctcggttcagacattaaagatgatgattatgtcatcttgatcggttgtggtgggtcatctacaagcttagaggatcttaaagagttatctagttttactaattgtgaatttgagcttccttctactggtgtgagccgtctgaattcccattcgttacacacactccagtag

SEQ ID NO: 53418 - protein, 377 aa, Kluyveromyces lactis NRRL Y-1140
MYVHIFPTSYSQTSINRLIMKAQLFSKTPLLKHQFKRSKGPQVLLKYEFLQPSGSFKSRGIGHLISTKVEEIKKSSPEKIGHVFASSGGNAGLAAAVASLELNVPCTVVVSNATRPRIIEKIRSYGADVVVHGNHWKEADSFMKEHLMKKLDSFKYEPIYSHPFDNPLIWEGHSFMVDEIMDVLASSKIPITKIKGIVCSFGGGGLYNGLILGLQRYNLADKIPIVCVETKGTDVLSASLRVGAPVEFEKISSCATSLGTATISTTAYQNVKRHGSKSAVISDTEVISTCLQFSNDTNIVAEPGCGATLYFGYNIDKLQNILGSDIKDDDYVILIGCGGSSTSLEDLKELSSFTNCEFELPSTGVSRLNSHSLHTLQ

SEQ ID NO: 53419 - DNA, 1704 bp, Kluyveromyces lactis NRRL Y-1140
  CDS (1)..(1704)
atgctacaatctatagtgagaactcctagagttcttcgtgcttcaaatgcattaaaactttctgttcgctgtgttagcacggaccagttctctgataatttgcagaggatgtactcccatttgaaggctgacgaacgattggaagatggatctccagactacgtgcgtttaattttaaggtcttctgtttatgaagtcattgaagagacccccatttcacgtgcggtgtcattgtcctctagactaaacactaacgttaaattgaaaagagaggatttgttgccagtgttttccttcaagctgcgtggtgcttataacatgattgccaagctagacgaaacacagaagaatgctggtgttattgcgtgctctgctggtaatcacgcacaaggtgttgccttttcaagtaatcatatgaacattccagctaccattgtgatgcctgtttcaacaccatcaatcaaatatcaaaacgtgtcgagattaggtgcccaagtggttctatacggtgacgacttcgatgaagccaaattggaatgtgcgaggttagctgaagaacgtggtatgacagatattccaccatttgatcatccttacgttatcgctggtcaaggtactattgccatggagattctaagacaagtacaaaatgggtctaacatcggagcagtgttctgtgccgtaggtggtggtggtttgatttcaggtattggttcatacttgaagagaatcgcacctcatatcaaggttattggtgtggaaacttacgatgccgctacgttagatgtttcattaaagaacggtaaacgtaccccattgccaagtgttggaacgttcgctgatggtacctctgtgaggttaatcggtgaagaaacattccgtgtttgtcaagacgtagtcgatgaagttatcttggtgaacaccgatgaaatctgtgctgccgttaaagatgtgtttgaggacacaagatcaattgtcgaaccaagtggtgctcttgctgttgccggtttgaaaaaatatgtctctcaactacaccctgaaatagaccattctaagaagacatacgttccaattctttccggtgccaacatgaatttcgaccgtttaagattcgtctcagaacgtgctgtattgggtgaaggtaaagaagtgtttatgttggtcaccattccagatactccaggttctttcaagaagctacagaatgtgatccatccaagagctgtcactgaattctcataccgttataacgagcattgtcacgaaaatgactccgatgtaccaaccgcttgtatctacacatcttttaacgtcgttgaccgtgaaaaggaaatcaagcaagtggttcaacaattgcatgctttaggtttcgaagccgtagatatctctgacaacgaaatggccaagtctcacggtagatatttggtcggtggtgcttctaaaattgaaaatgagaaagtcattgcattcgaattcccagagagaccaggtgcactaactaaattcttatcaggattgaacgtttcctggaacttgactttattccattacagaaaccatggcgctgatattgggaaaattttggctggtatcagtgtgcctccacaagacaacgaaatcttccaaaagttcttggacgatctaggatataaatatcaagatgaaactgacaatatggtttaccagaagtttttgaagtactag

SEQ ID NO: 53420 - protein, 567 aa, Kluyveromyces lactis NRRL Y-1140
MLQSIVRTPRVLRASNALKLSVRCVSTDQFSDNLQRMYSHLKADERLEDGSPDYVRLILRSSVYEVIEETPISRAVSLSSRLNTNVKLKREDLLPVFSFKLRGAYNMIAKLDETQKNAGVIACSAGNHAQGVAFSSNHMNIPATIVMPVSTPSIKYQNVSRLGAQVVLYGDDFDEAKLECARLAEERGMTDIPPFDHPYVIAGQGTIAMEILRQVQNGSNIGAVFCAVGGGGLISGIGSYLKRIAPHIKVIGVETYDAATLDVSLKNGKRTPLPSVGTFADGTSVRLIGEETFRVCQDVVDEVILVNTDEICAAVKDVFEDTRSIVEPSGALAVAGLKKYVSQLHPEIDHSKKTYVPILSGANMNFDRLRFVSERAVLGEGKEVFMLVTIPDTPGSFKKLQNVIHPRAVTEFSYRYNEHCHENDSDVPTACIYTSFNVVDREKEIKQVVQQLHALGFEAVDISDNEMAKSHGRYLVGGASKIENEKVIAFEFPERPGALTKFLSGLNVSWNLTLFHYRNHGADIGKILAGISVPPQDNEIFQKFLDDLGYKYQDETDNMVYQKFLKY

SEQ ID NO: 53421 - DNA, 1719 bp, Debaryomyces hansenii CBS767
  CDS (1)..(1719)
atgatgattgccagaaacctattgaagggcatacacaagcctgtaaacagaagggtttgtataccaaaaattggttcgttaacttcggccaaattctattccactcaatctacggttcaacaatttccagaattgcaagaagctgattttacgcccgaaggtgagccagattatattaagttgatattgacatctcgggtttacgatgtcgtcgatgaaggtggatctcctctcactcatgctgttaacttatcacagaaatgcaataccaatatattcttaaagcgtgaagatttattaccggtattttcattcaagttacgtggagcatataatatgattgcacatttacattctaattcaaagtcaccagtatcaggggtaattgcatgttctgctggtaatcatgcacaaggtgttgctttctctgctagtaaattaaagattcaatctactatagtcatgccaacagctactccttctatcaaatataaaaatgtttctagattaggatcacaagttgttttatacggagacgattttgatagcgcgaagaaagaatgtgatcggttgagttcattgaacggattgaccaatatccctccttttaaccacccatatgtcatcgcaggtcaaggtactatagccctagaaatcaccagacaattgaggttagacaaacttgatgccttatttgttccagtaggtggaggtggattgatagctgggattgctgtttatttaaaaaagattgctccccatgtcaagattattggtgtcgagacttttgatgcagatgcattgtatcagtcattgcaaaaccatcaactgaagacattggatcaggttggagtttttgctgacggtactgctgtcaaggttcttggtgatgaaacttggaagctttgccataaatatgttgatgaagtagttagggttctgaccgatgaattatgtgcagcaattaaagatatttttgaagataccagactgattgttgaaccatctggagcgttatctgttgctgggttgaagagatatcttagtgataattctgaaattgatcataggaataagaattacgttccaattttaagtggagccaatatgaatttcgatagattaagatttgtaagtgaaagagctgtactcggtgaaggtaaggaagtatcattagctgtcaccattcctgagagacctggtgagtttgctatattacagaatataatcgacccaagagctattacagaattttcctatagatttaacaatagtggtcctgcaaatatttttgttagtttcaatgttaccaataaggacaaagaattagctcctattgttgaatctatgaagagtaatgattatgaagttattgatatctcagagaatgagttggcgaagactcatggtcgttatttagtcggcggaaaatctacaacggctaactgcaataagatttctaaagaaaggttattcagattcgaatttcctgaaagaccaggtgctttaacaaaatttttacaaaccttgaagtatgattgggatataaccttgtttcactatagaaatcatggccatgatgttgggaagattttgtgtggttttgtacttccagaaggcacaagcgatgaggacttccaggatttcttgaaaaaaattggttataattttgttgatgaaacagacaatgtcgtatataaaaaattcttacaaagctag

SEQ ID NO: 53422 - protein, 572 aa, Debaryomyces hansenii CBS767
MMIARNLLKGIHKPVNRRVCIPKIGSLTSAKFYSTQSTVQQFPELQEADFTPEGEPDYIKLILTSRVYDVVDEGGSPLTHAVNLSQKCNTNIFLKREDLLPVFSFKLRGAYNMIAHLHSNSKSPVSGVIACSAGNHAQGVAFSASKLKIQSTIVMPTATPSIKYKNVSRLGSQVVLYGDDFDSAKKECDRLSSLNGLTNIPPFNHPYVIAGQGTIALEITRQLRLDKLDALFVPVGGGGLIAGIAVYLKKIAPHVKIIGVETFDADALYQSLQNHQLKTLDQVGVFADGTAVKVLGDETWKLCHKYVDEVVRVLTDELCAAIKDIFEDTRLIVEPSGALSVAGLKRYLSDNSEIDHRNKNYVPILSGANMNFDRLRFVSERAVLGEGKEVSLAVTIPERPGEFAILQNIIDPRAITEFSYRFNNSGPANIFVSFNVTNKDKELAPIVESMKSNDYEVIDISENELAKTHGRYLVGGKSTTANCNKISKERLFRFEFPERPGALTKFLQTLKYDWDITLFHYRNHGHDVGKILCGFVLPEGTSDEDFQDFLKKIGYNFVDETDNVVYKKFLQS

SEQ ID NO: 53423 - DNA, 1809 bp, Oryza sativa (japonica cultivar-group)
  CDS (1)..(1809)
atggcggccgccgccaccgccgcggccgcggccacctccaccttcaccgccgccgtgccgcgcgcgcgcgggcgcaggcatccaacgcgcgtggcggcggcggcggcggcgacggcgtcgtcaccggaggcggcgatggcggcggcggcgccgccgttgccgatgatgcgggtggcgcccgagacgctgcagcggcagagcgggtacctcgtgcggggccgcggggaggaggggattggggagggggaggcggaggcggtgggaggggacgcggcgggagggctcggcgcgatggagtacctgaccagcgtgctctcgtccaaggtgtacgacgtcgccatcgagtcgccgctccagctcgccaccaagctctccgagcgcctcggcgtcaacttgtggatcaagcgcgaggacctgcagcccgtattctcattcaagttgagaggagcatacaatatgatggcaaagctctcgcgtgaacagttggagaggggtgtcatctgctcctctgctgggaaccatgcccagggagtggccctttccgctcaaagactcggttgcgatgctgttattgtcatgcctgtgacaacgcctgaaatcaagtggcgatcggtggagagattgggtgcaacagttgtactcaaaggggactcatatgatgaagctcaatcatatgcaaaacaaagatgcgagcaggaaggccgcacattcatacctccttttgaccatcctgatgttataagtggacaaggaacgattggcatggaaattgttcggcagttgcaaggcccacttcatgccatatttgtacctgtaggaggaggtggattaattgctgggatcgctgcctatgtaaaaagggttcgcccagaggtgaaaataattggagtggagccatcagatgcaaatgcaatggcattgtccttgtgtcatggtcaaagggtcatgctggagcaagttggtgggtttgctgatggtgtggctgtcaaagttgtaggggaggaaacatttcgcttgtgccgggaacttgtagatggtattgttcttgtcagtcgagatgctatttgtgcttcaataaaggatatgtttgaggagaaaagaagcatacttgaacctgctggtgcccttgcgctggcaggagctgaagcttactgcaaatactatggcttgaaaggggaaaatgttgttgcaataactagtggagcaaatatgaactttgatcggctcagattagtaactgagctggctgatgttggtcgaaaacgagaagcagttcttgccacatttttgccagaggagcagggaagcttcaaaaagtttgcagagctggttggccggatgaatattactgaattcaaatacagatacgattgcaatgcaaaagatgcccttgtcctttacagtgttggcatctacactgacgatgaacttaaagcaatggtggaacgtatggaatcttcaaaattgagaactgttgatcttactgacaatgatttggcaaaggatcatctaagatactttattggtggcaggtcagaagtaacagatgaacttgtttaccggttcattttcccagaaaggcctggtgcacttatgaaatttttggatgcattcagcccccgctggaatatcagccttttccattaccgtgcacaggtgtgtgacagatttattattcatcagtttccctgctgtaaagtagtcttgtatgaaaattgcaatctcatgcatctgaaatcgtcattttattgccatctatcctgtacaatattccctttccattttcacttgacaaaaatgtacatctaa

SEQ ID NO: 53424 - protein, 602 aa, Oryza sativa (japonica cultivar-group)
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQVCDRFIIHQFPCCKVVLYENCNLMHLKSSFYCHLSCTIFPFHFHLTKMYI

SEQ ID NO: 53425 - DNA, 1020 bp, Oryza sativa (japonica cultivar-group)
  CDS (1)..(1020)
atggggagcagaggtggaagtggcggcgatggcgcagaaagccatggctatgccgcggacatccactccatcagggaggcgcaggctcgcatcgcaccatacgtgcacaagacgcccgttctgtcatcaacatcgatcgatgccatagtggggaagcagctgttcttcaagtgcgagtgcttccagaaggcaggggcgttcaagatccgaggcgcttccaattcgatatttgcgcttgatgatgatgaggcatccaagggcgttgtgacgcatagcagtgggaaccatgctgctgcagtggctcttgctgcaaagctacgcggaatacctgcttacattgtcattccaagaaatgcaccggcatgtaaggttgacaatgttaagcggtacggtggccatattatctggagtgatgtctccattgaatcaagagaatctgttgctaaaagagttcaggaggaaactggtgctattcttgttcacccattcaataataaaaacactatcagtggtcaaggtacagtgtctctcgaacttttggaggaagtccctgaaattgacacaataattgttccaatcagtggtggtggtttaatttctggtgtggcactggctgccaaggccataaacccttcaatacgtattctggcagcagaaccaaagggtgctgatgattctgcccagtccaaggctgctggaaagatcataacattgccttcaaccaacaccattgctgatggacttcgagcttttcttggtgacctgacatggccggtggtgcgcgacttggtggatgatatcattgttgtggatgacaatgccattgtggacgccatgaaaatgtgctacgagatgctgaaggtggctgttgagccgagtggagcaataggcctcgcagccgccctctctgacgagtttaagcaaagctctgcttggcatgagagcagtaagatagggatcattgtttctggaggcaatgttgacctcggtgtcctctgggagtctctctataaacgttga

SEQ ID NO: 53426 - protein, 339 aa, Oryza sativa (japonica cultivar-group) [sequence omitted]

SEQ ID NO: 53427 - DNA, 972 bp, Yarrowia lipolytica CLIB99
  CDS (1)..(972)
atgactggcgaaggaatcacctacaaggatgtcaagcacgcacacaagcgactcgacaaggtcgccgtcaagacacccgtgctgtcgatccagctcgacgacactcaatactttctcaagtgcgagaatatccagcgaaccggagccttcaagttccgtggagcctacaatgccttgtcgcagttctcgtccaagcaaaaggccggtggagtactaacgtactcatctggtaaccatgctcaggccattgcccatgctgctgccatgctcggaatcaaggccaccatcatcatgcccacggatgcccctaaaagcaagttgcaaggtaccaaggacctgggggctacaattgtgccctacgacagatacaaacaggaccgtgacgaggtagccaatgcaattctcacggaacatcccgaaatgacgctcattcctccatatgatcatcccgacatcatcgcaggacaaggtacagtggtcaaggagctgctagaggaaacaggacctctggacgatatctttgtgccgctgggtggaggaggactgctggcaggctcccttctggcagcagaaaaactcgctccaaagtgtaaggtgtggggtgtggagcccgagacaggaaacgacggtaagctgtcacttcaaagaggccaaatcgtgcatattgacaccccggtgacgattgccgacggtgctcagacccagcatctgggagaactcaccttccccatcattcagagacttgtcacggatatcaagacggtcaacgagggagagatgattgctatgacgcaatggtacgcccgaaagatgaagctggtggtggagccaactggatgcatggctttggcagcggcgttctcgtgctgtggaggcacccacaagaagcgagtgggagtcatcatcagtggaggaaacgtggatctcgataagtatgccacctatctaaccactccggtcgttcagcattga

SEQ ID NO: 53428 - protein, 323 aa, Yarrowia lipolytica CLIB99
MTGEGITYKDVKHAHKRLDKVAVKTPVLSIQLDDTQYFLKCENIQRTGAFKFRGAYNALSQFSSKQKAGGVLTYSSGNHAQAIAHAAAMLGIKATIIMPTDAPKSKLQGTKDLGATIVPYDRYKQDRDEVANAILTEHPEMTLIPPYDHPDIIAGQGTVVKELLEETGPLDDIFVPLGGGGLLAGSLLAAEKLAPKCKVWGVEPETGNDGKLSLQRGQIVHIDTPVTIADGAQTQHLGELTFPIIQRLVTDIKTVNEGEMIAMTQWYARKMKLVVEPTGCMALAAAFSCCGGTHKKRVGVIISGGNVDLDKYATYLTTPVVQH

SEQ ID NO: 53429 - DNA, 1590 bp, Yarrowia lipolytica CLIB99
  CDS (1)..(1590)
atgtccgaacccgactatctgaagctcatcttgaagagccgcgtctacgacgtgtgcaaggaaacacctgtgacatctgctcatggtctgagcgagaagctgggctgcaaagtgctgctcaagcgggaagatcttcagccggttttctcgttcaagctgcgaggagcctacaacatgatttcgcagctgagtgacgaggaaaagtggaagggagtgattgcgtgtagcgccggtaaccatgcccaaggagtcgccttttcagccaactatctcaacattccagcgactattgtcatgccgttggccactccttccatcaagcacagtaatgtttctagactaggtggcaaggtggttttgcacggagacgattttgattcggccaaggcccactgcaagcagctgtgtgagaaatatggactcacagatatccctccctttgatcacccccacgtgattgcaggccagggaactattggtatggagattcttcgtcaggcgtcggacaacctgaaggccgtgtttatctgtgttggaggcggcggtctgattgccggagtaggcgcttacatcaagcggatccagcccgatgtcaaaatcattgccgtggagacctatgatgcatgtgctctgaaacagagtctcatcaagggcgaacgggtgactctgcctgaagtcggtctgtttgccgatggagctgctgtcaagctgtgtggcgaggagactttccgactctgtcgcaagtacgttgatggagttgtgcttgtgaacacggacgagatctgcgccgctatcaaagatgtatttgaggccactagatcggtggtggagcctgctggtgctctgtcggtggctggtctcaagaagtactgctccgacccctcggccatttggtggtcacctgagtccgattccgcaaaggccaatggtatccccactaacgttgccatctcagaaaccgacgagtatctgtcaattctctctggagccaacatgaactttgaccggcttcgattcgtggccgaacgagctatgcttggagaaggaaccgaagtcttcatggtcgtcaccatccccgatattcccggagcgtttgaaaagctgcacgagatcattctccccagagctgtcaccgagttctcctacagaaagaagtccactgctgagaacgaagacgctaacatttttgtgtctttttcagtcaaaaaccgacaagaggaaattgcagacgtgctggaaaagctgcaagctgccggtatgagcggagtcgacgtttcagacaacgaactggcaaagacccacgctagatatctcgtgggaggccagccagacgtgcctaatgagagactgttccggttcgagttccctgaacgacccaacgcgctcaaaaacttcctcggaggtgtccagacaaagtggaatatcaccctgttccactacagaaacaacggcagtgatattggaaagattctgacagccttggacgtgccggaaagcgacaatgaggcgctcaaggagtttcttgagaagctcaagtacccctttgtggaggagacagacaatgtggtgtacaagcagtttatgaagtaa

SEQ ID NO: 53430 - protein, 529 aa, Yarrowia lipolytica CLIB99
MSEPDYLKLILKSRVYDVCKETPVTSAHGLSEKLGCKVLLKREDLQPVFSFKLRGAYNMISQLSDEEKWKGVIACSAGNHAQGVAFSANYLNIPATIVMPLATPSIKHSNVSRLGGKVVLHGDDFDSAKAHCKQLCEKYGLTDIPPFDHPHVIAGQGTIGMEILRQASDNLKAVFICVGGGGLIAGVGAYIKRIQPDVKIIAVETYDACALKQSLIKGERVTLPEVGLFADGAAVKLCGEETFRLCRKYVDGVVLVNTDEICAAIKDVFEATRSVVEPAGALSVAGLKKYCSDPSAIWWSPESDSAKANGIPTNVAISETDEYLSILSGANMNFDRLRFVAERAMLGEGTEVFMVVTIPDIPGAFEKLHEIILPRAVTEFSYRKKSTAENEDANIFVSFSVKNRQEEIADVLEKLQAAGMSGVDVSDNELAKTHARYLVGGQPDVPNERLFRFEFPERPNALKNFLGGVQTKWNITLFHYRNNGSDIGKILTALDVPESDNEALKEFLEKLKYPFVEETDNVVYKQFMK

SEQ ID NO: 53431 - DNA, 990 bp, Yarrowia lipolytica CLIB99
  CDS (1)..(990)
atgcgaccaggctacattgaaacaccgctgctgaagaacgacatcttctcgcaccaggtcgggtgcaacgtgtacctgaaaatggagaacttgcagccctcagggtcgttcaaatcccgaggcatgacccaggtcatctccgatgcgctggactcagacccccaggcttctctagacactctccacgtgtgttccagctctggaggcaacgcagggctcgccgcagcagtcacctcgcgactcaatggtgtcgcgtgcacggtggttgtgccggaatcgactaaacctcgaatggtggagaaactgagagctgcaggagcagaagtgattgtgcacggaaaacactggtcagaagccaacgactttctgcaaaaggaagagatgccgcggctcgaaaagacgggaaaaacgccaatctactgccatccctttgacgctccagcggtgtggaagggaaactcgactctcatcgacgaaatcatcaagcagggaatcaccccagacgccgtcgtgtgcagcgtgggaggcggaggactgttcaacggagtagtcgagggccttaaacgacacaagctcaactgccccgtgattgtagtggaaacaaacggtgctgatgctctgagccggagtctacagaagggcgagcaggtcactctacctggaattacgtcaattgccacttctctgggagccgttcgagtcgctgacaagacgtttgaaaacgcccagacataccctactgtgtctgcagtcgtttcagatgacgacgcagtatcagctctggtggagtacgctgagaccaagcagatcatcgtggaacccgcctgtggagcttccctcgctgttctgcctgctctaaaggatctggttgatttgaaacctgattctaacgttgttgttgttctctgtggaggctcggctactggcatttctgatatcgcgcagttcaagaaagacttggaagcaaaggagacaactgaagagaagtag

SEQ ID NO: 53432 - protein, 329 aa, Yarrowia lipolytica CLIB99
MRPGYIETPLLKNDIFSHQVGCNVYLKMENLQPSGSFKSRGMTQVISDALDSDPQASLDTLHVCSSSGGNAGLAAAVTSRLNGVACTVVVPESTKPRMVEKLRAAGAEVIVHGKHWSEANDFLQKEEMPRLEKTGKTPIYCHPFDAPAVWKGNSTLIDEIIKQGITPDAVVCSVGGGGLFNGVVEGLKRHKLNCPVIVVETNGADALSRSLQKGEQVTLPGITSIATSLGAVRVADKTFENAQTYPTVSAVVSDDDAVSALVEYAETKQIIVEPACGASLAVLPALKDLVDLKPDSNVVVVLCGGSATGISDIAQFKKDLEAKETTEEK

SEQ ID NO: 53433 - DNA, 1179 bp, Canis familiaris
  CDS (1)..(1179)
atgcccactcacctggtggttcgagagttcagtgagaccccatacagcaacccttggcaggggatcgggcacaaacagacgctcaggcaaccgatgacgcctggagagcccctgcacgtgaagacccccatccgtgacagcatgtcgctgtccaaagtggcaggcaccagcgtctacctcaagatggacagtgcccaaccttcaggctccttcaagatccggggcattggacacctctgcaagatgtgggctgagcaaggctgtgaacatttcgtctgctcctcggcgggcaatgcaggcatggcagccgcctatgctgccaggaagctgggcatccctgccaccatcgttgtgcccagcaccacccctgccctcaccattgagcggctcaagaatgagggtgccatagtcaaggtggtgggtgagatgttggatgaggccttcgagctggccaaggccctggccaagaacaaccctggctgggtgtacattcctccctttgacgaccccctcatctgggaaggccacacttccatcgtgaaggagctgaaggagaccctgagtgcaaagccaggggccatcgcgctgtcagtgggcggtgggggcctgctgtgcggagtggtccaggggctgcaagaggtgggctggggggacgtgcctgtcatcgccatggagaccgccggagcccacagcttccacgctgccaccactgccggcaagctggtctccctgtcccaggttaccagcgtggccaaggccctgtgcgtgaagactgtgggggctcaagccctgaagctgtttcaggaacaccccatcttctctgaagtcatctcggaccaggaggctgtggctgccattgagaagttcgtggatgacgagaagatcctggtggagcccgcctgcggggcagccctggccgccgtgtacagccgcgtggtgcagaagctgcaaggggaggggaagctccaggccccgctgtcctccctcgtggtcattgtctgcgggggcagcaacatcagtctgagccagctgcgggcccctcaaggaacagctgggcatgaatgggctgcccaacctgtggcccggaccagccggttccctcctcgttcccatgagcccaccctgccaacaggccgcagctccgaggcggagccgggtcggcagccagcaaagctgtga

SEQ ID NO: 53434 - protein, 392 aa, Canis familiaris
MPTHLVVREFSETPYSNPWQGIGHKQTLRQPMTPGEPLHVKTPIRDSMSLSKVAGTSVYLKMDSAQPSGSFKIRGIGHLCKMWAEQGCEHFVCSSAGNAGMAAAYAARKLGIPATIVVPSTTPALTIERLKNEGAIVKVVGEMLDEAFELAKALAKNNPGWVYIPPFDDPLIWEGHTSIVKELKETLSAKPGAIALSVGGGGLLCGVVQGLQEVGWGDVPVIAMETAGAHSFHAATTAGKLVSLSQVTSVAKALCVKTVGAQALKLFQEHPIFSEVISDQEAVAAIEKFVDDEKILVEPACGAALAAVYSRVVQKLQGEGKLQAPLSSLVVIVCGGSNISLSQLRAPQGTAGHEWAAQPVARTSRFPPRSHEPTLPTGRSSEAEPGRQPAKL

SEQ ID NO: 53435 - DNA, 936 bp, Thermus thermophilus HB27
  CDS (1)..(936)
atgccttccctccaagacctctacgccgccttccgccgcatcgccccccacacccaccgcacccccctcctcacctcccgcctcctggacgggcttttgggaaagcgcctcctcctcaaggccgagcacctgcagaaaacggggagcttcaaggcccggggagcgctttccaaggccctcgccctggaaaaccccaaggggctcctcgccgtctccagcggcaaccacgcccagggggtggcctacgccgcccaggtgctcggggtgaaggccctggtggtcatgcccgaggacgcgagcccctacaagaaggcctgcgcccgggcctacggggccgaggtggtggaccggggggtgacggcggagaaccgggaggaggtggcccgggcccttcaggaggaaacgggctacgccctgatccacccctttgacgaccccttggttatcgccgggcaagggacggcggggcttgagcttctggcccaggcggggcggatgggggtcttccccgaggccgtcctcgcccccgtggggggcggggggctcctcgcgggcctggccacggcggtgaaggccctctcccccacgaccctcctcctcggggtggagcccgaggtcgcggacgacgccaggaggagcctggaggcgggaaggcttttccgcttggaagcgccccccaggacccgggcggacggggtgcggacgctaagcctgggggagcacaccttccccatcctcaaggagaaggcggacgggatccttgtggtgagcgaggaggcgatcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 53436 - protein, 311 aa, Thermus thermophilus HB27
MPSLQDLYAAFRRIAPHTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAENREEVARALQEETGYALIHPFDDPLVIAGQGTAGLELLAQAGRMGVFPEAVLAPVGGGGLLAGLATAVKALSPTTLLLGVEPEVADDARRSLEAGRLFRLEAPPRTRADGVRTLSLGEHTFPILKEKADGILVVSEEAILEAERLLFTRTKQVVEPTGALPLAAVLEHGARLPQTLALLLSGGNRDFSP

SEQ ID NO: 53437 - DNA, 1269 bp, Listeria monocytogenes str. 4b F2365
  CDS (1)..(1269)
atggaattagttgatttattagtaacagaagaagatgtcgaaaaggcctatgaagtcttaaaggcggtcgtcaaacatacgccactagaatatgatttttatctttcggaaaaatatcattgcaatgtctatctgaaacgcgaagatttgcaaagagtgcgttcttttaaattacgtggtgctttttatgctatttctagattatcagcggaacaattggaaaaaggtgtggtatgtgcaagtgcgggaaaccatgcgcaaggagttgcatatacgtgcaaacgaatgaccgtcccagctacgatttttatgccaacgactacgccgcaacaaaaagtatcacaagtaaaatttttcggtggtagtaatgtcgaagtggttttagttggcgatacgtttgatgcttctgcaactgccgcgaaagaatttgctgcaacgcatggccaaactttcatccctccgtttgatgatcctgatattatcgctggccaaggctctcttgctgtggagatggtgaaagatttaaataaagcacatgagcaagcagattatgtttttgcaggaatcggtggtggtggcttaattagcggtgttgcaacgtatctcaaagcaaagagcccgattacaaaaatcatcggggtagaacctgatggcgcgccttcaatgacagcagctttaaaacaaaatcaagtcgtaacactagataaaatcgataaatttgttgatggcgctgcggtaaaagaagttggtggcttaacgttccaacatgcgaaagtattagttgatgaagtgacaaccgtctctgagggagctgtttgttctacgattttggatatgtatacgaagcaagcaattgttgcagaacctgctggagcactatccgttgccgcacttgaaatttaccgtgaagagattaaagacaagaccgttgtctgtattgtaagtggcggaaacaacgacatcaaccggatgcaagaaattgaagagcgttccctcttacacgaaggattaaaacattattttatcgtcaatttctcgcagcgtcctggggctttgaaagaatttgttaacgatgtgctcggtccacatgacgatatcaccaaattcgaatatacgaaaaaagtgaatcgaggtaatgggcctgtaattatcggtgttttgttgcaagataaaaatgattatgaaggattgcttgagcgggttgctgcttttgacccgagctatattccgattaatgataatcaaaccctatacacattacttgtataa

SEQ ID NO: 53438 - protein, 422 aa, Listeria monocytogenes str. 4b F2365
MELVDLLVTEEDVEKAYEVLKAVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAATHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGGLTFQHAKVLVDEVTTVSEGAVCSTILDMYTKQAIVAEPAGALSVAALEIYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLERVAAFDPSYIPINDNQTLYTLLV

SEQ ID NO: 53439 - DNA, 1206 bp, Picrophilus torridus DSM 9790
  CDS (1)..(1206)
atggaattcgatgatatattatatgcaaaatcagttgtatcaaggtatctgcacaggacgcctgtttttcattcaaagaccttcagcgacatgttccacggagatatattttttaaaatggagaatttccagaagaccggctcatttaaatcaaggggtgcagttacaaagttctcaaggttaagcgatgaggaactaaaaaacggtgtcataacggcaagcgctggaaaccatgcgcagggcgttgcatatgccgcatcgatctttaaaacagatgcaaagatagtaatgcctgaaaacacaacaccggcaaaggtaaacgctgttgaggcatacggcggccatgtgatactaaccgggagatcatacgatgaatcacatagccatgcattaaaaatagcaatggatgaaaatagaacatttatagaggcatacaatgatgaggccattatagcaggccagggtacaatagcacttgagctctttgaggatcttggaaatcttgatcagataatagtgcccattgggggtggcggtttaatatccgggatagcctttgccgcaaagcacataaatccaaatgtaaaaatcataggggtcgaatcagaaaaggcaaatgcaatgatgctatcattaagggaaaacagaatagttccatacacaagctctgatacaatagccgatggcatagccgtgaaatatcccggggatataacatttgacattgtaaaaaactatgttgacgatgttgttacagtaaatgatgaaagcatagcctattcattgtttaaactgcttgagcgtgaaaaggttcttgttgagccatccggggcagttggtcttgccgcactctacgagggtaagatagactcagaatcaaagaaaactgcaataatactatcaggcggaaacataaattttctgctgctatcaaaaattatatacaaatccatggagatggagaataaattaataaggcttgagttcaaccttcctgacaggccgggaaccatggtaaaaatagtaaacgcaatatcaagcgttggcgcaaatatataccatgccgaggtcgataatttaaaaaagaacacgcctataggctatcaaaatcttacatttaccgtaaacatagttgacgcaaatagaatagaaaaactattgaacgcactggactcccttggatataaatataatataataaattaa

SEQ ID NO: 53440 - protein, 401 aa, Picrophilus torridus DSM 9790
MEFDDILYAKSVVSRYLHRTPVFHSKTFSDMFHGDIFFKMENFQKTGSFKSRGAVTKFSRLSDEELKNGVITASAGNHAQGVAYAASIFKTDAKIVMPENTTPAKVNAVEAYGGHVILTGRSYDESHSHALKIAMDENRTFIEAYNDEAIIAGQGTIALELFEDLGNLDQIIVPIGGGGLISGIAFAAKHINPNVKIIGVESEKANAMMLSLRENRIVPYTSSDTIADGIAVKYPGDITFDIVKNYVDDVVTVNDESIAYSLFKLLEREKVLVEPSGAVGLAALYEGKIDSESKKTAIILSGGNINFLLLSKIIYKSMEMENKLIRLEFNLPDRPGTMVKIVNAISSVGANIYHAEVDNLKKNTPIGYQNLTFTVNIVDANRIEKLLNALDSLGYKYNIIN

SEQ ID NO: 53441 - DNA, 1149 bp, Picrophilus torridus DSM 9790
  CDS (1)..(1149)
atgagtgtcttaaaatgcccggtatgcgggaacgaatatgatataaacagaagcaattatctctgcgataaatgcggaaacatacttgaggtaattcatgaaaatgattttgtaaaagaaaattttaggggtgtctggaggtacaaaagcattatacatccgggcatagataaaaggctaattgttacaaggggtgagggcaatacctttgtgtacggtcatgaaaatatatcatcatattcaggaataaaaaatataaaactgaagcatgagggtgaaaatccaacaggttcatttaaggatcgtggcatgacagttgcagtatccgaggccatgaggctcggatataaaaagaccctatgcgcatcaaccggaaatacatccgcatctgctgcaagctattctgcaatggcaggcattgaaaacttcgtcctgataccagatggtaaaatagcggtaaacaagcttgcccaggcctacgtttatggttcaaaaataataaaggttcctggcaatttcgacgatgcaatggggaagctaatgaacataatatctaaaaataataatttttatgttttaaattcaataaatccctggcgtgttgagggtcaaaaaaccattgcctttgagatacttgaggaaaatgagccggactttatagcactacctgcaggaaaccttggaaacacaacggcaataggcaaggcaataaaggaatttcatgatcttggtttaataaaaaagataccaagaatcgtttcagttcaggccgagggcgcaagcccattctataaccttgtcaataaccatgagggcagtcttaatccggtaaatcctgaaacaattgcatcggcaataagaataggaaaccctgtcaactggaaaaaggcattaaaatacataaaattcacaaaaggtatagtcgagaaggttacagatgacgagatactaaatgcaaaaagaattatagacagatccggaataggctgtgaaacggcctctgccgcatcacttgcaggtgtaaaaaagctctcagatgcaggtataatagacagaaacgatgaggttttttgtatattaaccggaaacgttttaaaggatatacatatagaaaatataaattccatggatattaatattttatcttaa

SEQ ID NO: 53442 - protein, 382 aa, Picrophilus torridus DSM 9790
MSVLKCPVCGNEYDINRSNYLCDKCGNILEVIHENDFVKENFRGVWRYKSIIHPGIDKRLIVTRGEGNTFVYGHENISSYSGIKNIKLKHEGENPTGSFKDRGMTVAVSEAMRLGYKKTLCASTGNTSASAASYSAMAGIENFVLIPDGKIAVNKLAQAYVYGSKIIKVPGNFDDAMGKLMNIISKNNNFYVLNSINPWRVEGQKTIAFEILEENEPDFIALPAGNLGNTTAIGKAIKEFHDLGLIKKIPRIVSVQAEGASPFYNLVNNHEGSLNPVNPETIASAIRIGNPVNWKKALKYIKFTKGIVEKVTDDEILNAKRIIDRSGIGCETASAASLAGVKKLSDAGIIDRNDEVFCILTGNVLKDIHIENINSMDINILS

SEQ ID NO: 53443 - DNA, 1266 bp, Bartonella henselae str. Houston-1
  CDS (1)..(1266)
atgagtaaatttattcaagatgtaaacaaggctatggtggctttgcataatgtatttgctgaaacacctcttcaaagaaatgattttcttagtcaaaaatatgatgcagaaatttatttgaaacgtgaagatttaactccggtgcgatcttataaaattcgcggtgcttttaattttgtttcagaaatgcttagtaagatatctcaaaatgcagcatttgtttgtgcgtcagcggggaatcacgcgcaaggggtttcatttgtttgtcgctattttaaacgtaaaggcgtgatttttatgcctgtgacgactccgcaacagaaaattgataagacgcgcgtttttggcaaagagtttgttgatatccgtttaattggtgaaacgtttgaccaatgttatgcggcagcacaatcttttgctacggagagtggtggtgttatggcaccgccttttgacgatactcgcattattacggggcaggcgacagttttgtgtgaggctgttttgcaatggaaaaaactcaatggtgaaagcgagccagatttgattcttgttcctgtaggtggaggtggtttggccagtggtgtgagcaagtttttacatgaatatggttggaaaaccgagcttcgctttgttgagccgaagagagctgcaagcttgttcgcttgtttgaagagtggaaaacgtgtcaaacttgaaaatatcgatacatttgtagatggagctgctgtagcggaaattggtgcattaaattacacaatgctgaagaatttttcaccagattctgttattacagttcctgagaaccgtgtgtgctctacaatggttgaaatgctcaatgttgaaggtgtggtccttgaaccagctggtgctttatcgattgatgctcttaatagtcttcctcctcaagagttaaaaggcaaaaaaattcttcttgttatttcaggtggtaattttgattttgagcgtttgccagatattaaagaacgttctctccgttttcagggattgagaaaatattttatttttagttttccgcaacatcctggtgcgttgcgtagttttcttgctcaactttctcccgatgatgatatcgtacgttttgaatatcttaagaaatcatctagaagttttggctctgtgttgattgcaattgagacaaaaaaatatgataatttttgtcttttagagaaaaaatttcaagagttaggttggcgctatcgtgatattaccgatgatcaaacgttatttgattttgttatctga

SEQ ID NO: 53444 - protein, 421 aa, Bartonella henselae str. Houston-1
MSKFIQDVNKAMVALHNVFAETPLQRNDFLSQKYDAEIYLKREDLTPVRSYKIRGAFNFVSEMLSKISQNAAFVCASAGNHAQGVSFVCRYFKRKGVIFMPVTTPQQKIDKTRVFGKEFVDIRLIGETFDQCYAAAQSFATESGGVMAPPFDDTRIITGQATVLCEAVLQWKKLNGESEPDLILVPVGGGGLASGVSKFLHEYGWKTELRFVEPKRAASLFACLKSGKRVKLENIDTFVDGAAVAEIGALNYTMLKNFSPDSVITVPENRVCSTMVEMLNVEGVVLEPAGALSIDALNSLPPQELKGKKILLVISGGNFDFERLPDIKERSLRFQGLRKYFIFSFPQHPGALRSFLAQLSPDDDIVRFEYLKKSSRSFGSVLIAIETKKYDNFCLLEKKFQELGWRYRDITDDQTLFDFVI

SEQ ID NO: 53445 - DNA, 1539 bp, Acinetobacter sp. ADP1
  CDS (1)..(1539)
atgctgtctcgtttggttcgacaaattttacaagcaacggtatatgacgttgcaatcgaaactccactcgaagcagcgccacgaattagtgaaaaactaaacaacaatattcgctttaaacgcgaagaccttcaacccgttttctctttcaaactacgcggtgcttataaccgtattagtcaattaccgaaatctcagttggaacgtggcgttattactgcttcagcaggtaaccatgctcaaggtgtggctttatctggtcaaaagctggggattcgcgccattatcgtgatgccaaaaacaacgccagatattaaggtacaagcagttaaacgtttgggtggcgaagtggttttgcatggtgattcttttgatgttgccaataaatacgcgattcagcgtgcgcaagatgaaggtatgacttttattccgccatatgatgatgaattggtgatggcaggtcagggcacgattgccaatgaaattctgcgtcagtggcgtgatgttgaatatgtatttgttgccgtaggtggtggtggactcattgcaggcgttgcagcgtatttgggtgatgttgctcctcacgtaaaaatcattccagtcgaatatgatgaatctgcttgcctgaaagccgcattcgaacacaatgaacgtgttattttgccacaagtcggtttatttgcagatggtactgcggttgcacaaattggtgaaaaaccctttgaagtaattcagcttcaaaaatcagataactctggtccaattgttgaacgcgatgtgatcttggtcaataccgatgaaatttgtgctgccatcaaagacacttttgatgaatgccgtagcattgtagaaccatctggtgcaatggcgctggcaggtatcaaaaaatatatcgaacaacatcaaattacagataaaaatatcgtttcgattgtttgcggtgcaaacatgaattttgaccgattgcgttatattgctgaacgtacagaacttggcgaacgtaaagaggccatttttgctgtcaccattcctgaacaaaaaggcgcctttttaaatttctgccgtgcattacatggacgcaatattacagaatttaactatcgtgcaagcgatagcgatgatgctcaagttttcgtcggaatcagtttaaaatctggcgaaaaagaacgtcatgacattcacgagttacttaaaagccaatataatgttgatgatttatccgatgacgaagttgctaagctgcatattcgctatcttatcggtggtcatgccaatatcgaaaatgaacgcttgtttcgtgttgaatttccagagcgacccggtgcacttctaaccttccttgaacgccttggacctagtcataatattagcctgttccattatcgtaatcacggtgctgccgaaggacgtgtattggtaggtttacaggctaccgatacgcaagaaaacccagatgtactaattgaaacattggaaaatattacttatccatatgaagaaattacacacaatgtgggttataaacgctttttgcagtaa

SEQ ID NO: 53446 - protein, 512 aa, Acinetobacter sp. ADP1
MLSRLVRQILQATVYDVAIETPLEAAPRISEKLNNNIRFKREDLQPVFSFKLRGAYNRISQLPKSQLERGVITASAGNHAQGVALSGQKLGIRAIIVMPKTTPDIKVQAVKRLGGEVVLHGDSFDVANKYAIQRAQDEGMTFIPPYDDELVMAGQGTIANEILRQWRDVEYVFVAVGGGGLIAGVAAYLGDVAPHVKIIPVEYDESACLKAAFEHNERVILPQVGLFADGTAVAQIGEKPFEVIQLQKSDNSGPIVERDVILVNTDEICAAIKDTFDECRSIVEPSGAMALAGIKKYIEQHQITDKNIVSIVCGANMNFDRLRYIAERTELGERKEAIFAVTIPEQKGAFLNFCRALHGRNITEFNYRASDSDDAQVFVGISLKSGEKERHDIHELLKSQYNVDDLSDDEVAKLHIRYLIGGHANIENERLFRVEFPERPGALLTFLERLGPSHNISLFHYRNHGAAEGRVLVGLQATDTQENPDVLIETLENITYPYEEITHNVGYKRFLQ

SEQ ID NO: 53447 - DNA, 1005 bp, Erwinia carotovora subsp. atroseptica SCRI1043
  CDS (1)..(1005)
atgacaagcaaataccaaagagcaaccgactctgtaacgttgaaagatatttacacggcatctcagcagattaaaacgacgatacgcagaacgccgctagaccgctcgcaggaattatccgctcttgttggtgcagaaattcggctcaagatggaaaacctccaacagaccggtagcttcaagttacgtggcgcggcaaacgttcttgccaatctgggtgcagaacaacgccgtattggcgtcatcgccccaacggcaggaaatcacggattagggctcgcctatgccggacaagtggcgggcgtccccgtaaccatctttttgccacgctcagcagacccgatgaaagtcgcggccatgaaaggttgtggtgcccacattacgttttttgatgacatcgaagaagcgaggcaggcggcaatagcagcagcgcaacagtctagtgctaccttcgtttcagcctacgataatccgcatatgattgctggtggcggcaccgtcggccttgagattatggaagactggatggatgcagagataatcctggtgaatatcggcggcggcgggcttatttcggggattgcgacggcagtaaaagcaatcaaccccgcgatcgaagtatgggggatacaaagtgaagtcagcccgacatttgcccgttggaaagacgccggtgaaacgcttcccgtcgaactgactccctccatcgctgagggcgttagcggctatattgagcccagtgcgatgacctggccgctggttcgtgaccgtgtcgatcgcgtgctcacggtatcagaagttgaaatcaaagccgcaatgctgtcaatgctcgaacttcaccgtcatgttgtcgaaccttcaggggtgccagccgtcgcgggagccattcgctacgcgaaggagattgggggacgtaaaaccgtctgcgttgtcaccggtaggaacatttcgagttcacgttatctcacgctgcttaatgaggcgacggccggtgtagataagtag

SEQ ID NO: 53448 - protein, 334 aa, Erwinia carotovora subsp. atroseptica SCRI1043
MTSKYQRATDSVTLKDIYTASQQIKTTIRRTPLDRSQELSALVGAEIRLKMENLQQTGSFKLRGAANVLANLGAEQRRIGVIAPTAGNHGLGLAYAGQVAGVPVTIFLPRSADPMKVAAMKGCGAHITFFDDIEEARQAAIAAAQQSSATFVSAYDNPHMIAGGGTVGLEIMEDWMDAEIILVNIGGGGLISGIATAVKAINPAIEVWGIQSEVSPTFARWKDAGETLPVELTPSIAEGVSGYIEPSAMTWPLVRDRVDRVLTVSEVEIKAAMLSMLELHRHVVEPSGVPAVAGAIRYAKEIGGRKTVCVVTGRNISSSRYLTLLNEATAGVDK

SEQ ID NO: 53449 - DNA, 975 bp, Erwinia carotovora subsp. atroseptica SCRI1043
  CDS (1)..(975)
atgagcgacttacgcctcccaaccttcgacgatgtggtagccgcagcggaacgcattgatggctatgccaataaaacgccagtgatgacatcacgcacggtcaatgatgccttcggcgcagaggttttcttcaagtgtgaaaactttcagcgtatgggcgcattcaagttccgcggagccatgaacgcgctgttgcagttctcagatgagcagaaagccgcaggcgtggtcaccttttcttccggtaaccatgcgcaggccattgccctttccgccaaattacttggcattccggcaacgatcgttatgccgcacgatgcacccgcagcaaaggtcgctgcgacacgtggctatggcggaaacgtggtggaatataatcgatataccgaagatcgtgagcagatcggtagagatctggctgaaaagcagggtctgacgctcattcccccttatgaccacccgcacgtcattgcaggacaaggtacggctgcgaaagagctgttggaagaaaccggtgagctggacgccctgttcgtctgcttgggcggcggtggattgttggcaggttccgcactgtccgcgcgtcagctgtctccacgctgtaaaatttatggcgtcgaacctctcgcgggcaacgacgggcagcaatctttccgcagcggcaatattgtgcatatcgatacgcccaaaaccatcgccgatggcgcacagactcaacatctgggcaactataccttcccgctgattcgccagaacgtcgacgatattctgaccgtgacggatgacgacctgattgacgcaatgcggttttacgctgagcgcatgaagatcgtcgttgagccgacggggtgcctcagttttgcggcggcgcgtaatctcagggaatcactacacggcaaacgtatcggtatcattatcagcggcgggaatgtcgatatcagccgctacggcgcatttctgaccggcagcgtttga

SEQ ID NO: 53450 - protein, 324 aa, Erwinia carotovora subsp. atroseptica SCRI1043
MSDLRLPTFDDVVAAAERIDGYANKTPVMTSRTVNDAFGAEVFFKCENFQRMGAFKFRGAMNALLQFSDEQKAAGVVTFSSGNHAQAIALSAKLLGIPATIVMPHDAPAAKVAATRGYGGNVVEYNRYTEDREQIGRDLAEKQGLTLIPPYDHPHVIAGQGTAAKELLEETGELDALFVCLGGGGLLAGSALSARQLSPRCKIYGVEPLAGNDGQQSFRSGNIVHIDTPKTIADGAQTQHLGNYTFPLIRQNVDDILTVTDDDLIDAMRFYAERMKIVVEPTGCLSFAAARNLRESLHGKRIGIIISGGNVDISRYGAFLTGSV

SEQ ID NO: 53451 - DNA, 1551 bp, Erwinia carotovora subsp. atroseptica SCRI1043
  CDS (1)..(1551)
atgctgatggctgtgtcacaacctcttcctgccgcgccgggaggcgcggagtacctgcgcgcgatcttgcgctcgccagtgtatgaaatcacgcaggtcacgccgctggagaagatggataagctctcttcgcggctgggtaatgtcattctagtaaaacgtgaagaccgacacgcggtgcacagctttaagctgcgtggcgcgtacgcaatgatggcgggtctgagcgatgaacagaaatcgcacggcgtggtgacggcgtcagccggtaaccatgcgcaaggtgttgcactctcctccagcaagctggggattaaatcgctgattgtgatgccggtggcgacagccgacatcaaggtggatgcggtgcgtggttttggcggagaagtgctgctacacggcgctaactttgatgaagccaaagccaaggcgattgagctgtcagagcaacaacatatgacttttctgccgccgttcgatcaccctgcggtgattgccgggcagggcacgctggcgatggagttgttacagcaggatgcgcatctggatcgcgtgtttgtgccagttggtggtggtggcttggcggcaggcgttgccgtactgattaaacagctgatgccgcagattcaggtgatcggcgtggaagcggaagattccgcctgtctgcgcgcggcgctggatgctgggcaaccagtcgatctgccgcgtgtcgggctgtttgccgaaggcgtggcggtgaagcgcatcggcgatgaaacgtttcgcctatgtcgggaatatctggatgacgtgattaccgtcgacagcgatgccatctgtgcggcagtgaaagatctgttcgaagatgtccgcgcgattgctgaaccgtctggtgcgctggcgttggcggggatgaaaaagtacatccaacagcatcagattcagggtgagcgcttggcgcatgttctgtccggtgcgaacgttaacttccacggattacgttacgtttccgaacgctgcgagctgggcgaacagcgcgaagccttgctggctgtgacgatccctgagcaacagggaagcttcctgaagttttgccaactgttgggtggtcgttctgtcacggagttcaactatcgctacgcggatgccaaagacgcctgcatttttgtcggtgtgcgcttgacgcgcggctatgcggaacggcaggagatcatcgctgagctttccgcagacggttatgaagtagtggatttgtccgatgatgaaatggcgaagctacacgttcgctatatggtcggcggacgtccttccaaaccgttgcaggaacgtctgtacagctttgaattcccagagtcgccgggtgcattactgaaattcctgcatacgctgggggcgcactggaatatttctctattccattaccgcagccacggcacggattttggccgcgttctggctgggttcgagctggaggcgggcgatcgggagtttgagcagcacttgctggcgctgggctatgaatgccatgacgaaaccaataacccggcattccgcttctttctagcgggttaa

SEQ ID NO: 53452 - protein, 516 aa, Erwinia carotovora subsp. atroseptica SCRI1043
MLMAVSQPLPAAPGGAEYLRAILRSPVYEITQVTPLEKMDKLSSRLGNVILVKREDRHAVHSFKLRGAYAMMAGLSDEQKSHGVVTASAGNHAQGVALSSSKLGIKSLIVMPVATADIKVDAVRGFGGEVLLHGANFDEAKAKAIELSEQQHMTFLPPFDHPAVIAGQGTLAMELLQQDAHLDRVFVPVGGGGLAAGVAVLIKQLMPQIQVIGVEAEDSACLRAALDAGQPVDLPRVGLFAEGVAVKRIGDETFRLCREYLDDVITVDSDAICAAVKDLFEDVRAIAEPSGALALAGMKKYIQQHQIQGERLAHVLSGANVNFHGLRYVSERCELGEQREALLAVTIPEQQGSFLKFCQLLGGRSVTEFNYRYADAKDACIFVGVRLTRGYAERQEIIAELSADGYEVVDLSDDEMAKLHVRYMVGGRPSKPLQERLYSFEFPESPGALLKFLHTLGAHWNISLFHYRSHGTDFGRVLAGFELEAGDREFEQHLLALGYECHDETNNPAFRFFLAG

SEQ ID NO: 53453 - DNA, 1251 bp, Leifsonia xyli subsp. xyli str. CTCB07
  CDS (1)..(1251)
gtgaccgatcccacgcgcaccccgttcgccggccccagcctggccgctttcgaggctgcgcgcgcgatcgtggcgacggtggcccagccgaccccgctggagagctcccgctatctcgcgggcgtgctcggtgcgcccgtcctgctgaagtgcgagaatctgcaacgcaccggctcctacaagatccgtggcgcctacaaccgcatgtccaagcttaccgccgaggaacgtaatcgtggggtcgtcgccgcctccgccggaaaccacgcacagggcgtggccttcgcggcccgggagctcggcatccacgccacgatcttcatgccggtcggtgtggccatccccaagttccaggcgacgcgggcgtacggcgctgatgtggtcctgagcggcagcattgtggatgaggcgctgcgcgcggcggcggatttcgcggccgagaccggcgctgtgctcatcccgccgttcgaccacccggacgtggtggccggtcagggcacgctcggcctcgagatcctcgacgaggtccccgacgtgagcacgatcgtcgtcccgatcggtggtggcggactcatctccggcatcgccagcgcggtcaagcagcgttccgcacgcgagggccgcacggtgcgcgtgatcggcgtgcaggccgccaacgccgccgcctacccgccctcactcgaagccggcgcccccaccgagatctccctcgtcgcgaccatcgccgacggcatcgccgtcagccgcccgggcgcgctcaacttccagatcgttcaggacgcggtggatgccgtggtcacggtcaccgaggacgacatcgcccgagccctcctcgtcctcctcgaacgcgcgaagctcgtggtcgagcccgccggggccgcggccgtcgccgccgtcctcgccgggcacatccccgccgatggcacgacggtcgtcatcctctccggtggcaacatcgacccgttgctgatgcagcgtgtgatcagccacggtctcgccgcctcagaccgctacctcaagctgtcgatcatgctgcccgaccggccgggccagctggctcgcatcgcggagatcctcgcgggcgtcaacgcgaatgtggtcgaagtgctgcacacccggcatggccgcgggctgcagctcagtcaggtcgaactcgatgtctccgtggagacccgcggctccgagcaccgtcagcaggtcatctccgttctccgcgccgcgggatacgatccggtcctcgaagaggactga

SEQ ID NO: 53454 - protein, 416 aa, Leifsonia xyli subsp. xyli str. CTCB07
MTDPTRTPFAGPSLAAFEAARAIVATVAQPTPLESSRYLAGVLGAPVLLKCENLQRTGSYKIRGAYNRMSKLTAEERNRGVVAASAGNHAQGVAFAARELGIHATIFMPVGVAIPKFQATRAYGADVVLSGSIVDEALRAAADFAAETGAVLIPPFDHPDVVAGQGTLGLEILDEVPDVSTIVVPIGGGGLISGIASAVKQRSAREGRTVRVIGVQAANAAAYPPSLEAGAPTEISLVATIADGIAVSRPGALNFQIVQDAVDAVVTVTEDDIARALLVLLERAKLVVEPAGAAAVAAVLAGHIPADGTTVVILSGGNIDPLLMQRVISHGLAASDRYLKLSIMLPDRPGQLARIAEILAGVNANVVEVLHTRHGRGLQLSQVELDVSVETRGSEHRQQVISVLRAAGYDPVLEED

SEQ ID NO: 53455 - DNA, 1506 bp, Desulfotalea psychrophila LSv54
  CDS (1)..(1506)
atgaaaaaaataattcgtgacatcctcacctcccgggtctatgaggcagcggtggagacaccacttgaacaggcagtacaactctcccaccaactcggaaacaaaatccttctaaaaagagaagatcaacaaccggtattctcctttaaaatacgcggcgcttacaataaaattgcccatctgagcgaagaggagcgagcacggggggttattaccgcctcggcgggaaatcatgcccaaggcgtggcctattctgccaagaaactcggcatctcagccctgatcgttatgcccaccaccacccctaagatcaaggtagatgcagttcgccgtatgggcggccaggttatcctccacggcgacaactactccgaggcagccacccacaccgaacagatcatggcggagacaggtagatactatatccccccctttgacgatgagttggtcattgccggtcaaggcactattgccgatgaaattcttcgccaaaatcccggaaaaattgacgcaatttttattcccgtgggtgggggcggactcattgccggcattgccgcctatatgaaaaatctccgtcctgagatcaggataatcggggtagagccgaccgatagcaatgccatgcactgctcccttaaggcgggtaaacgggtggaactctccaccgttggtatctttgccgatggcgttgccgtacggaaggttggagagcaaacctttgccctctgccaggagtatgtagatgagatcatcgaaatcagcagcgacgaactctgcagtggtatcaaggccatctaccaggcgacccgctccattgtcgaacctgcaggcggccttggcatggccggtctcttaaaatatatccgggagacaggctgcaaggacaagactcttattgccattaattccggagccaatatgaactttgagcgcctgcgttacgttgccgagcgcaccctgatcggggaggagcaggaggcactttttgcggtaaccatgcctgaagaggcgggaagcctgaaaacattctgccagaggatagttgaaaaacgaaatatcaccgaattcaactatcgccatatctctccagaaaaggcacatatctttgtcggtatctccatagaacaggcaaaagaacgacaagagttcagccaacagctcacggcagccggttatgaaaatatcgatctgaccgataacgatcttgccaaaaaccatatccgctatatggtgggtggcaaaccggcaagcgtccaagaggagagactctttcgtttctggtttcctgaaacacccggagcccttgtccgttttctcgacgccacccgtggcgcactctccatctccctcttccactaccgcatgcagggtggaaattatagccgggtacttgttggctttaactcctgccgggatgacgatgagctattggagagattagatatactgggctaccgctttaaagaagagacagacaatcccgcatacaagatgtttttatag

SEQ ID NO: 53456 - protein, 501 aa, Desulfotalea psychrophila LSv54
MKKIIRDILTSRVYEAAVETPLEQAVQLSHQLGNKILLKREDQQPVFSFKIRGAYNKIAHLSEEERARGVITASAGNHAQGVAYSAKKLGISALIVMPTTTPKIKVDAVRRMGGQVILHGDNYSEAATHTEQIMAETGRYYIPPFDDELVIAGQGTIADEILRQNPGKIDAIFIPVGGGGLIAGIAAYMKNLRPEIRIIGVEPTDSNAMHCSLKAGKRVELSTVGIFADGVAVRKVGEQTFALCQEYVDEIIEISSDELCSGIKAIYQATRSIVEPAGGLGMAGLLKYIRETGCKDKTLIAINSGANMNFERLRYVAERTLIGEEQEALFAVTMPEEAGSLKTFCQRIVEKRNITEFNYRHISPEKAHIFVGISIEQAKERQEFSQQLTAAGYENIDLTDNDLAKNHIRYMVGGKPASVQEERLFRFWFPETPGALVRFLDATRGALSISLFHYRMQGGNYSRVLVGFNSCRDDDELLERLDILGYRFKEETDNPAYKMFL

SEQ ID NO: 53457 - DNA, 1002 bp, Rickettsia typhi str. Wilmington
  CDS (1)..(1002)
atgaatttattactacaatctcctcaaaatgtagcaatcgcacataatagaataaaacaatatataaatttaacaccgataattcactctgaaagcttaaatgagatgctaggtcatgagattttttttaaggttgaatcattacaaaaaactggagcatttaaagttagaggagtattaaataatttgttagaattaaaagaacaagaaaaattaccgaataaaatagtttgttatagtagtggtaatcatggcattggccttgcttattcaagtaaattatttggtattaaaacaagaatttatttaccgttaaatacttcaaaagtaaaactgcaagcagctctttattacggatgtgaagttatatacacaaatactcggcaagaagcagaatcaagagcaaaggaagatgaagaacaaggattctactatatgcacccttctgatagtgattctataatagcaggagcaggcacgttatgctatgaagcattacagcaattagattttattcctgatgctatttttgcatcttgcggcggcggaggtttaatttctggctcatatcttgctaaagaattaatatcacctacaagcttattaataggttcagaaccagctgcagctaatgatgcttatttatcgattaaaaataataatatatatagatttaatgacacaccaataaccattgcagatggtcttaaaactttaagtgtatcagctcgtacatttgaatatttaaaaaaacttgaccatttttatttagcagaagaatatgaaatatattactggacagcgtggcttattcatttactgaaagttatatgcgagccatcaagtagtataaatatggtttcagtaataagttggttaaaaacacaaaccagaacacagaaactactagtattaatctcaggcggcaatatcgaccctactctttataatgagttatggcaagatgattatttaactgttccaccaagcattagtaactaa

SEQ ID NO: 53458 - protein, 333 aa, Rickettsia typhi str. Wilmington
MNLLLQSPQNVAIAHNRIKQYINLTPIIHSESLNEMLGHEIFFKVESLQKTGAFKVRGVLNNLLELKEQEKLPNKIVCYSSGNHGIGLAYSSKLFGIKTRIYLPLNTSKVKLQAALYYGCEVIYTNTRQEAESRAKEDEEQGFYYMHPSDSDSIIAGAGTLCYEALQQLDFIPDAIFASCGGGGLISGSYLAKELISPTSLLIGSEPAAANDAYLSIKNNNIYRFNDTPITIADGLKTLSVSARTFEYLKKLDHFYLAEEYEIYYWTAWLIHLLKVICEPSSSINMVSVISWLKTQTRTQKLLVLISGGNIDPTLYNELWQDDYLTVPPSISN

SEQ ID NO: 53459 - DNA, 963 bp, Yersinia pseudotuberculosis IP 32953
  CDS (1)..(963)
atgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgagcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 53460 - protein, 320 aa, Yersinia pseudotuberculosis IP 32953
MNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPELDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 53461 - DNA, 1200 bp, Symbiobacterium thermophilum IAM 14863
  CDS (1)..(1200)
atggcccgctggcacggtgtcatccggcagtaccaacgttttctgcccgtgagcgagaggaccccggtggtgacgctgctggagggcaacaccccgctggtgccggcgccccggctgggggcggagctggggctcgatctctacctgaagttcgaggggctgaaccccaccggctccttcaaggaccgggggatgaccctcgccatgtccaaggcggtcgaggcgggggcgaaggcggtgatctgcgcctccaccggcaacaccagcgcctccgcggcggcctacgccgcccgggcggggctgccctgctacgtcgtcatccccgacggcgcggtcgccatgggcaagctcgcccaggcgctgatgtacggcgcccgcacgattcagatcgagggcaacttcgacgacgggctccggctggtgcgccgcctgacccaggagcacccggagatcgcgctggtcaactcggtcaacccgtaccggctccaggggcagaagaccgccgccttcgaggtggtggacgccctggggggctaccccgatttcctggcgatcccggtgggcaacgccggcaacatcaccgcctactggatgggcttccaggagtacgccgccgccggcgtgggcgccgtcgagtcctgtagctccagcggggcgcctgcgggggccctcctgccccgcatgctgggcttccaggcggcaggggcggcgccgctggtgcacggcggcgaggtggaggacccgcagacggtgggcacggccatcaggatcggccgcccagccagccgcgccggggcgctggccgcggcccgggagtcgggcggggcgttctgggcggtgacggacgaggagatgctggcggcctaccgccggctggcggcgaccgagggcatcttcgctgagcccgcctcctgcgcctccgtggccgggctgatcaagctgtgccggctcgggtacttcgaggggcgcaccggcagtgccggcgatgtgtccggggtcggcggtttcatcgacggcgtgcccgccccggtgccgacccaccggcccttcactggccggggcggccggcccaaggtcgtcgccgtactgaccggacacgggctcaaggaccccgacacggccatccgggtttcgccgctgcctgagaagctgcccgccgactacggccggctggagcggctgatcctctccgggagctga

SEQ ID NO: 53462 - protein, 399 aa, Symbiobacterium thermophilum IAM 14863
MARWHGVIRQYQRFLPVSERTPVVTLLEGNTPLVPAPRLGAELGLDLYLKFEGLNPTGSFKDRGMTLAMSKAVEAGAKAVICASTGNTSASAAAYAARAGLPCYVVIPDGAVAMGKLAQALMYGARTIQIEGNFDDGLRLVRRLTQEHPEIALVNSVNPYRLQGQKTAAFEVVDALGGYPDFLAIPVGNAGNITAYWMGFQEYAAAGVGAVESCSSSGAPAGALLPRMLGFQAAGAAPLVHGGEVEDPQTVGTAIRIGRPASRAGALAAARESGGAFWAVTDEEMLAAYRRLAATEGIFAEPASCASVAGLIKLCRLGYFEGRTGSAGDVSGVGGFIDGVPAPVPTHRPFTGRGGRPKVVAVLTGHGLKDPDTAIRVSPLPEKLPADYGRLERLILSGS

SEQ ID NO: 53463 - DNA, 1233 bp, Symbiobacterium thermophilum IAM 14863
  CDS (1)..(1233)
gtgacggtaacctttgcggacatcgagaaggcgcgcattctgctgagcggacacatcaagcggacacccatgcttcagagccctggcatcaccgagcacctgggacttccggtctacctgaaggccgagaacctgcagcgggccgggtcgttcaaggtgcggggagcgctcaacaagatccactcgctgactgaggaagagaaggcgcgcggcgtcatcgcggcgtcggccggcaaccacgcgcagggcgtggccctggcggcgtccagtctcggcatccggtcggtcatctgcatgccggagggcgccccgatcgccaagctggaggcgacccagggctacggcgcccaggtggtcctgcacggcgagacctacgacgacgcctaccagaaggcgcgggcgctgcaggcggagcacgggtacacgttcatccacggcttcgatgacccgtacaccatcgccggccaggggacggtcgggctggagatcgtggaggacctgcccgacatcgcgacggtggtggtgccgatcggcggcggcggcctcatggcgggcgttgccctggcggtcaagtccctgaagcccggcgtacgggtggtgggggtccaggccgcgggcgcgccggcggtcttcctcagccggcagcagggcaagctggtggcgaccgactcggtccacaccatcgcggacggcattgccatcaagaagccgggggcgctgtgctgggagattatccgggaacacgtggacgacatcgtgctggtggacgaggaggagatcgcacagtcgatcctcttcctgctggagcgtgcgaaggtcatcgtcgagggcgccggcgccgtgggcatggccgcgctcctcggcgacaagatcccggatctgcagggaccggtctgcgtcgtgctctcgggcggcaacattgacgtgaacatcatctcccgcatcatcgagcgcggtctggtgaaggcggggcggtacatccggatctccacgttcgtgcccgaccggcccggcgggctgcagcagctcctcgcgaccgtggcccaggccggggccaacgtgatcgacgtgcgtcatgagcgctggctgaacaaggtgaccatcggcgaggtggagatcaccctggcgctggagactcgcaacgcccgccatgtcgatgagattctcgccaccctcaaggcgaaggggtatcatgtctggatcattccgccgtatcgtcccaacgactggtag

SEQ ID NO: 53464 - protein, 410 aa, Symbiobacterium thermophilum IAM 14863
MTVTFADIEKARILLSGHIKRTPMLQSPGITEHLGLPVYLKAENLQRAGSFKVRGALNKIHSLTEEEKARGVIAASAGNHAQGVALAASSLGIRSVICMPEGAPIAKLEATQGYGAQVVLHGETYDDAYQKARALQAEHGYTFIHGFDDPYTIAGQGTVGLEIVEDLPDIATVVVPIGGGGLMAGVALAVKSLKPGVRVVGVQAAGAPAVFLSRQQGKLVATDSVHTIADGIAIKKPGALCWEIIREHVDDIVLVDEEEIAQSILFLLERAKVIVEGAGAVGMAALLGDKIPDLQGPVCVVLSGGNIDVNIISRIIERGLVKAGRYIRISTFVPDRPGGLQQLLATVAQAGANVIDVRHERWLNKVTIGEVEITLALETRNARHVDEILATLKAKGYHVWIIPPYRPNDW

SEQ ID NO: 53465 - DNA, 1263 bp, Bacillus cereus ZK
  CDS (1)..(1263)
atggtgcagaaggtaaaggagagagtgaaaattgaagatatcttaatggcccataattgcatgaaagatatcgttatgaaaacaccgttacaacgtgatacagttttatctgagaaatatgattgtgatgtttatgtaaaacgagaagatttacaattgattcgctctttcaaaattcgtggtgcgtataatttaattcaaagcttaccgaaagaacaattacaaaacggtgttgtttgcgcaagcgctggtaatcacgcacaaggggtagcttatacgtgtaatttattgaaaattccatcaaaaattttcatgccaacaacaacacctaagcaaaaagtagcacaagttcaatttttcggtggtgatttcgcagagattgtattggttggtgatacattcgatagctcttttcaagaagcacagcgttattgtgaagaaaatagaatgacgtttgttcatccgtttgatgatccgtatgtagttgctggtcaagggacagtggcagttgaaattatgcatgatatggagaaaccggttgattatatctttacagcaattggcggtggcggattagcatcaggtgttggtacatatgtgaaaggtgttagtcctgctacacaggtcattggggtagagccaatgggagctgcatctatgaaagaggcttttcttcaaaatgataatgtggcattggagaaaatagatagttttgttgatggggcagcggttaaaaaggtaggaaagttaacatttgaaacttgtaaagatgtaattgatgacattgttttagtaccagagggaaaggtttgtacgacgattttagaactgtataagaaaaatgcgattgtagctgaaccagctggtgcactctctattgcagcgcttgatttatacagagatgaaattaaaggtaaaaccgttgtatgcacattaagtggtggaaataatgatattgatagaatgcaagaaatgaaagaacgttctctcatttatgaaggattaaagcattatttcatcattgaattcccgcaacgttcaggtgcgctaagagaatttcttgataaaggattaggaccagaagatgatattacgcgctttgagtatattaagaaacataataaagaaaatggtccagcattagtcggagtagagttaaaacataaagaagattacgagcagttaattatccgttttaaagaaaataatattcaatttatggagcttaataaaaatcctgttttgtttgatttgcttatttaa

SEQ ID NO: 53466 - protein, 420 aa, Bacillus cereus ZK
MVQKVKERVKIEDILMAHNCMKDIVMKTPLQRDTVLSEKYDCDVYVKREDLQLIRSFKIRGAYNLIQSLPKEQLQNGVVCASAGNHAQGVAYTCNLLKIPSKIFMPTTTPKQKVAQVQFFGGDFAEIVLVGDTFDSSFQEAQRYCEENRMTFVHPFDDPYVVAGQGTVAVEIMHDMEKPVDYIFTAIGGGGLASGVGTYVKGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 53467 - DNA, 1539 bp, Mannheimia succiniciproducens MBEL55E
  CDS (1)..(1539)
atggttaataatttatcgaacgccccgaccggggcggagtatttaagagcgatcttaatttctaaagtttatgaggcggcaaaagttactccgttgcaattaatgccgaaattgtcggaacgtttaggcaatcggatttatgttaaacgtgaagatcatcaacccgtacatagctttaaattacgcggcgcctacgccatgatttcaggtttaacccaggcgcagaaagaggccggcgtcattaccgcatcggcgggaaatcacgcgcaaggcgtagccctttcggcaaaaaatgccggtattcgtgcgctgattgtaatgccgcaaaatacgccttccattaaagtggatgcggtacgcggacacggcggcgaagtacttttacacggcgcgaatttcgatgaggccaaagccaaagcgattgaactttcgcaaacggagcaaatgacctttatcccgccttttgatcatcctgcggtgattgcggggcagggctccatcggtatggaattattgcagcaaaacggtcacatcaaccgcatttttgtaccggtaggtggcggcggtttgcttgcgggcgttgccgtgctgattaaacaattaatgccggaaattaaggtgatcggcgtagaagcgaaggattccgcctgtttatattatgcactgaaagcgggtcgtcccgttgatttagaacgcgtcggactttttgccgacggtgtggcggtaaaacgaatcggtgacgaaactttccgcatttgtcagcaatatgtggatgatgtgattctggtggatggtgatgaaatctgtgcggcgatgaaagatatgtttgaaaacgttcgtgcggtaccggaaccttcgggcgcattatcgctcgccggcttgaaaaaatatgctaaacagcataatttgcaaggcgaaaccttagtaaatctgctgtccggcgcgaatttaaatttccatacgctgcgttatgtttccgaacgttgtgaaatcggtgaaaaacatgaagccttatttgcggtaacgattccggaacaacggggcagcttcttaaaattctgtcagattttaggacaaaatgcggtgacggaattcaactatcgctatgctgatgaaaaacaggcttgtatttttgtcggtgtgcgcattaccggcgaacaggaaaaacaagttattatccagcaattaaaacagggcgggtatgacgtgcaggatttgtctgacgacgatattgctaaaactcatattcgttatatggtcggcggccgctcatccagtgatttaaacgaacgtctatatagctttgaatttccggaacaaaaaggcgcattgctgaagttcctggaaaccctcggcaccacggatgcgaatatttccctgttccattaccgcggacacggtgcggattacggcgatgtgttggcaggtttccaaattaatgacgcggatttaccggcatttaaacaacatttggaaaaattaggctatgcttatcaggatgttaccgacagcccgtcttatcggtatttcttaggatag

SEQ ID NO: 53468 - protein, 512 aa, Mannheimia succiniciproducens MBEL55E
MVNNLSNAPTGAEYLRAILISKVYEAAKVTPLQLMPKLSERLGNRIYVKREDHQPVHSFKLRGAYAMISGLTQAQKEAGVITASAGNHAQGVALSAKNAGIRALIVMPQNTPSIKVDAVRGHGGEVLLHGANFDEAKAKAIELSQTEQMTFIPPFDHPAVIAGQGSIGMELLQQNGHINRIFVPVGGGGLLAGVAVLIKQLMPEIKVIGVEAKDSACLYYALKAGRPVDLERVGLFADGVAVKRIGDETFRICQQYVDDVILVDGDEICAAMKDMFENVRAVPEPSGALSLAGLKKYAKQHNLQGETLVNLLSGANLNFHTLRYVSERCEIGEKHEALFAVTIPEQRGSFLKFCQILGQNAVTEFNYRYADEKQACIFVGVRITGEQEKQVIIQQLKQGGYDVQDLSDDDIAKTHIRYMVGGRSSSDLNERLYSFEFPEQKGALLKFLETLGTTDANISLFHYRGHGADYGDVLAGFQINDADLPAFKQHLEKLGYAYQDVTDSPSYRYFLG

SEQ ID NO: 53469 - DNA, 1269 bp, Bacillus licheniformis ATCC 14580
  CDS (1)..(1269)
atgaaaccgttgcttaaagaaaactctctcatccaagtcaaagacattttaaaagcccaccaaaatgtaaaagatgttgttattcatacccctctccaaaaaaatgagaggctgtccgagaggtacgattgcaacgtatatttaaaaagagaagacctgcaggttgtccgctcttttaaactgagaggcgcctattataaaatgaagcagctttcaaaagaaacgacgaaaaacggggtggtctgcgccagtgcaggaaaccatgcgcagggagtcgctttttcctgcaaacatctcggtattcacggaaagatttttatgccgtcgacgaccccgaggcaaaaaatttcccaagtcgaattgttcggcaaggaatacgtcgagatcatcctgacaggcgacacgtttgatgatgcttatcaaagcgcagtcgcctgctgcgaggaagaaaagcgcgcatttatccacccgtttgacgatcctgccgtcatggctggccagggtacggtcgcggtcgaaatcttaaacgatatcgaaacggaaccccattatttattcgcaagcgtaggcggagggggtctgctttcaggagtgggaacctatatgaaaaacgtgtccccggatacaaagctgatcgcggttgagcctaaaggcgcgccggctctttttgaatcaaacaaaaaaggcgaagtcgtcatccttgagaaaatcgataaatttgtcgatggagccgctgtgcagaaaatcggcgaagagacatttaaaacgcttgaaaccgttgtcgatgatattttgctcgttcctgaaggaaaggtgtgcaccgcgattcttgagctgtacaaccaatgcgcgattgtcgccgaacctgcgggagcgctgccgatcgccgctttagatctttacagggatgaaattaaagggaaaaatgtcgtatgcattgtgagcggaggaaacaacgatatcggcagaatgcaggaaatcaaagacagatcgatgatgtatgaaggactccagcattatttcatcgtgaacttcccgcaaagggcgggagctttgcgcgaatttttagatgaagtgctcgggccgaccgacgatatcacccggtttgaatatacgaagaaaaataataaaagcagcggccctgcgctcgtcggcatcgaattgaagcagcgcgaagattacgagccgctgatcgcaagaatggacaggaaaggcttccgctatgtcgaagtcaataaagatgaagggctctttcatttgctgatttaa

SEQ ID NO: 53470 - protein, 422 aa, Bacillus licheniformis ATCC 14580
MKPLLKENSLIQVKDILKAHQNVKDVVIHTPLQKNERLSERYDCNVYLKREDLQVVRSFKLRGAYYKMKQLSKETTKNGVVCASAGNHAQGVAFSCKHLGIHGKIFMPSTTPRQKISQVELFGKEYVEIILTGDTFDDAYQSAVACCEEEKRAFIHPFDDPAVMAGQGTVAVEILNDIETEPHYLFASVGGGGLLSGVGTYMKNVSPDTKLIAVEPKGAPALFESNKKGEVVILEKIDKFVDGAAVQKIGEETFKTLETVVDDILLVPEGKVCTAILELYNQCAIVAEPAGALPIAALDLYRDEIKGKNVVCIVSGGNNDIGRMQEIKDRSMMYEGLQHYFIVNFPQRAGALREFLDEVLGPTDDITRFEYTKKNNKSSGPALVGIELKQREDYEPLIARMDRKGFRYVEVNKDEGLFHLLI

SEQ ID NO: 53471 - DNA, 1056 bp, Burkholderia mallei ATCC 23344
  CDS (1)..(1056)
gtggctgcgcgcggcgcgcgaagctgggacaatggccgcttccttgtccaacgcgttttcgcactcgccgccatgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 53472 - protein, 351 aa, Burkholderia mallei ATCC 23344
MAARGARSWDNGRFLVQRVFALAAMSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 53473 - DNA, 1524 bp, Burkholderia pseudomallei K96243
  CDS (1)..(1524)
atggcctcccacgattatctgaagaaaatcctgaccgcccgggtgtacgacgtcgcgctcgaaaccgagctcgaacgcgcgcgcaacctgtccgcgcggctgggcaacgccgtctacctgaagcgcgaggacaaccagccggtgttctcgttcaagctgcgcggcgcgtacaacaagatggcgcacatcccggccgacgcgctcgcgcgcggggtgatcaccgcgtcggcgggcaaccatgcgcagggcgtcgcgttctcggccgcgcggatgaacgtgaaggcggtgatcgtcgtgccggtgacgacgccgcaggtgaaggtcgacgcggtgcgcgcgcacggcgggccgaccgtcgaggtgatccaggcgggcgaatcgtacagcgacgcgtacgcgcacgcggtgaaggtgcaggccgagcgcggcctcacgttcgtccatccgttcgacgatccgtacgtgatcgcgggccagggcacggtcgcgatggagatcctgcgtcagcatcaggggccgattcacgcgatcttcgtgccgatcggcggcggcgggctcgcggcgggcgtggccgcgtacgtgaaggcggtgcgcccggagatcaaggtgatcggcgtgcagaccgacgattcgtgcgcgatgaagcaatcgctcgcggcgggccggcgcatcgagctcaccgaggtggggctcttctccgacggcaccgcggtcaagctcgtcggcgaggagacgttccgcctctgcgcggcgtatctcgacgaggtcgtgaccgtcgataccgacgcgctttgcgcggcgatcaaggacgtgttccaggacacgcgcagcgtgctcgagccggccggctcgctcgcggtggcgggcgcgaagcggtatgcggagcaggcgggcatcgagggcgagacgctcgtggcggttacctccggcgcgaacatgaatttcgaccggatgcgcttcgtcgccgagcgcgccgaggtgggcgaggcgcgcgaggcggtgttcgcggtgacgattcccgaggagcgcggcagcttcaagcgcttctgcgcgctcgtcggcgagcgcaacgtgaccgagttcaactaccggatcgccgatgcgcgatcggcgcatctcttcgtcggtgtgcagatccggcggcgcgacgaatcggacgagatcgccgccaacttcgccgcgcacggtttcacgagcgtcgacctgtcgggcgacgagctatcgaagcagcatatccgctacatggtgggcgggcgctcgccgctcgcgcacgacgagcggctgttccgcttcgagtttcccgagcggcccggcgcgctgatgaagttcctgtcgtcgatggcgcccgactggaacatcagcctgttccactaccggaaccagggcgccgactacagctcgatcctcgtcggcctgcaggtgccgcaggccgaccacgcggcgttcgatcgcttcctcgcggcgctcggctatccgttctgggaagaaagcggcaatccggcgtatcgtctcttcctgtcgtaa

SEQ ID NO: 53474 - protein, 507 aa, Burkholderia pseudomallei K96243
MASHDYLKKILTARVYDVALETELERARNLSARLGNAVYLKREDNQPVFSFKLRGAYNKMAHIPADALARGVITASAGNHAQGVAFSAARMNVKAVIVVPVTTPQVKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGRRIELTEVGLFSDGTAVKLVGEETFRLCAAYLDEVVTVDTDALCAAIKDVFQDTRSVLEPAGSLAVAGAKRYAEQAGIEGETLVAVTSGANMNFDRMRFVAERAEVGEAREAVFAVTIPEERGSFKRFCALVGERNVTEFNYRIADARSAHLFVGVQIRRRDESDEIAANFAAHGFTSVDLSGDELSKQHIRYMVGGRSPLAHDERLFRFEFPERPGALMKFLSSMAPDWNISLFHYRNQGADYSSILVGLQVPQADHAAFDRFLAALGYPFWEESGNPAYRLFLS

SEQ ID NO: 53475 - DNA, 984 bp, Burkholderia pseudomallei K96243
  CDS (1)..(984)
atgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 53476 - protein, 327 aa, Burkholderia pseudomallei K96243
MSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 53477 - DNA, 1530 bp, Methylococcus capsulatus str. Bath
  CDS (1)..(1530)
atgctgcaaaaatacatagagaagattctgcgcgcccgtgtctacgacgttgcccaggagaccccgctggacccggcgcccggcctgtcgcggcggctggacaacacggtgctgatcaagcgcgaggacctgcagccggtgttctcgttcaagctgcgcggcgcctacaacaagatcgcctcgctcacacccgaggcgcgcgcggccggcgtgatcgcggcctccgccggcaaccacgcccagggcgtggcactggcggcgcagcggctgggcatccgcgccgtgatcgtgatgccttgcaccaccccgcatatcaaggtcgatgcggtgcgcaaccgaggcggtgaggtcgtactgcatggcgacgcctatgacgaagcctacgaacatgcgctggaactggcccgcgaccagtgcctgaccttcgtccacccctacgacgatccggaagtcatcgccgggcaaggcaccatcggcatggaaatcctgcgccagcaccaggacgccatccacgccatcttcgtgcctgtgggcggcggcggattgatcgccggcatcgccgcctacgtcaagttcgtgcgcccggacatccgcgtcatcggcgtggaaccagtggactccgactgcctgcaccgggcgctgaaagccaagcggcgggtgatcctgaagcaggtgggcctgttcgccgacggcgtcgcggtgaagcaggtcggcaaggaaccgttccatctcgcccaccagtgggtggacgaggtcgtgaccgtcgacaccgacgaaatctgcgccgccatcaaggacatcttcgacgacacccgctccatcgccgagccggcgggcgcgctgggcatcgccgggctcaagaaatacgtggccgaaacaggaatcaagaacgcgtgcctggtggcgatcgaaagcggcgccaacatcaacttcgaccggctgcgccacgtcgctgagcgcgccgagatcggcgaaaagcgcgaactgctgctggcagtgacgatccccgagcggcccggcagcttcctcgaattctgccgggtgctgggccgccgcaacatcaccgaattcaactaccgcttcttcgacgaaaaggccgcccaggtgttcgtcggcctcccggtggcgagcggcgcgatcgaccgcgaaagcctggtccgcgaattcgaacgccagggtttcggcgtgctcgacctgaccggcaacgaactcgccatcgaacacatccgctacatggtcggcggccacgcgccgaaactgctggacgaacaggtctacagcttcgaattccccgagcgacccggcgcgctgctgcgcttcctgtccatcatgggcgggcgctggaacatcagcctgttccattaccgcaaccacggcgccgccttcggccgggtactgatgggcatccaggtgccgaaaccggaacgcaaggccttccgggaattcctcgaagccatcggctacgccttcaaggaggaaacccaaaatcccgcctaccggctgttcgcggggggcagcgagcgggggtga

SEQ ID NO: 53478 - protein, 509 aa, Methylococcus capsulatus str. Bath
MLQKYIEKILRARVYDVAQETPLDPAPGLSRRLDNTVLIKREDLQPVFSFKLRGAYNKIASLTPEARAAGVIAASAGNHAQGVALAAQRLGIRAVIVMPCTTPHIKVDAVRNRGGEVVLHGDAYDEAYEHALELARDQCLTFVHPYDDPEVIAGQGTIGMEILRQHQDAIHAIFVPVGGGGLIAGIAAYVKFVRPDIRVIGVEPVDSDCLHRALKAKRRVILKQVGLFADGVAVKQVGKEPFHLAHQWVDEVVTVDTDEICAAIKDIFDDTRSIAEPAGALGIAGLKKYVAETGIKNACLVAIESGANINFDRLRHVAERAEIGEKRELLLAVTIPERPGSFLEFCRVLGRRNITEFNYRFFDEKAAQVFVGLPVASGAIDRESLVREFERQGFGVLDLTGNELAIEHIRYMVGGHAPKLLDEQVYSFEFPERPGALLRFLSIMGGRWNISLFHYRNHGAAFGRVLMGIQVPKPERKAFREFLEAIGYAFKEETQNPAYRLFAGGSERG

SEQ ID NO: 53479 - DNA, 963 bp, Nocardia farcinica IFM 10152
  CDS (1)..(963)
ttgaccgatcgggacggcgcgctggtcgcgggggagcacgcccggctgtatcgatccgatgtccgcctcgcgcggcgcaggctcgccgggcggatccggaagacgcccgtcttccacacgagcgtggccgggcccgccgggccggtcccggtgacgttgaaactcgagcatctccagcacgcgggcaccttcaaggtgcgcggcaccctcaacgcgctgctcgccgccgacccggaggaccacgtggtgatcgcctcggcgggcaattccggcatcgccgcggcgctggcggcggcctggctgggcaagacgtgcacggtggtggtgcccgagtcggcgccgcacaccaaggtggccgcgatgtggtcgcacggcgccgaggtgctgtggcacggcaccacctaccgcgaggccgaacggtacgccgccgagctggcggccgaccgcggcgcactggtgctgcacgcctacgaccagctcgacgtgatcgccggtgcgggcgtgctcgcgctcgagctggaggagcaggtgcgcggcaggccgccggtgctggtctcggtgggtggcggcggcctgctggcgggcgtggccgccgcgttcgggcgcaggcagcgggtgatcggggtggagccggtcggcatgcccgcgctgcgcgccgcactgacggccgaacgcccggtggacgtgggcccggcccggccggtgctgcatccgctgggcgccacccgggtcggcgaactcgcgttgcgcctggcgcgccgctacgacgtgcccgcgctgctggtcaccgaggaggcgatcacgaccgcgcgcgagtacctgtggcgtgagttccggatcgtggtggaactggccggcgcgaccgcgctggccgcgatcctcagcggcgcctacgtcccggccccgggtgagcggccggtggtggtgctgtgcggggcgaacaccgacgcgaccggtctctga

SEQ ID NO: 53480 - protein, 320 aa, Nocardia farcinica IFM 10152
MTDRDGALVAGEHARLYRSDVRLARRRLAGRIRKTPVFHTSVAGPAGPVPVTLKLEHLQHAGTFKVRGTLNALLAADPEDHVVIASAGNSGIAAALAAAWLGKTCTVVVPESAPHTKVAAMWSHGAEVLWHGTTYREAERYAAELAADRGALVLHAYDQLDVIAGAGVLALELEEQVRGRPPVLVSVGGGGLLAGVAAAFGRRQRVIGVEPVGMPALRAALTAERPVDVGPARPVLHPLGATRVGELALRLARRYDVPALLVTEEAITTAREYLWREFRIVVELAGATALAAILSGAYVPAPGERPVVVLCGANTDATGL

SEQ ID NO: 53481 - DNA, 1356 bp, Nocardia farcinica IFM 10152
  CDS (1)..(1356)
gtggccaatccgctggaactgatcgatgacctgtccccgtctcgtcgcgcgctcaacgccgacgagatcgacgccgcggccaagcgaatttccgacatcatcgagcccacccccctccagctcagcccccgcctgtccgccgccaccggcgcccgcgtctacctcaagcgcgaggacctcaccgccgtgcgctcctacaagctgcgcggggcctacaacctgatcgtgcagctcgacgagcgcgagcgcgcggcgggcgtggtcgcggccagtgccggcaatcacgcccagggcgtggcgttcgcctgccaggcgatgggcatccagggacgcatctacgtgccgaccacgacgccgaagcagaagcgcgaccggatccgggtacacggcgggcagttcgtggagctgatcgccgtcggcgacacctacgacgccgccgcggccgccgcggccgccgacgtggaacgcaccggcgcgacgatggtcgctcccttcgacgacccgcgcaccgccgccggtcagggcaccatcgcggtggagatcctcgaacagctcggcgcggcacccgatttggtcgtggtgccggtgggcggcggcggctgcctggccggtatcggcacctacctgcgcgaccgctcccccgccaccggcatcctggcggccgagcccgccggggcggcctccatgacggcggcgctgatcgcgggcgggccggtgaccctgcccgagatcgatcccttcgtcgacggcgcggcggtgcgccgcgtcggcgcgctgccctatgccgcggcggtcggcttcggcggccgggtggtcacgcacgcctcgctgccgctgctcaccgccgtcgactcaccgcagggacacggcgcgttccggttgctccaggtcgacgagggcgccatctgcacgacgatgctcgagctctaccagaacgagggcatcatcgccgagcctgcgggcgcgctggcggtggccgccctggccgaggtcgacgtcgaacccggttcgacggtggtgtgcctgatctccggcggcaacaacgacgtctcccgctacggcgagatcatcgagcgctccctggtgcaccagggtctcaagcactacttcctggtcgatttcccgcaggagccgggcgcgctgcgccggttcctggacgaggtgctcggcccggacgacgacatcaccctgttcgagtacgtcaagcgcaacaaccgggagaccggggcggcgctggtcggcatcgaactcggcgcggccgacgggctggacgcgctgctcgaacgcatcgcggcctcgcccatccaatgcgaacggctggagccgggctcgcccgcctaccgctacctgacctga

SEQ ID NO: 53482 - protein, 451 aa, Nocardia farcinica IFM 10152
MANPLELIDDLSPSRRALNADEIDAAAKRISDIIEPTPLQLSPRLSAATGARVYLKREDLTAVRSYKLRGAYNLIVQLDERERAAGVVAASAGNHAQGVAFACQAMGIQGRIYVPTTTPKQKRDRIRVHGGQFVELIAVGDTYDAAAAAAAADVERTGATMVAPFDDPRTAAGQGTIAVEILEQLGAAPDLVVVPVGGGGCLAGIGTYLRDRSPATGILAAEPAGAASMTAALIAGGPVTLPEIDPFVDGAAVRRVGALPYAAAVGFGGRVVTHASLPLLTAVDSPQGHGAFRLLQVDEGAICTTMLELYQNEGIIAEPAGALAVAALAEVDVEPGSTVVCLISGGNNDVSRYGEIIERSLVHQGLKHYFLVDFPQEPGALRRFLDEVLGPDDDITLFEYVKRNNRETGAALVGIELGAADGLDALLERIAASPIQCERLEPGSPAYRYLT

SEQ ID NO: 53483 - DNA, 936 bp, Nocardia farcinica IFM 10152
  CDS (1)..(936)
gtgccgatcgaaccgaccgttatcgacgtcgacgccgccgccgaacggatcgccgggctgatccgtccggtcaccgtcgccccggccgaaccgccgggtgagtgctggctggcgctggagttcctccagcacaccggctcgttcaaggcgcgcggcgcgcagaatttcgtggaggcccaccggctcgcgggcaccatgcccgccgccggggtgaccatcgcctcgggcgggaacgccggactggcctgcgcgtgggctgcggcgagccggggcgtgcccgcgacggtgttcctgccgcgcaccgcgcccacggtgaaggtgcagcggctgcgcggctacggcgccgaggtgcggctggtcggcgcggaatacgccgacgcgctggcggcctgccgtgacttcgccgccgagtccggcgcgttgatgtcccacgcctacgacgatccactgatcgcggccggcgccggcacgctgctcaccgaaatccaccgggcgataccgaaactggacacggtggtgctcgccgtcggcggcggtgggctgttcgccggcatcgccaccgcggccgcgcagctcggggtgcggacggtggcggtggagcccgagcgctgccgcgccctcgacgccgcgctggccgcgggcgaaccggtggacgtggaggtgaactcgatcgccgccgacgcgctgggcgcccggcgggtcaccgagctggcgctggccgccgcccggcaggccgacacggtgtcggtgctggtgcccgacgagcagatcgtcgcggcgcggcgcggcctgtgggccgaacggcgtctcgcggtcgagcatgccgccgcgaccgcgctcgcggccctggaatcgggcgcctaccggccggcgccgggcgaacgcgtctgtgtcgtgttgtgcggggccaacaccgacccggccgatctgggctga

SEQ ID NO: 53484 - protein, 311 aa, Nocardia farcinica IFM 10152
MPIEPTVIDVDAAAERIAGLIRPVTVAPAEPPGECWLALEFLQHTGSFKARGAQNFVEAHRLAGTMPAAGVTIASGGNAGLACAWAAASRGVPATVFLPRTAPTVKVQRLRGYGAEVRLVGAEYADALAACRDFAAESGALMSHAYDDPLIAAGAGTLLTEIHRAIPKLDTVVLAVGGGGLFAGIATAAAQLGVRTVAVEPERCRALDAALAAGEPVDVEVNSIAADALGARRVTELALAAARQADTVSVLVPDEQIVAARRGLWAERRLAVEHAAATALAALESGAYRPAPGERVCVVLCGANTDPADLG

SEQ ID NO: 53485 - DNA, 1554 bp, Photobacterium profundum SS9
  CDS (1)..(1554)
atgagcgaagtaacacaggccaaggatgcagagctattaagcggagccgattaccttcgcaatattcttcgagcacctatctatgaagtggcgcaagtgacgcccctccaagatatggatcgattgtcagcaaggatcggcaatcgcatccagttaaaacgagaagatcgccagccggttcactcgtttaaactgcgtggtgcttacaacatgatgtctcagctaaccccagcgcaacgtaaagcgggggctattgcagcctctgcgggcaatcatgctcaagggttagcattatccggtcataagcttgatgttagtgcaaccatcgttatgccactgaccacacctgcgattaaagtcgatgcggtgagaagctttggtggcaaagtggttttgcacggcaataattttgatgaagccaaagcccacgctgaagaattagcgcaacaatatggttataccttcattccaccctttgatcacccatcagtgattgcaggacagggcaccatcggtatggaactgctccaacaaaatgggcatcttgattatgtttttgttcctgttgggggcggcggtttagcggctggaatatcggtattacttaaacagttaatgccgaatattaaaatcatcggtgtggaagctgaagattcagcctgcttgaaagccgcgctcgatgcgggttgtccggttacactcgaccaagttggcatgtttgctgacggtgtcgcggtaaaacgcattggtgaagaaacattccgtttatgccagcagtatcttgatgatgttattaccgttagcagcgatgaaatttgctctgccgttaaagatatttttgaagatacccgggccattgcagaaccatctggtgcactctctttagcaggactcaaaaaatacgttgaggtacaccagctacaagataagcagctagcatccattttatcgggggctaacctcaactttcatggtctacgctatgtatcagagcgttgtgaattaggtgagaaacgagaaggtctcttagcggtaacagtgccagaacggcctggggcttttcttgatttttgccatatcttaggtggccgaacagtgactgagtttaactatcgctacaacgacgatgcactggctaatgtctttgtgggggtgcgcttaatgcaagggcaagaagagctggacggcatcattcacgatcttcgaaaagggggctaccccgttgtcgatttatctgatgatgaaatggcaaaagttcacgtgcgctatatgattggtgggcgtccatcaaagccactaaaagaacgtttatatagttttgaatttccagagtaccctggcgcactattaaagtttcttaatacgctaggtacacactggaatattagcctatttaattaccgtaatcatggtgcagattttggtcgagtattatgtggttttgaattggaagacaaagatctgctgtcttttactagtcacttacacgaattaggctaccaatggaaagatgaaacggaaaacctagcatataagttttttctagcccaataa

SEQ ID NO: 53486 - protein, 517 aa, Photobacterium profundum SS9
MSEVTQAKDAELLSGADYLRNILRAPIYEVAQVTPLQDMDRLSARIGNRIQLKREDRQPVHSFKLRGAYNMMSQLTPAQRKAGAIAASAGNHAQGLALSGHKLDVSATIVMPLTTPAIKVDAVRSFGGKVVLHGNNFDEAKAHAEELAQQYGYTFIPPFDHPSVIAGQGTIGMELLQQNGHLDYVFVPVGGGGLAAGISVLLKQLMPNIKIIGVEAEDSACLKAALDAGCPVTLDQVGMFADGVAVKRIGEETFRLCQQYLDDVITVSSDEICSAVKDIFEDTRAIAEPSGALSLAGLKKYVEVHQLQDKQLASILSGANLNFHGLRYVSERCELGEKREGLLAVTVPERPGAFLDFCHILGGRTVTEFNYRYNDDALANVFVGVRLMQGQEELDGIIHDLRKGGYPVVDLSDDEMAKVHVRYMIGGRPSKPLKERLYSFEFPEYPGALLKFLNTLGTHWNISLFNYRNHGADFGRVLCGFELEDKDLLSFTSHLHELGYQWKDETENLAYKFFLAQ

SEQ ID NO: 53487 - DNA, 1260 bp, Haloarcula marismortui ATCC 43049
  CDS (1)..(1260)
atgggcatgacgcaagtcacaaccctcgagtgtacactctgtggggcagagtacgacccgaaccggatcatctacacctgtcccgaacacgagggcgtgaagggaattctcgaggtgacgtacgactacgatgctatcgatgatgcgtttgacggcgacctcggcgggccgatcgcaagtcaatggaagtacgaggcgtttctgccagtcgcagcggacgccgatatcgtgacgctcaacgagggcgggacggacctcttcgacgcgccgaatctcagcgctgcgctgggcgtggagacactggtcaaagacgacggacggaacccgaccggctgcttcaaggaccgcgccagcgctatcgcggtcacgaaagcaaaacacgccgggcgcgatatcatcacctgcgcctccaccgggaacgccgccgcgtcactgtcgggctatgccgcccgcggggggatggactgccgtattttcgtccccggtgacgccccgacggggaaactcgcacagccgctcgtctacggcgcggatgtccttgctgtcaacggcaactacgacgaagcctacgacctcagcgtcgaggtcaccgagaagtacggctggtacaaccgcaacgcggctatcaatccgttccaggtcgagggcaagcgcaccgtcggccacgagctcgcagaccagtctatcgcccgcggacacgtcccggactgggtcgtgttttcgatgggcgacggctgtacgattgccggggcctggaaggggttcaaggagttctacgacctcggctacgtcgatgaccaccccaaaatgctaggggttcaggccgaaggggcgtcggcgatccacgacgccttccacaaccacgaggatatcgacgatatcgccgaaacgctggccgattcaatcgcagtcggacggccgcggaacacgattaaggcttgccgcgcgctggaacagagcggtggcaccagcgtgctggtctccgatgaagagattctggaagccgaaacgctacttggcagcaccgaaggaatctactccgagccggcgggagcagcgcctatcgcgggcgttcagacggcgctcgaccggggaatcatcgaacaggacgaaacggtcgtcgtggtgtccaccggcttcggcctgaaggacacgaaaagcgccgagaaggcgaccggcggggtggatcgaatcgaccccgaaatcgcagaggtcgaaggtctgtacggcacggccgaagaagccgcagccgacgactga

SEQ ID NO: 53488 - protein, 419 aa, Haloarcula marismortui ATCC 43049
MGMTQVTTLECTLCGAEYDPNRIIYTCPEHEGVKGILEVTYDYDAIDDAFDGDLGGPIASQWKYEAFLPVAADADIVTLNEGGTDLFDAPNLSAALGVETLVKDDGRNPTGCFKDRASAIAVTKAKHAGRDIITCASTGNAAASLSGYAARGGMDCRIFVPGDAPTGKLAQPLVYGADVLAVNGNYDEAYDLSVEVTEKYGWYNRNAAINPFQVEGKRTVGHELADQSIARGHVPDWVVFSMGDGCTIAGAWKGFKEFYDLGYVDDHPKMLGVQAEGASAIHDAFHNHEDIDDIAETLADSIAVGRPRNTIKACRALEQSGGTSVLVSDEEILEAETLLGSTEGIYSEPAGAAPIAGVQTALDRGIIEQDETVVVVSTGFGLKDTKSAEKATGGVDRIDPEIAEVEGLYGTAEEAAADD

SEQ ID NO: 53489 - DNA, 1263 bp, Haloarcula marismortui ATCC 43049
  CDS (1)..(1263)
atgacacataccgaatcggacacgctacccgtcacatacgcagacatcgaacgagcccgcgaacgtctggacgacgacacagttgtaaagaagacgccagtcgaacggagctcgtcccttggtgggttcgtcgacgccgaggtgtacctgaagatggagcacctccagtggacagggtcgttcaaaaccagaggcgcgtacaacaagatctcgcaggacgttgccgatgacgtggagtccttcgtcgccgccagcgccgggaaccacgcccagggtgtcgctctcgccgcgacgaaatgtggggcagagtcaacgattttcatgccggagaacgcgccacaggccaagatcgacgccacgagggcctacggcggaagcgtcgaactggtcggcaacgactttcaggagacgatgtcccacgccaaagctgtcgtcgaggagaccgacgccgagttcgttcacgcctatgacgatctggacatcattgctggacaggggaccctcggaacggaaatgtaccacgactgccccgatgtcgacacagtcatcgtccccattggcggcggcggacttatcagcggtgtctcgaccgcaatcaagcacctctcgcccgagacgcgcgtcatcggtgtgcaggcgaccggcgctgagacggtgcatgaaagcctcgacaaagggattccggtcgtgcttgatgaagtcgacaccatcgccgacggtatcgctacgggcggtatctcggagacgacgctcgacatcatcgaggcgaacgtcgacgaagtcgtgacggtttcggacaccgatatcgcacaggcgattctcctgttgatggaacgagccaaacaggtcgtggaaggtgccggggccgcctccgtggctgccatactgagtgacagcctcgacgtgtcgggtgaaacggtgatgccgctgctctgtggcgggaacctcgatatgacacagatgcgagaagttctcattcatgcactcacggagcgccagcagctcctccagctccgggttcggatcgatgaccagccgggtgtgatggaggagatatctggcgtcatcgccagacagggagccaacatccacgacgttcggcacgaacggtccgtcgagaatctcgaaatcggggaggcgtatctcgtattcaacgtcgaaacgagtggtgccgagcacgcacagagtattatcacggcgatacgtgatgcgggctatcccgtcgataacgttgcacgggaggccaaaagtggcgcactgtga

SEQ ID NO: 53490 - protein, 420 aa, Haloarcula marismortui ATCC 43049
MTHTESDTLPVTYADIERARERLDDDTVVKKTPVERSSSLGGFVDAEVYLKMEHLQWTGSFKTRGAYNKISQDVADDVESFVAASAGNHAQGVALAATKCGAESTIFMPENAPQAKIDATRAYGGSVELVGNDFQETMSHAKAVVEETDAEFVHAYDDLDIIAGQGTLGTEMYHDCPDVDTVIVPIGGGGLISGVSTAIKHLSPETRVIGVQATGAETVHESLDKGIPVVLDEVDTIADGIATGGISETTLDIIEANVDEVVTVSDTDIAQAILLLMERAKQVVEGAGAASVAAILSDSLDVSGETVMPLLCGGNLDMTQMREVLIHALTERQQLLQLRVRIDDQPGVMEEISGVIARQGANIHDVRHERSVENLEIGEAYLVFNVETSGAEHAQSIITAIRDAGYPVDNVAREAKSGAL

SEQ ID NO: 53491 - DNA, 1029 bp, Haloarcula marismortui ATCC 43049
  CDS (1)..(1029)
atggccggtcgctacgaaccgatcgactccccggacgagacgaccctctttccgtaccacgacctgacgccgccgacagttgcaacggtcgctcgcgcccggcaacgcatccgacagcacctcccggagacgcccctggtccgaagcgaagccctctccgaagccctcgacgcggatgtcttgctcaagcgagaagatacgctcccgaccggcgcgttcaaagtccgcggcggggtgaacctcgtcgcgtccctcgacgaggagttccacgacgccggactgctcgccgcgagcacgggaaaccacggccagtctatcgcctgggccgggcgtgagttcgacgtacccgttactatcggcgtccccgaagaagccaacgccggaaaggtcggcgcgctggagcaactcggcgcagaagtcatccagtacggcgaggactacgacgaggcccgcgaacacatcgaggacttggcgacccagcgcgaggcgcgctacgtccactcgggcaacgaaccgaagctgctcgccggcgtcggcacggcggggctcgaaatccttgacgagcgccccgacgtcgaccgtgtgttctgccccgtcggcggcggcaccgccgcggccgggtactgcactacgctcggggcgatgaccgacgccgatgtcgtcggcgtgcaggctgcgggcgcgcccgcggtgtaccgcgcttggcaggacgagacgctggacgccctcgacagcgtcgacactatcgccgagggtgtcgcaacccgggttccgttcgcgctcccgaccgaaatcctgcaggcgggactcgccgatttccgactcgtgtccgaagacgccattaccgatgccgtggcgcgcctgttcgaaacagaccgcatcgtcatggaaggggcctgtgcgacggctgtcgccgcagcgattcaggctggtgacgaactacggggcgagacggtcgtccttcccatttcgggacggaacatcgaccgagagaagtttgaccgactgctggccgaaagcgagtactag

SEQ ID NO: 53492 - protein, 342 aa, Haloarcula marismortui ATCC 43049
MAGRYEPIDSPDETTLFPYHDLTPPTVATVARARQRIRQHLPETPLVRSEALSEALDADVLLKREDTLPTGAFKVRGGVNLVASLDEEFHDAGLLAASTGNHGQSIAWAGREFDVPVTIGVPEEANAGKVGALEQLGAEVIQYGEDYDEAREHIEDLATQREARYVHSGNEPKLLAGVGTAGLEILDERPDVDRVFCPVGGGTAAAGYCTTLGAMTDADVVGVQAAGAPAVYRAWQDETLDALDSVDTIAEGVATRVPFALPTEILQAGLADFRLVSEDAITDAVARLFETDRIVMEGACATAVAAAIQAGDELRGETVVLPISGRNIDREKFDRLLAESEY

SEQ ID NO: 53493 - DNA, 1212 bp, Haloarcula marismortui ATCC 43049
  CDS (1)..(1212)
atgctctcatttgaggatgtcctcgcggcacaggacaccgtctccgagacggccagacacacaccgcttgattactcgcacacgttttcggcgatgacgggcgcggatatccatctcaaactcgaactgttccagcgtacggggtcgttcaagatacggggtgcgaccaaccgtatcgcgtcgctttcagatgctgaacgggaggctggcgtcgtcacagcgagcgccggcaaccacgctcagggggtcgcgctggccgccacgcgaatcggcgtcgactcgaagattgtgatgccggagcgggccccggtatcgaaagtgaaggccacccggagctacggcggtaacgtggtccttcacggtcgggactacgacgcggccgccgaacacgcccacgaactcgaacgcgaggaaggccggacatacgtccatgccttcgacgacgagaaagtgatggcagggcaggggaccatcggactggagatctacgaggacctccccggcgttgatacggtcgtcgtccctatcggcggcggcggacttattagtggcatcgccacggcgctcaaaggcaaggacgaacgtatccgcgtcatcggcgtgcaggccgagggagcgtccagcgtggccgaatccctggagaagggccaccgcatcgagcgtgacagcgtcgaaactatcgccgacggtatcgccacccgcactgtcggcgagcagacgttcgaggtcatcagcgaccgcgtcgacgaggtcgtgacggtgtcggactcggaaatcgcagtcgcgctgacgacactgttagagcgctcgaaaacgcttgccgagggcgcgggtgccgtcgcgctggctgccgtcatggaagagaagttcgacttcgaggacgacgagacgatcgttcccgcgctgtgtggcgggaacatcgacctgaacaccctgaccaacgtcatcatgcgcggcctcgttgagactggccggtatctcaaaatccggaccgtccttcaggaccggcccggcgcgctggaagagctcgtcgaggtcctgtcacgcgagcaggtcaacatctacggcatcgagcacgaccggaccagtcgcgacgtggcgatgagttcggccgaggtcgaactggacctggagacccgcggccacgaccacgtcgccgaactcatcgacgcgctcaccgacgaggggtatgaggtcgacgtgctcgtctga

SEQ ID NO: 53494 - protein, 403 aa, Haloarcula marismortui ATCC 43049
MLSFEDVLAAQDTVSETARHTPLDYSHTFSAMTGADIHLKLELFQRTGSFKIRGATNRIASLSDAEREAGVVTASAGNHAQGVALAATRIGVDSKIVMPERAPVSKVKATRSYGGNVVLHGRDYDAAAEHAHELEREEGRTYVHAFDDEKVMAGQGTIGLEIYEDLPGVDTVVVPIGGGGLISGIATALKGKDERIRVIGVQAEGASSVAESLEKGHRIERDSVETIADGIATRTVGEQTFEVISDRVDEVVTVSDSEIAVALTTLLERSKTLAEGAGAVALAAVMEEKFDFEDDETIVPALCGGNIDLNTLTNVIMRGLVETGRYLKIRTVLQDRPGALEELVEVLSREQVNIYGIEHDRTSRDVAMSSAEVELDLETRGHDHVAELIDALTDEGYEVDVLV

SEQ ID NO: 53495 - DNA, 1251 bp, Streptococcus thermophilus CNRZ1066
  CDS (1)..(1251)
atgattactgcaaatgatatcgtaaaggctaatgaagtcttaaaaaacgtggtggagcgtaccccactagattttgatcgctacttatctgaaaaatatggagcgactatttatattaaaaaagaaaatatgcaaaaggtacgttcctttaaattacgtggtgcctactatgcgatccatcagttaagtgatgaagacaaggaacatggtgtggtctgtgcatcagccggaaaccatgcccaaggtgttgcttatacttgtaatgaaatgaagattcctgcaactatctttatgccagtaacaactcctctccaaaaaattggtcaagtacgtttctttggtggcaagtttgtaacaattaaattggttggagatacctttgatgaatctgctaaagcggcacaagagtatacgaagtcggaagggatgactttcattgatccattcgatgattataatgtccaagcgggtcaaggaactgttgcttatgaaatttatgagcaagctcaagaggaaggtgtttcctttgatagtatcttagtgccggtaggtgggggtggactcatctctggtgtggctacctatatcaaggatgtggcaccctctatagaggttgtaggtgttgaggctagtggtgctcgtagtatgcgtgcagcctttgaccatggttatcctgtaaaacttgaaaagattgataagtttgcagatgggattgctgtccaaaaggtaggtgcaaaaacttacgaagttgctcgtaaatatgtagatcgtctcttgggagttgatgaaggattaatctcagaaaccttaattgatatgtactcgaaggttggtactatcgcagaacctgcaggggcagcatcagttgcggcacttgaagtgattaaagatgaaatcaaaggaaaaactatcgtttgcatcatttcaggcggtaataatgatatcaaccgtatgccagagatggaagaacgtgcccttatctatgatgggatcaagcactattttgtggttaatttcccacaacgtccaggagcccttcgtgagtttgtaaatgatatcttagggccaaatgatgacattactcgttttgagtacatcaaacgtgccaataaaggaaaaggtccagttctcattggtatagctcttagtgataagaatgattatgatggccttcttgagcgtctttctgaatttgatccaagttacattaatcttaacggaaatgaaacactttacaacatgcttgtctga

SEQ ID NO: 53496 - protein, 416 aa, Streptococcus thermophilus CNRZ1066
MITANDIVKANEVLKNVVERTPLDFDRYLSEKYGATIYIKKENMQKVRSFKLRGAYYAIHQLSDEDKEHGVVCASAGNHAQGVAYTCNEMKIPATIFMPVTTPLQKIGQVRFFGGKFVTIKLVGDTFDESAKAAQEYTKSEGMTFIDPFDDYNVQAGQGTVAYEIYEQAQEEGVSFDSILVPVGGGGLISGVATYIKDVAPSIEVVGVEASGARSMRAAFDHGYPVKLEKIDKFADGIAVQKVGAKTYEVARKYVDRLLGVDEGLISETLIDMYSKVGTIAEPAGAASVAALEVIKDEIKGKTIVCIISGGNNDINRMPEMEERALIYDGIKHYFVVNFPQRPGALREFVNDILGPNDDITRFEYIKRANKGKGPVLIGIALSDKNDYDGLLERLSEFDPSYINLNGNETLYNMLV

SEQ ID NO: 53497 - DNA, 936 bp, Thermus thermophilus HB8
  CDS (1)..(936)
atgccttccctccaagacctctacgccgccttccgccgcatcgccccctacacccaccgcacccccctcctcacctcccgcctcctggacgggctcctgggaaagcgcctcctcctcaaggccgagcacctgcagaagacggggagcttcaaggcccggggggcgctttccaaggccctcgccctggaaaaccccaaggggctcctcgccgtctccagcggcaaccacgcccagggggtggcctacgccgcccaggtgctcggggtaaaggccctggtggtcatgcccgaggacgcgagcccctacaagaaggcctgcgcccgggcctacggggccgaggtggtggaccggggggtgacggcaaagaaccgggaggaggtggcccgggcccttcaggaggagacgggctacgccctgatccacccctttgacgaccccctggtcatcgccgggcaggggacggcggggcttgagcttctggcccaggcggggcggatgggggtcttccccggggccgtcctcgcccccgtggggggcggggggctcctcgcgggcctggccacggcggtgaaggccctctcccccacaaccctcgtcctcggggtggagcctgaggccgcggacgacgccaagagaagcctggaggcgggaaggatcctccgcctggaagcgccccccaggacccgggcggatggggtgcggacgctaagcctgggggagcgcaccttccccatcctgcgggaaagggtggacgggatccttacggtgagcgaggaggccctcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 53498 - protein, 311 aa, Thermus thermophilus HB8
MPSLQDLYAAFRRIAPYTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAKNREEVARALQEETGYALIHPFDDPLVIAGQGTAGLELLAQAGRMGVFPGAVLAPVGGGGLLAGLATAVKALSPTTLVLGVEPEAADDAKRSLEAGRILRLEAPPRTRADGVRTLSLGERTFPILRERVDGILTVSEEALLEAERLLFTRTKQVVEPTGALPLAAVLEHGARLPQTLALLLSGGNRDFSP

SEQ ID NO: 53499 - DNA, 1209 bp, Geobacillus kaustophilus HTA426
  CDS (1)..(1209)
atgttgacattagcagacattgaacaagcgcgagcgaaaatgaaaggcatcgtccatcaaacgccgcttgagcattcgcaaacgttcagccggctgtctggcaatgatgtatatatgaaactcgaaaatttgcaaaaaacgggctcgtttaaagtaagaggttcattcaataaaattatgtcgctcacggaagaagagagggcgcgcggcgtcatcgccgcttcggccggcaaccacgcccaaggggtcgcctatgcgagcggcatgcttcatattccgtgcacgatcgtcatgccaaaaggcgcgccgctcagcaaaattgaagcgacgaaaagctacggggcggaagtcgtgctgtacggcgatgtgtttgacgagtctttggaatatgcgttagagttgcagcgtgaacgggggatgacgtttgttcatccgtttgacgacttggcggtgatggccggccaagggacgatcggcttagagctgatcgagcagcttcccgacgtcgatgtcgttctttgtccagtcggcggcggcgggttgcttgcgggggtggcgcttacgttaaaacagctgaagccgtcggttgaagtgtacggcgttgagtcatcggcttgccccggcatgacggcggccatacgccataaacagcccgtctccattgccgcatcgaatacgatcgccgatgggattgccgtgaaaaagccgggcaatattacgtaccaatacattgagcaatacgtcgatggcgttgtatgcgtggaagaggcggaaatttcgcggacgatgctgtatgtgctcgagcggaacaagctgttgatcgaaggggcggcagcttgtccgctggcggcattgttgtatcaaaagctgccgtttcgcggcaaaaaagtcgccgccattttaagcggcggcaacgtcgatgtgacgctcatttcccgcatcatcgagcgggggctcgtcgaagccgggcgattcgttacgtttacaacggtcatctccgacaagccgggccagttgaacaagctgctgcgcattattgcggagcttgaggcaaacgtgatgtcgattcatcatcagcgcatcggcgccaaagtgctgccaggtcaggcggaaattcacttttcgctcgagacaaaaaacgaagaccacattcagcaaatctaccaagtgttgttgaaagaaggctacgatgtacagttttaccgatga

SEQ ID NO: 53500 - protein, 402 aa, Geobacillus kaustophilus HTA426
MLTLADIEQARAKMKGIVHQTPLEHSQTFSRLSGNDVYMKLENLQKTGSFKVRGSFNKIMSLTEEERARGVIAASAGNHAQGVAYASGMLHIPCTIVMPKGAPLSKIEATKSYGAEVVLYGDVFDESLEYALELQRERGMTFVHPFDDLAVMAGQGTIGLELIEQLPDVDVVLCPVGGGGLLAGVALTLKQLKPSVEVYGVESSACPGMTAAIRHKQPVSIAASNTIADGIAVKKPGNITYQYIEQYVDGVVCVEEAEISRTMLYVLERNKLLIEGAAACPLAALLYQKLPFRGKKVAAILSGGNVDVTLISRIIERGLVEAGRFVTFTTVISDKPGQLNKLLRIIAELEANVMSIHHQRIGAKVLPGQAEIHFSLETKNEDHIQQIYQVLLKEGYDVQFYR

SEQ ID NO: 53501 - DNA, 1272 bp, Geobacillus kaustophilus HTA426
  CDS (1)..(1272)
atggaacaacagctgaaacggaagcaaggggcggtatacgtcgaggacattttgatcgcgtatcatacgctgaaggatgttgttttccatacgccgctgcaaaaaaatccgctgttatccgagcgctacgagtgcaatgtctacttaaagcgcgaggatttgcaagtcgtgcgttcgtttaagttgcgcggggcgtacaaccggatgaagcatttaaccgatgaggagcggagaaacggggtggtatgcgccagcgccggcaaccatgcccaaggggtggcctattcatgccgggcgcttggcgtgcacgggaaaatttatatgccggcgacgacgcctcggcaaaaagtgtcgcaagtgcagctgtttggcaaagacatggtcgagatcgtgcttgtcggcgacacgtttgacgattcctacaacgaagcggtgaagtgcgccgaggcggaagggcggacgttcatccatccgtttgatgatgaatacgtcattgccggacaggggacgattggcgtcgaggtgttaaacgactgtgatgaaccgatcgactttttgttcgccagcatcggcggcgggggattgatggccggactagggacgtatgtgaaaagcatttctccgtccaccaaagtcatcggggtcgagccggctggcgccccatcgatgaaagcggcgctcgagcgcggacatgtggtgacgctcgatgaaatcgacaagttcgttgacggcgctgccgtcaagacggtcggggaaaagacattcgccttatgccgcggggtgcttgatgacatcgtcgtcgttccggaaggaaaagtatgcacgacgattttggagctgtacaacgaaaacgccattgtcgctgaaccggcaggggcgctgccgatcgccgcgcttgatttttacaaggaacaaatccgaggcaaaacagtcgtctgcgtcataagcggcggcaacaacgacatcgaccggatgcaggaaatcaaagagcgttcgatgatttacgaaggactgcagcactatttcatcgtcaacttcccgcagcgggctggggcgttgcgtgagtttttggatgaagtgcttgggccgaccgatgacatcacccggtttgaatacacgaagaaaaacaacaaagaaagcggaccggcgcttgtgggcatcgaactgaaacggcgcgaagactacgcgccgctcatcgagcggatgaagaaaaaaggcttcccgttccaagaagtgaacaaagacccgaacttgttccatttattgatctaa

SEQ ID NO: 53502 - protein, 423 aa, Geobacillus kaustophilus HTA426
MEQQLKRKQGAVYVEDILIAYHTLKDVVFHTPLQKNPLLSERYECNVYLKREDLQVVRSFKLRGAYNRMKHLTDEERRNGVVCASAGNHAQGVAYSCRALGVHGKIYMPATTPRQKVSQVQLFGKDMVEIVLVGDTFDDSYNEAVKCAEAEGRTFIHPFDDEYVIAGQGTIGVEVLNDCDEPIDFLFASIGGGGLMAGLGTYVKSISPSTKVIGVEPAGAPSMKAALERGHVVTLDEIDKFVDGAAVKTVGEKTFALCRGVLDDIVVVPEGKVCTTILELYNENAIVAEPAGALPIAALDFYKEQIRGKTVVCVISGGNNDIDRMQEIKERSMIYEGLQHYFIVNFPQRAGALREFLDEVLGPTDDITRFEYTKKNNKESGPALVGIELKRREDYAPLIERMKKKGFPFQEVNKDPNLFHLLI

SEQ ID NO: 53503 - DNA, 960 bp, Idiomarina loihiensis L2TR
  CDS (1)..(960)
atgccgaagttatcgctcccctgccatgccgatgtcgtacaagcgcagcaaagaattaatagctataccgtcaagacccctgtgctgacaaaccctgcgttaaatcagcaattgggctgcgaattatttttcaaatgcgagaatttgcaacgtaccggggcctttaagttccgtggtgccactaacgcgctacttaagcttagcccggagcagcgccagcaaggggttatcaccgtgtcttccggcaatcatggtgcggcattagcccatgcaggtaaagctttgggtgtaaaagtaaaagtgggtgtacccattaatgctcccgcaataaaacggcaaaatattgaagccggtggtgcggaaactaccgacatagaacccggtatggcagcgcgtgaagccattgtggccaagtggcaaaaggaaggtaaaagtcactttataccgccttatgatcatgccgacattattgccggtcagggcacagcaacacttgagttactggagcaaactgacgcactggatgctgtaatcacgccactgggtggtgggggcttgctttcaggagcttgtcttgcctgcgacggtaccgaaatacaagtgttcggtgcggagccggaattagcgaatgatgctttcttgtcattaaaagccggagagcggcaaccggcgttacccgcgaaaagcctgtgcgatggcttactgactcaaatcggtgaattgccgtttgccattattcagcaacgtatctgcggtatcttagtcttgaaggatgaagacaccctaagcgccatgaagctgatttggcatcatctgaaaattattgtggaaccgtcgtctgctatcgctttagctgcggttatacaaaataagtcgctatttgaaggtaaacgagtggggttggtgctgagcggtggtaatgttgcagcgcagccggaagatataaagctgcgccagtag

SEQ ID NO: 53504 - protein, 319 aa, Idiomarina loihiensis L2TR
MPKLSLPCHADVVQAQQRINSYTVKTPVLTNPALNQQLGCELFFKCENLQRTGAFKFRGATNALLKLSPEQRQQGVITVSSGNHGAALAHAGKALGVKVKVGVPINAPAIKRQNIEAGGAETTDIEPGMAAREAIVAKWQKEGKSHFIPPYDHADIIAGQGTATLELLEQTDALDAVITPLGGGGLLSGACLACDGTEIQVFGAEPELANDAFLSLKAGERQPALPAKSLCDGLLTQIGELPFAIIQQRICGILVLKDEDTLSAMKLIWHHLKIIVEPSSAIALAAVIQNKSLFEGKRVGLVLSGGNVAAQPEDIKLRQ

SEQ ID NO: 53505 - DNA, 1521 bp, Azoarcus sp. EbN1
  CDS (1)..(1521)
atgactgccgcaatcccggattatctggaaaaaaccctcaacgcccgcgtctatgacgtcgcggaagaaactccgctcgacctcgccccgaacctgtccgcacgcatccacaaccgcatctacctcaagcgcgaggacatgcagccggtattcagcttcaagctgcgcggggcctacaacaagatggcgcacctgccgccgcaggcgctcaagcggggggtgatctgcgcctcggccggcaatcatgcacaaggcgtcgcgctgtcggcgcagaagctcggggtgcgcgcggtgatcgtgatgccgacttcgacgccgcagatcaaggtcgacgcggtcagggcgcggggcggcgaggtggtgctcgccggtgactcctactcggacgcctacgcccactcgctggaactggaaaaggtggacaagctcactttcgtccatccttatgacgacccggacgtcatcgccggacagggcacgatcggcatggagatcctgcgcgcgcaccccgatccgatccacgcgattttctgcgccgttggcggcggcggactgatcgccggcgttgccgcctacgtgaagcggctgcggcccgaaatcaggatcgtcggcgtcgagacggtggacgccgacgcgatgacgcgctcgctcgcagcgggcgaacgggtcgttctcgaccaggtcggcctgttcgccgacggcaccgcggtcaagcagatcggcgaagagactttccggctgtgccgggagtatgtcgacgagatggtcctcgtcgacaacgacgcgatctgcgccgccctgaaagacgtcttcgaggacacgcgctcgatcctcgagccttccggcgcgctggcgatcgccggggcgaaggaatacgcgaagcgccacaatctgcatggcaagtgcctggtagcggtggcgtccggcgcgaacatgaatttcgatcgcctgcgtttcgttgccgaacgcgccgaagtgggcgagcaacgcgaggcggtgttcgccgtgacgatcccggaacgccccggctcgttccgcaaattctgcagcctcgtcggcgatcgccacatcaccgagttcaactatcgctacgccgacgccgaacaggcgcacatcttcgtcggcgtgtcggtgcacaaccgcgccgaggcgtcccgcctcatcgagatgctcgggcgccacgaactgccggcagtcgacctcaccgacgacgaaatggcgaagagccacgtccgctacatggtcggcggacacgcgccgcacatcgacaacgagctggtgtaccgcttcgaattccccgagcgccccggtgccctgatgaatttcctcacgaatctgcactcggactggaacatcagcctgttccactaccgcaaccacggctcggattcgggtcgcgtgctggtcggcatgcaggtgcctcccggcgacaagacggcattcagcgcgtttctcgaccggctcggctatgaatccgccgatgagtccgggaacccggcataccgcatgttcctcggctga

SEQ ID NO: 53506 - protein, 506 aa, Azoarcus sp. EbN1
MTAAIPDYLEKTLNARVYDVAEETPLDLAPNLSARIHNRIYLKREDMQPVFSFKLRGAYNKMAHLPPQALKRGVICASAGNHAQGVALSAQKLGVRAVIVMPTSTPQIKVDAVRARGGEVVLAGDSYSDAYAHSLELEKVDKLTFVHPYDDPDVIAGQGTIGMEILRAHPDPIHAIFCAVGGGGLIAGVAAYVKRLRPEIRIVGVETVDADAMTRSLAAGERVVLDQVGLFADGTAVKQIGEETFRLCREYVDEMVLVDNDAICAALKDVFEDTRSILEPSGALAIAGAKEYAKRHNLHGKCLVAVASGANMNFDRLRFVAERAEVGEQREAVFAVTIPERPGSFRKFCSLVGDRHITEFNYRYADAEQAHIFVGVSVHNRAEASRLIEMLGRHELPAVDLTDDEMAKSHVRYMVGGHAPHIDNELVYRFEFPERPGALMNFLTNLHSDWNISLFHYRNHGSDSGRVLVGMQVPPGDKTAFSAFLDRLGYESADESGNPAYRMFLG

SEQ ID NO: 53507 - DNA, 1242 bp, Azoarcus sp. EbN1
  CDS (1)..(1242)
atgtcgtccatcccggtgccgctcacattgcccgatctcgtcgccgcgcgcgaacgcatccgcgatgcggtcgtccgtaccggccagtggcagaatgacgcgctgtccgacgaactcggcgtgccgctgcaactgaagctcgaaaacatgcagcgcaccggctcgttcaagctgcgcggcgcgacgcacaagatcggccgcctgctggaagccggtgctcggcccgccggcgtcgtcgcggcgtcggccggcaaccacgcgcagggcgttgcgcgcgcggctgcgcgggtcggcctcggggcggtcgtcgtgatgccggcgaacgcgccgctgacgaagatccaggcgtgtcgcaagctcggtgccgacgtgcgcctcgtcggcgacacgctcgaagccgccagcgacgaagcgcgccggctggccgacggcgaagggctcgcgctgatccatccctacgacgactgggacgtgatcgccggccaggcgagctgcggcctggagatgctcgaagacgcgccggacatgaccgtcgcgatcgtgccgctcggcggcggcgggctgctctccggcgtcgcgctggcgctgaagctgcagaatccggcgatccgcgtcatcggcgtgcagaccgacgcggtcgcgccgtggcggcatttcttgcgcgacggcaccctcgaggcggtgcggccggacgcccacacgatcgccgacggcatcaaggtgaaacggccgggaatgctgacgcggcaggtgatcgcgcgccacgtcgacgacatcgtcaccgtcgacgacaacgcgatcgccgaggcgatcgtcacgctgctcgaacgcacgcgcacgatcggcgaaggtgcgggcgtggtcgggctcgcggcgctgctgcagcgcaaggtccgcctcgggcccgacgaccgcgcggtggtcgtgatttcgggcggcaacgtcgatatgacgctcgtcgggcgttcgatcgactacggcctcgcgtcgagcgggcggctgatgagcgtcgcggtgatgatttccgatgcgccgggccagttgctcgcgctgctggcgacagtcgccgaactcggcatgaacgtgcgccatgtcgagcaccgccgcggcgaactgcacgtcgcggtcggcatgaccgaagtgatcctgcagatcgagacgcgcgatgccgagcaccagcacgcgctgctgacgcactttgccgcccagggccttgccgtgcgcaacctgctcgcgggatga

SEQ ID NO: 53508 - protein, 413 aa, Azoarcus sp. EbN1
MSSIPVPLTLPDLVAARERIRDAVVRTGQWQNDALSDELGVPLQLKLENMQRTGSFKLRGATHKIGRLLEAGARPAGVVAASAGNHAQGVARAAARVGLGAVVVMPANAPLTKIQACRKLGADVRLVGDTLEAASDEARRLADGEGLALIHPYDDWDVIAGQASCGLEMLEDAPDMTVAIVPLGGGGLLSGVALALKLQNPAIRVIGVQTDAVAPWRHFLRDGTLEAVRPDAHTIADGIKVKRPGMLTRQVIARHVDDIVTVDDNAIAEAIVTLLERTRTIGEGAGVVGLAALLQRKVRLGPDDRAVVVISGGNVDMTLVGRSIDYGLASSGRLMSVAVMISDAPGQLLALLATVAELGMNVRHVEHRRGELHVAVGMTEVILQIETRDAEHQHALLTHFAAQGLAVRNLLAG

SEQ ID NO: 53509 - DNA, 1239 bp, Zymomonas mobilis subsp. mobilis ZM4
  CDS (1)..(1239)
atggtaagcttggataatccagagactcttcccgtttcacttgatgatatcaaacaggcgcatcaacgcattaagaatgccattattagaaccccgaccctttacagtcggactttgtctgacttgattggtgccggtgtctggctgaaatttgaaaatttccagtttaccgccgcctataaagaacggggtgcgttaaataaattattgtcgctggacaaggttgcccgcgaaagaggggttattgccgcttcggccggaaatcatgcccaaggtctcgcctatcacgggaatcgtttggatattccggtcacgatcgtgatgcctgtccataccccgacggtaaaagtcgagcagacccgtggacatggtgcgaatatcgtcctttatggcgaacaattcgatgaatcccttgcccatgcgttagaattggctgaaaaagacaatctgacctttgtccatcctttcaatgatccagctattattgccggtcagggcacggttgcccttgaaatgttggaagatgccccagcgattgacactctggttgtgccagtgggtggcggcggcctgatttcaggctgtgctgtggttgccaaaaacgcagatcggcctttggatgttattggtgccgaagccgagctttatccttcgatgtatgattatatcaaagggaaaaatctgccttgcggtggggatactctggcagaagggatcgcggttcaggttcccgggcagttaactcgccgttttgttgaagccttggtcgatgatattttgctggtcagtgaaagcaatatcgaacatgctttgtctttgattgttcagattgaaaagacgattgttgaaggggctggcgcggctggtttgggggcgttgctatcgcatcccgaacgattccaaggcagacaggtaggcattatcttttctggcggtaatatcgacacccgcttgttagccaatgttctattgcgtgatttggcacgctctggtcgtctggcgcggttgcgggtcagaatgaaagatcaagcaggtcagctttacaaagtagcgcgtgttttccacgatcagcaggcgaatattgtcgaaatttcttatcagcgcatctttacaaccctgcccgctaagggattatgtgccgatattgaatgtgaaacgcgcgatcaggctcatttgcggcatttaatcgatgctttacgtgaagcgggttatggtgtgaccttgattgaaccggcctga

SEQ ID NO: 53510 - protein, 412 aa, Zymomonas mobilis subsp. mobilis ZM4
MVSLDNPETLPVSLDDIKQAHQRIKNAIIRTPTLYSRTLSDLIGAGVWLKFENFQFTAAYKERGALNKLLSLDKVARERGVIAASAGNHAQGLAYHGNRLDIPVTIVMPVHTPTVKVEQTRGHGANIVLYGEQFDESLAHALELAEKDNLTFVHPFNDPAIIAGQGTVALEMLEDAPAIDTLVVPVGGGGLISGCAVVAKNADRPLDVIGAEAELYPSMYDYIKGKNLPCGGDTLAEGIAVQVPGQLTRRFVEALVDDILLVSESNIEHALSLIVQIEKTIVEGAGAAGLGALLSHPERFQGRQVGIIFSGGNIDTRLLANVLLRDLARSGRLARLRVRMKDQAGQLYKVARVFHDQQANIVEISYQRIFTTLPAKGLCADIECETRDQAHLRHLIDALREAGYGVTLIEPA

SEQ ID NO: 53511 - DNA, 954 bp, Silicibacter pomeroyi DSS-3
  CDS (1)..(954)
atgtatataccgacctttgaggacatgcttgccgcgcatgcgcggatcgaaccccatatccgccgcacgccggttcgggtctcggattacctcaacgagctgaccggtgcgcagctgttcttcaaatgcgagaactttcaggagccgggcgcgttcaagatacgcggcgctaccaacgcggtgtttggcctggacgatgcccaggccgcaaagggggtcgccacgcattcatcgggcaatcatgcctcgtgtctgagctatgccgcgatgctgcgcggtatcccctgcaacgtggtgatgccaagcaccgcgccgcaggccaagaaggacacggtgcgccgttatggcggggtcatcaccgaatgcgccccctcgaccagcgcgcgcgaagagacctttgcccgggtgcaggcgcaaaccgggggcgatttcgtgcatccctataacgacccccgggtgatcgcggggcaggggacatgcgcgcgcgaactgatggaacagaccgatggtctggatatcgtggtggcaccgatcggcggtggcggcatgatctctggcacctgcctgaccctgtcgacactggcgcccgagacccgagtgatcgcggccgaaccggaacaggccgatgacgcctatcgcagcttcaaggcgggccatatcatcgccgatgacgcacccaagaccattgccgatggtctgctggtaccgctcaaggatctgacctggcatttcgtcagcaaccatgtggccgaaatctacacggcctccgagcaggagatcatcgaggcgatgaagctgacatggaaacacctgcgcgtggtgatggaaccctccagcgcggtgccgctggcgacgatcctgaagaaccgcaaggcatttgcgggcaagcgcgtgggcgtaatcattaccggcggcaacgtcgatctggacaaacttccttggatgaacgggtga

SEQ ID NO: 53512 - protein, 317 aa, Silicibacter pomeroyi DSS-3
MYIPTFEDMLAAHARIEPHIRRTPVRVSDYLNELTGAQLFFKCENFQEPGAFKIRGATNAVFGLDDAQAAKGVATHSSGNHASCLSYAAMLRGIPCNVVMPSTAPQAKKDTVRRYGGVITECAPSTSAREETFARVQAQTGGDFVHPYNDPRVIAGQGTCARELMEQTDGLDIVVAPIGGGGMISGTCLTLSTLAPETRVIAAEPEQADDAYRSFKAGHIIADDAPKTIADGLLVPLKDLTWHFVSNHVAEIYTASEQEIIEAMKLTWKHLRVVMEPSSAVPLATILKNRKAFAGKRVGVIITGGNVDLDKLPWMNG

SEQ ID NO: 53513 - DNA, 975 bp, Silicibacter pomeroyi DSS-3
  CDS (1)..(975)
atgagcacccttgaactgatcgaagccgctgccgagcggctgtcgggccatgtccgccgcacaccgctgctctcctcgccctttctggacgagatcgccgggcgccgggtactggtgaaacccgaatgcctgcaacataccggcagcttcaagtttcgcggcgcatggtcggccatttccgcgctggaccccgaggcgcgcgcgcgcggggtcatcgccttttcctcgggcaaccatgcgcaaggggtcgcccatgcggccacgctgcatggcatcgcctcggtcatcgtgatgccctcggacgcgccccggctcaagatcgacaacacaagagcgctgggggccgaggtggtgctgtatgaccggggccgcgaaagccgcgaagagatcggcaccgcgctggccggtgaacgcgggctgacgctgatccggccctatgacgaaccgcaggtgatcgccggtcaggccagcgtcgggctggaactggccgaacaggcgggcgaactgggggtcgagagcggcgatgtgctggtctgttgcggcggtggcgggttgacctcgggcgtggcactggcgctggaggcgcgggcgccgggcctgagggcgcgcccggtcgagcccgaggggtttgacgatgtgaaacgctcgcttgccggcgggaccatcagccgcaacaattcggaaaccggcaatatttgcgacgcgatcctgacgccggaaccgggcaggattacctttccgatcctcagccggctctgtggccccggcctggccgttaccgaggacgaagccctgcgcgccatggcgctagcctttctgcgcctcaagatcgtgctggaaccgggcggggcggtctcgctggcggcggccctgtttcacccggaccaggtcgaaggcgacaccgtgctggccgtggcctcgggcggcaatgtcgacgcggccctgttccgcaccgcgctggagctccacgcgtga

SEQ ID NO: 53514 - protein, 324 aa, Silicibacter pomeroyi DSS-3
MSTLELIEAAAERLSGHVRRTPLLSSPFLDEIAGRRVLVKPECLQHTGSFKFRGAWSAISALDPEARARGVIAFSSGNHAQGVAHAATLHGIASVIVMPSDAPRLKIDNTRALGAEVVLYDRGRESREEIGTALAGERGLTLIRPYDEPQVIAGQASVGLELAEQAGELGVESGDVLVCCGGGGLTSGVALALEARAPGLRARPVEPEGFDDVKRSLAGGTISRNNSETGNICDAILTPEPGRITFPILSRLCGPGLAVTEDEALRAMALAFLRLKIVLEPGGAVSLAAALFHPDQVEGDTVLAVASGGNVDAALFRTALELHA

SEQ ID NO: 53515 - DNA, 1227 bp, Silicibacter pomeroyi DSS-3
  CDS (1)..(1227)
atgagcgatttcatgacccgagcccgcgccgccgaacaggcgatgcgcgaagttttccccgccacgccgttgcagcgaaacgaccatctgtcggcgcgttatggcgccgatatctggcttaagcgcgaggatctgagcccggtccgctcctacaagatccgaggtgcgttcaacgcgatgcgcaagcagccggggcaggggctgttcgtctgtgcaagtgccggcaatcatgcccagggcgtggcctttatgtgtcggcacatgggggtacggggcgtgatcttcatgccggtgaccacgccgcagcagaagatccagaagacccgcatgttcggcggcgatcaggtcgaaattcacctgaccggcgactatttcgaccagacgctggccgccgcacaggcctggtgcgcgcaggagggtgggcatttcctgtcgcccttcgacgatgccgatgtgatcgaggggcaggcctcgctggccgtcgagatcgaggaacagctgggcggcgtgcccgatcatgtggtgctgccggtgggtggcggcggcatgtcggcgggggtggcgacctggttcggggatcgcagccattgcatctttgtcgaacccgagggcggcgcctgcctgcgcgcggcgctggcggcggggcatccggtaaagctggatcatgtggacaatttcgtcgatggcgcggcggtgggccggatcggggaaaagacattcgaactgctgaaatcgcggcacatgtccgatgtgctggtgatgcccgaagatcgcatctgcaccaccatcatcgagatgctgaatgtcgaggggatcgtgctggaacccgccggcgcgctgtcggtcgaggcggtggccgatgtgcaaagctttgtccggggcaagacggtggtctgcgtcacctcgggcggcaatttcgatttcgaacgcctgcccgaggtcaaggagcgcgcgcagcgctatttgggggtcaagaaatacttcctgctgcgcctgccacagcgaccgggcgcgctgaaggaatttctgaacattctggggcccgatgacgatatcgcccggttcgaatacatgaagaaatcggcgcgcaatttcggctcggtcctgatcgggatcgaaaccgcgaggcccgagaacttcgaacgcctttacgcccgtctggacgaggccgggtttacctataccgatatcacccgcaacgagacgctggcgcaattcgtgatctga

SEQ ID NO: 53516 - protein, 408 aa, Silicibacter pomeroyi DSS-3
MSDFMTRARAAEQAMREVFPATPLQRNDHLSARYGADIWLKREDLSPVRSYKIRGAFNAMRKQPGQGLFVCASAGNHAQGVAFMCRHMGVRGVIFMPVTTPQQKIQKTRMFGGDQVEIHLTGDYFDQTLAAAQAWCAQEGGHFLSPFDDADVIEGQASLAVEIEEQLGGVPDHVVLPVGGGGMSAGVATWFGDRSHCIFVEPEGGACLRAALAAGHPVKLDHVDNFVDGAAVGRIGEKTFELLKSRHMSDVLVMPEDRICTTIIEMLNVEGIVLEPAGALSVEAVADVQSFVRGKTVVCVTSGGNFDFERLPEVKERAQRYLGVKKYFLLRLPQRPGALKEFLNILGPDDDIARFEYMKKSARNFGSVLIGIETARPENFERLYARLDEAGFTYTDITRNETLAQFVI

SEQ ID NO: 53517 - DNA, 1008 bp, Silicibacter pomeroyi DSS-3
  CDS (1)..(1008)
atgacgacgaaaatcactcttcaggacagcatcagggcgcgggcgcggattgccgggcgtatccgcgaaacccctttggtggaatcgccctctctcagcagtctgagcggcaggcaagtcctgctaaagctggaaagcaggcagatcaccggcagcttcaagctgcgcggcgccaccaatgcggtcttgtcgctgacggatacgcagcgcgcggcgggcgtggttggggtatctaccggcaaccacgggcgcggactggcctatgcggcggcagaggccgaggtgcgttgcatcatctgcatgtcggaactggtgccgcagaacaaggttgacggcatcagatcccatggcgccgaggtgcgtatcctgggccggtctcaggacgatgcgcagcaggaagtcgaccggctggtcagagatggcatgaccatgctgcccccctttgaccatccggatatcattgccggccagggcaccgtcgcgctggaaatgctggatcaggcgccagaccttgaaaccgtgttggttcccctgtcgggtggcgggctgatttccggtgtcggcatggttctgaaagcggcgaacccggatatccgggtgatcggcgtcagcatggaacgcggcgccgcgatgtatgaatgcctgcaggcgggcaggcccgttcaggttgcggaactgcccacattggccgactctctgggcggggggatcgggctggacaatgcctatacattcgaaatgaccaaggcgtttgtcgatgaggtggtgctggtgtccgaggctgaaatcgccgccgccatccgccatgcctatttcgaggaacgcgaggtgatcgaagggtccggcagcgtcggcatcgcggcgctgctggccggcaagatcggcaatcccggccgttgtgtgtcgctggtgagcggtcagaacatcgctatggacctgcacaaacgcatcatcgacggtgaagacgtggatgtggaagccgacatcaaaggaggcgcagatgcctga

SEQ ID NO: 53518 - protein, 335 aa, Silicibacter pomeroyi DSS-3
MTTKITLQDSIRARARIAGRIRETPLVESPSLSSLSGRQVLLKLESRQITGSFKLRGATNAVLSLTDTQRAAGVVGVSTGNHGRGLAYAAAEAEVRCIICMSELVPQNKVDGIRSHGAEVRILGRSQDDAQQEVDRLVRDGMTMLPPFDHPDIIAGQGTVALEMLDQAPDLETVLVPLSGGGLISGVGMVLKAANPDIRVIGVSMERGAAMYECLQAGRPVQVAELPTLADSLGGGIGLDNAYTFEMTKAFVDEVVLVSEAEIAAAIRHAYFEEREVIEGSGSVGIAALLAGKIGNPGRCVSLVSGQNIAMDLHKRIIDGEDVDVEADIKGGADA

SEQ ID NO: 53519 - DNA, 921 bp, Silicibacter pomeroyi DSS-3
  CDS (1)..(921)
atggattggaaagcggatatcgcggcggcggcggatcggatcgccgggcatgtgcaagtgaccccggtgatggagacgcgcggatttggcctgtccgacccgctttccctgaagctggaacagatgcagcataccggcagtttcaaggcgcgcggggcctttaataccctgctgtccagcgacgtgcccgctgcgggtgtggtggccgcatcgggtggcaatcatggtgcggcggtggcctatgcggcccgcgctctgggccatcgcgccaagatcttcgtgccggaaatggctggccccgccaagatcgcgctgatccgggataccggcgccgatcttgaggtggtgccgggcgaatatgccaatgcgctggccctggcgcaggcgcatgaggccgccaccggcgcgatgcagatccatgcctatgacgcgcccgcgaccgttgccgggcagggcacctgctttgccgaatgggatgcgcaggggctagaggccgatacggtggtgatcgcggtcggcggtggcggtctggtcgccggggcgctggcctggtggcagggtgcgcgcaaggtggtcgcggtcgagccggaaacctcctgcgcgctgaatgccgcgctgaccaacggtgggccggtcgatgtcgaggtgtcgggcatcgccgccaatgcgctgggcgcgcggcggatcggcgagatctgtttcggtctggcgcaggggggtgcccggtcggttctggttccggacgcggcgattgccgcggcccagcgcgcgctctgggccgagcgccgggttctggtcgagcccgcgggtgcaaccgcgctggcggcgctgatgtgcggcgcctatcgtcccgagccggacgagcgggtggcggtactggtttgcggtggcaatatcgccccggatccctttgccgggtga

SEQ ID NO: 53520 - protein, 306 aa, Silicibacter pomeroyi DSS-3
MDWKADIAAAADRIAGHVQVTPVMETRGFGLSDPLSLKLEQMQHTGSFKARGAFNTLLSSDVPAAGVVAASGGNHGAAVAYAARALGHRAKIFVPEMAGPAKIALIRDTGADLEVVPGEYANALALAQAHEAATGAMQIHAYDAPATVAGQGTCFAEWDAQGLEADTVVIAVGGGGLVAGALAWWQGARKVVAVEPETSCALNAALTNGGPVDVEVSGIAANALGARRIGEICFGLAQGGARSVLVPDAAIAAAQRALWAERRVLVEPAGATALAALMCGAYRPEPDERVAVLVCGGNIAPDPFAG

SEQ ID NO: 53521 - DNA, 969 bp, Bacillus clausii KSM-K16
  CDS (1)..(969)
atggacacgattcctgtcaaagcggtatggcaagcacgcaaacggctttttccttatctgccaaaaacgcccctcgtttatagcgctcccttatcgggtcatttccgaacgcctgtttggttgaaattagaaacattacagccgagcggctcatttaagctccgcggggcgatgaacgtgctcttgtctatgtcagctgagtcaagacaaaaaggcgttgctgctttttccacgggaaaccatggccttgcggtcgcctatgccgccaaacaggctaaaacgcaggcgacgatttttgtatcggaagcagtaccgactgctaagcaagctgcacttcaagccagcggggcaacgctaactgtgacagggcgcagccaagatgaagcaggagccgcctgtatccgccattgccagcaaacagggcagacgctcgtccctccatttgacgacgacaggattatcgctggccaaggcacactcgctttagagctgctagacgatttgcctgaacttgaaacggtgatcgctggattatcaggaggagggttgcttagcggtattgggctagtaatgaaacataccgatccgacgattcaagttgccggggcaagcatcgtcaacggagccgctatggaagccagtttggcagcgggccatccagtagaagtagccgaacagccgactgtggccgatagccttcttggcggaatcgctctggacaaccgttggacgtttaaggcggtgcaacgttatgtcgacacccgtgtacaagttccagaagaagacattgccaaggcgatggcgtatttatatgagcatcaccatttaatcgtggaaggagcagctgccataggagcagccgcactgttaaataatagcattcgccctaaagggcgtaccgctgttgtcattactggcgccagcattcacccaaaagagcatcaccgcattattcgcccttacctctag

SEQ ID NO: 53522 - protein, 322 aa, Bacillus clausii KSM-K16
MDTIPVKAVWQARKRLFPYLPKTPLVYSAPLSGHFRTPVWLKLETLQPSGSFKLRGAMNVLLSMSAESRQKGVAAFSTGNHGLAVAYAAKQAKTQATIFVSEAVPTAKQAALQASGATLTVTGRSQDEAGAACIRHCQQTGQTLVPPFDDDRIIAGQGTLALELLDDLPELETVIAGLSGGGLLSGIGLVMKHTDPTIQVAGASIVNGAAMEASLAAGHPVEVAEQPTVADSLLGGIALDNRWTFKAVQRYVDTRVQVPEEDIAKAMAYLYEHHHLIVEGAAAIGAAALLNNSIRPKGRTAVVITGASIHPKEHHRIIRPYL

SEQ ID NO: 53523 - DNA, 1245 bp, Bacillus clausii KSM-K16
  CDS (1)..(1245)
atgaccacgcatttacaggatattattcgagcaaatcaacaaattaaagatgtcgtgacgcatacacctttgcaaaaagatcaggttttgtctgaacgatatgattgcacagtttatttaaaacgagaagacatgcaagttgtcagatcttttaaaattcgcggcgcctattaccaaatttcttctctttcaaaagaagaacttgccgctggggttgtatgcgcaagcgctggaaaccatgcacaaggggttgcctactcatgccgcgctttaaaagtcaaaggtgttattttcatgccgactaccacgccaaagcaaaaagtcgcacaagtgaaattttttggcagggactatgtggacgttagattaattggcgatacgtttgatgattcttatgcggacgccattcaatactgcgaagagcaggaaatgacgttcatccacccatttaaccaagacaaagtgattgctgggcaaggaacagtcgggcttgaaattatgaatgacattgaggaaacgccagactttgtgttttcatcaatcggcggtggtgggcttattagtgggatggcaacgtatataaaaagcgttagcccgtctacgaaaatgattggctgtgaaccagccggtgctgcatcgatgacagaatcaattaagcaaggcaacgttgttgagttagacgaaatcgataaatttgtcgatggggcagctgtgaagaaagtcggcgacaaaacatttgaaatttgcaaagagctgctagatgacattattgttgttccagaaggaaaaatttgcacaacgattttaaacctttacaatgagaatgcgctagtcgctgaaccggcaggggctatgcctattgctgctcttgatttgtatacggaacaaattaagggaaaagtcgttgtctgtattgttagtggcggcaacaacgacatcgggcgcatggaggaaatccgggaacgttcgctcatttatgaaggattgcagcattactttatcgttgaatttccacagcgagctggggcgctacgtgagtttattaccgatgtgctcggcccggaagacgacattactcgctttgaatatacaaagaaaaacaataaatcgaacggtccagtattaattgggattgaactgaaatgcagcaaagattatgatgggttaatcgaaagaatggaaaagattggatttgcctataatgaagtcaacaaggatgaaaatttgttttctttgctgatttga

SEQ ID NO: 53524 - protein, 414 aa, Bacillus clausii KSM-K16
MTTHLQDIIRANQQIKDVVTHTPLQKDQVLSERYDCTVYLKREDMQVVRSFKIRGAYYQISSLSKEELAAGVVCASAGNHAQGVAYSCRALKVKGVIFMPTTTPKQKVAQVKFFGRDYVDVRLIGDTFDDSYADAIQYCEEQEMTFIHPFNQDKVIAGQGTVGLEIMNDIEETPDFVFSSIGGGGLISGMATYIKSVSPSTKMIGCEPAGAASMTESIKQGNVVELDEIDKFVDGAAVKKVGDKTFEICKELLDDIIVVPEGKICTTILNLYNENALVAEPAGAMPIAALDLYTEQIKGKVVVCIVSGGNNDIGRMEEIRERSLIYEGLQHYFIVEFPQRAGALREFITDVLGPEDDITRFEYTKKNNKSNGPVLIGIELKCSKDYDGLIERMEKIGFAYNEVNKDENLFSLLI

SEQ ID NO: 53525 - DNA, 1071 bp, Bacillus clausii KSM-K16
  CDS (1)..(1071)
atggctgcttgggcaggacttttaaaagaatacggctcgtatttgccgattacggaaaacacgccggcattgacgcttggcgagggcaatacgcctttaattaaactcgaacatttatcagaagagtggggcgtagagctttatgtgaagtatgaaggggcaaacccgactggctcgtttaaagacagaggaatggttgttgctgtcgcaaaagcaaaagaagaaggggcgcaggcgcttatttgcgcctcaacaggcaatacgtctgcggcagcttccgcctacggggcccgcgcggggcttcgttcaattgtcgtcattccaaaaggcaaaacggcacttgggaaagtagcccaagcggcgatgtacggagcagaaatcattgaaattgaaggaaactttgaccgcgctcttgcgctcgtaagagaattatgtgaaacggagccaattgcccttgtcaactcggtcaacccatataggctccacggccaaaagacagcagcttttgaaatttgtgatgcgctaggggctgctccagatgtattggcgatccctgtcggaaatgccggaaacatctctgcttattggatgggctttaaagaatacgatgagttgcaccaaacgggccggccgcgtatgcatggatttgaagcggaaggggcggcagcgattgtgaagcaacatgtcattgagcacccagagacgattgccactgccattcgcatcggcaatccggcgagttggaaattggctgtacaagctgcgaatgagtcaaaaggcgaaatcgacttagtgacggacgaagaaattgtcgaggcgtaccgggaaatagcgaaaaaagaaggcatatttgctgaaccaggttcatgtgcatcattggctggcttaaaaaaacacattcaagcagggaaagtagcaaagggctccaaaattgtcgccgttctaactggcaatggcttgaaggacccgacaacagctatagatctttccaatgtgcaaacgacaacggttgaagattcaaaaacagcgttggccgattacttaatggccacaaagccggcggtcaagtaa

SEQ ID NO: 53526 - protein, 356 aa, Bacillus clausii KSM-K16
MAAWAGLLKEYGSYLPITENTPALTLGEGNTPLIKLEHLSEEWGVELYVKYEGANPTGSFKDRGMVVAVAKAKEEGAQALICASTGNTSAAASAYGARAGLRSIVVIPKGKTALGKVAQAAMYGAEIIEIEGNFDRALALVRELCETEPIALVNSVNPYRLHGQKTAAFEICDALGAAPDVLAIPVGNAGNISAYWMGFKEYDELHQTGRPRMHGFEAEGAAAIVKQHVIEHPETIATAIRIGNPASWKLAVQAANESKGEIDLVTDEEIVEAYREIAKKEGIFAEPGSCASLAGLKKHIQAGKVAKGSKIVAVLTGNGLKDPTTAIDLSNVQTTTVEDSKTALADYLMATKPAVK

SEQ ID NO: 53527 - DNA, 978 bp, Rhodobacter sphaeroides 2.4.1
  CDS (1)..(978)
atgagcgacatcgcgatgatcgaggctgcagcggcccggcttgcgggccatgcccggcggacgccgcttctctcctcgccctttctcgacgagatcgcggggcggcgggtgctggtgaaggccgagtgcctgcagcacacgggctcgttcaagttccgcggcggctggtcggcgctctcggcgctggagccggcccggcgcgcgcagggcgtgatggcctattcctcgggcaaccatgcgcagggcgtggcgctggccgcggcccgccacggcgcgcccgccgtgatcgtcatgcccgccgatgcgccgcagctgaagatcgagaacacccgcgcgctcggcgccgaggtggtgctctacgaccgcgcgaccgaggaccgcgatgcgatcggcgcgcggctggccgacgagcggggtctcaccctgatccgccccttcgacgagcccctcgtgatcgccggtcagggcacgaccgggctcgagatcgccgagcaggcggccgaggagggcgtgacctctgccgatgtcctcacctgctgcggcggcggcgggctcaccgcgggcatcgcgctggcgctcgaggcgcgcgcgcccggcctccgggtccgcccggtcgagccggtggggttcgacgatacggcacgcagcctcgccgccggcgagatccggtcgaacgcggcgctctcgggctcgatctgcgatgcgatcgtgacgccccagccgggccggatcacctttccgatcctcgcgcggctctgcgggccgggcctcgccgtcaccgacgcggaggcgctccgcgccatggcgctggccttcctgcggctcaagatcgtgctcgagcccggcggggcggtggcgctggccgcggcgctcttccggcccgacgcgctcgagggcgacgccgtgatctgcaccgcctcgggcggcaatgtggatccgcccctctttgcccgcgccctcgcggaggccgccgactga

SEQ ID NO: 53528 - protein, 325 aa, Rhodobacter sphaeroides 2.4.1
MSDIAMIEAAAARLAGHARRTPLLSSPFLDEIAGRRVLVKAECLQHTGSFKFRGGWSALSALEPARRAQGVMAYSSGNHAQGVALAAARHGAPAVIVMPADAPQLKIENTRALGAEVVLYDRATEDRDAIGARLADERGLTLIRPFDEPLVIAGQGTTGLEIAEQAAEEGVTSADVLTCCGGGGLTAGIALALEARAPGLRVRPVEPVGFDDTARSLAAGEIRSNAALSGSICDAIVTPQPGRITFPILARLCGPGLAVTDAEALRAMALAFLRLKIVLEPGGAVALAAALFRPDALEGDAVICTASGGNVDPPLFARALAEAAD

SEQ ID NO: 53529 - DNA, 1053 bp, Xylella fastidiosa Dixon
  CDS (1)..(1053)
atggatatacctgatgtaggtcacaccgttgtcaagcaatccaatgcaagtaacgtcaataccgtgagtgtggccgatgtgttggctgcacaagcccgcttacgtcgttatctaatgcctaccccaattcactatgccgagcgtttcggagtgatgctgaagttagaaaatctgcaacgcaccggatcctataaagtgcgcggcgcactgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcacagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttactattggaagaacacctgatcgccgaaggggcaggcgcactggcattggccgctggccgccgcgtttcaggtaagcgcaagtgtgcagtggtctccggaggtaatattgacgctgcagtactggccaaactgttgtcagaagtaagaccacggccaccacgcaaaccacgcagacgtagtgcagatcgccccaacaattccggcaatttaccgctcccttttaactga

SEQ ID NO: 53530 - protein, 350 aa, Xylella fastidiosa Dixon
MDIPDVGHTVVKQSNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLLLEEHLIAEGAGALALAAGRRVSGKRKCAVVSGGNIDAAVLAKLLSEVRPRPPRKPRRRSADRPNNSGNLPLPFN

SEQ ID NO: 53531 - DNA, 1266 bp, Leuconostoc mesenteroides subsp. mesenteroides ATCC 8293
  CDS (1)..(1266)
atgacgactgagggaaagctaacggctgaagaaatagatgaggcgcatcgagtcttgtcaaaggtagtaacgcatacgccattggcatatgatgactatctatcaaaaaaatatagagctaatgtgtatcttaaacgagaagatatgcaacgggttcgttcgttcaaaattcgtggtgcctactacaatatcattaaggcagagaaagaaaaactcaataatggggttgttgctgcttcagctggaaaccacgcgcaaggcgtagccgatacatgtcataatttaaagatacaagcaactatttttatgccagtcattacaccaaatcaaaaagtagaagcggttaaacgttttggtggtcaatatgttacggtaatcctagtcggtgatacctttgacgaagcacaaagtgcagcgtttgaatacactgaaaaacataatatgttctttgtagcaccatttgatgatcggcgtaccatggctgggcaaggcacggtggcggttgaggtatttgaagatgctgtagagcaaaatattaatgttgattatttgattgcttctgttggtggtggcggtttaatcggtggtctgtcgacctattctaaaaaggtatcaccacaaaccacagtagtaggtgtcgaaccagaaacggcacagtcaatgaaagcggcttttcaagctcaaaaacctaccaccgtcgagaatatcgatcactttgttgatggtgctgccgttgcgcgtgtcagtcagtttacctataatcaagcacagcagtatgttgacaaactgctggctatccctgaaggaaaggttgctcaagcagtattagacttgtacacttatgaggcgatagttgccgaaccagctggagcgatgcctatcgctagtttggattttatggccagtgatatcgtagggaaaaacgtcgttctagttgtttctggtggaaacaatgatatcggccgtatgcaagaaatggaacaaaaggcattaatgtataagggtcgccaacagttttacttagttgagtttccgcaacgacccggggcattacggcaatttgtaaatgatgttttaggaccaaacgacgatattactcgttttgaatatactaaaaaaataaactctgaaacaggctctgtcatggttggtattctgctggatcctgttacgaaagtagatgacttaacagcccgtttagcagctttttttccaaaatatatcaatttgcaagaaaatactgtgcttttcaatatgttagtttag

SEQ ID NO: 53532 - protein, 421 aa, Leuconostoc mesenteroides subsp. mesenteroides ATCC 8293
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVITPNQKVEAVKRFGGQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKAAFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFPQRPGALRQFVNDVLGPNDDITRFEYTKKINSETGSVMVGILLDPVTKVDDLTARLAAFFPKYINLQENTVLFNMLV

SEQ ID NO: 53533 - DNA, 1515 bp, Azotobacter vinelandii
  CDS (1)..(1515)
atgctcgaacagtacgtcaagaagatccttacctcgcgcgtctacgacgtcgccgtcgaaactcccctgcagcctgcccgccagctctccgaacgtctcggcaaccagatcctgctcaagcgcgaggatctgcagccggtgttctccttcaagatccgcggcgcctacaacaaggcggcccggctgagcgaggccgagctggcgcgcggcgtggtcaccgcctcggccggcaaccatgcccagggcgtggccctggcggccaggcacctgggcatcaaggcggtcatcgtgatgccgaggaccaccccggagatcaaggtccaggcggtgcgcgcgcgcggcgccaaggtggtgctgcatggcgacgcctttcccgatgcgctggcccattcgctgaagctggtcgaggagaagggctacgtctacatccacccctacgacgatcccgacgtgatcgccgggcagggcacggtggccatggagattctccgccagcagccgggccggctggacgccgtgttcgtgccggtcggcggcggcggactgatcgcgggtatcgccgcctatgtgaaatacctgcgtcccgaggtccgggtgatcggtgtcgaaccggaggactccaactgcctgcagatggccatggccgccggcgagcgggtggtgctgccgcaggtcgggctgttcgccgacggggtggcggtggcgcagatcggcgcctgcaccttcgacatctgccgccatcacgtggacgaggtggtcactgtcagtaccgacgagatctgcgcggcgatcaaggacatctacgacgacacccgctcgatcaccgagccggccggtgccctggcggtggccgggatcaagcgctacgtcgagcgcgaaggggcgagcgggcagaccctggtggccatcgattccggtgccaacatcaacttcgaccgcctgcgccatgtggccgagcgctccgaactgggcgagaagcgcgaggcgatcatcgccgtgaccatccccgagcagccgggcagcttcaaggcgttctgccaggccatcggcaagcggcagatcaccgagttcaactaccgctacaaccgcccggaccatgcgcacatcttcgtcggcgtgcaaacccacccggagaacgatccgcgcgagcaactggtggccagcctgcgcgagcagggctttcccgtactcgacctgaccgacgacgagatggccaagctgcatatccgccacatggtcggcggccatgcggcgggcgtcagcgacgaggtggtgttgcgcttcgagtttcccgagcggcccggcgcgttgttcaacttcctcagcaagctcggcggacgctggaacatctcgatgttccactaccgcaaccatggcgccgccgacggccgcgtggtggccggcctgcaggtgccggcgggcgagcgccacctgttgccggcggctttggacgccatcggctatccgtactgggacgaaaccgacaacccggcctaccggttgttcctcggctga

SEQ ID NO: 53534 - protein, 504 aa, Azotobacter vinelandii
MLEQYVKKILTSRVYDVAVETPLQPARQLSERLGNQILLKREDLQPVFSFKIRGAYNKAARLSEAELARGVVTASAGNHAQGVALAARHLGIKAVIVMPRTTPEIKVQAVRARGAKVVLHGDAFPDALAHSLKLVEEKGYVYIHPYDDPDVIAGQGTVAMEILRQQPGRLDAVFVPVGGGGLIAGIAAYVKYLRPEVRVIGVEPEDSNCLQMAMAAGERVVLPQVGLFADGVAVAQIGACTFDICRHHVDEVVTVSTDEICAAIKDIYDDTRSITEPAGALAVAGIKRYVEREGASGQTLVAIDSGANINFDRLRHVAERSELGEKREAIIAVTIPEQPGSFKAFCQAIGKRQITEFNYRYNRPDHAHIFVGVQTHPENDPREQLVASLREQGFPVLDLTDDEMAKLHIRHMVGGHAAGVSDEVVLRFEFPERPGALFNFLSKLGGRWNISMFHYRNHGAADGRVVAGLQVPAGERHLLPAALDAIGYPYWDETDNPAYRLFLG

SEQ ID NO: 53535 - DNA, 1110 bp, Desulfitobacterium hafniense DCB-2
  CDS (1)..(1110)
ctggctgggacggagatctacctcaagctggaaaatctgcagaagaccggttcctttaaagttcggggggctatgaataaagccttgaagctttctgaagaggagaagaaaaaaggaatcctggccgcttccgccggcaatcatgcccaaggggtagccatggcggctgcccgtatcggtattcccgccacgattgtcatgccggaaaatgcccccctagccaaagtgtccgctacggaagggtacggagcccaggtcattctgtccggagcggtttttgatgatgcttatcagaaggcagtagagatccaaaaggaaacaggagccacgtttatccatgcttttgatgatctggaagttatggccgggcagggaaccatcggcttggaagtttttgaggagctgcctgaagtggatacggttcttgtccctatcgggggaggagggctgatcgcagggattgctgtggctttgaaatccctgaagccttccgtgcgcgtgatcggtgtccaagcggccggagcggcaagcatggctcacgcgctgagcataggcaggcccgagccattagggcaggccagtactttggcagatggcattgcggtgaaaagggcaggtgatctaaccttcgcagcagtccgccattatgtggatgagatggtgacggttgaagaagaagagattagtcaagctattctcctgttgatggagcgcaccaaaacccttgctgaaggagccggggcggttgccgtagcggcggcgcttcagggtaagctggatcttaaggagcagaaaacggttctcatcctgagcgggggaaatattgacgtgaatttcctggcccagattatcgaacggggactgaggcgttccgggcgtaccatggcctgccagcttcttttgccggatcaacccggcaacttagaaaaggtgatcgagcttatagcccaggaacgggccaatatcatcaacgtcgaacactcccgctatgatttagccgttcctctgcgttcagcccgtgttcatatgctgctggaaacccaaagttttgaacatcaaaagcgcattattcagcgtttagaaggtgccggatatcccctgacccgttaa

SEQ ID NO: 53536 - protein, 369 aa, Desulfitobacterium hafniense DCB-2
MAGTEIYLKLENLQKTGSFKVRGAMNKALKLSEEEKKKGILAASAGNHAQGVAMAAARIGIPATIVMPENAPLAKVSATEGYGAQVILSGAVFDDAYQKAVEIQKETGATFIHAFDDLEVMAGQGTIGLEVFEELPEVDTVLVPIGGGGLIAGIAVALKSLKPSVRVIGVQAAGAASMAHALSIGRPEPLGQASTLADGIAVKRAGDLTFAAVRHYVDEMVTVEEEEISQAILLLMERTKTLAEGAGAVAVAAALQGKLDLKEQKTVLILSGGNIDVNFLAQIIERGLRRSGRTMACQLLLPDQPGNLEKVIELIAQERANIINVEHSRYDLAVPLRSARVHMLLETQSFEHQKRIIQRLEGAGYPLTR

SEQ ID NO: 53537 - DNA, 975 bp, Nostoc punctiforme PCC 73102
  CDS (1)..(975)
atgtcacaaactaattccgttactataactgatgtgcaagcagcacaagagcgaattttgggaattgcccatcgcacgccggtgctaacttctagaatggttaacgatcgcaccaatagccaagtattctttaaatgcgagaactttcaacgcaccggggcatttaaatttagaggggcgtataatgccttagcgcaactatcggtagcccaaaaacaaacaggcgttatcacctattcatcaggaaatcatgctcaagcgatcgctctagctggtaaactcctcaatatccctaccactattgtcatgcctgatgatgcacccactgtcaaacaaactgcgactcgtggttatggtgcagagataattttatacaatcgccaggaggcaaaccgagaagaattagcccaaagtttagcaagcgatcgctctttgacactcatccctccttacgatcatccccatgtagtcgccggacagggaacaactgctttagaactgattcaagaagttggtgaattggacttgctattagtttgttgtggcggtggcggattactttcaggatgtgcgatcgcagctaaagcacttttacccaattgtaaagtaatcggggtagaaccagcacttgccgacgatgctacccgctcttttcacaccaaaaccctgcaaactgtcaagaatcctgataccatcgccgatggtgcgcggactcctagccttggtaaaattactttccccttagtgctgcattacgtcgatgatatggtgacggtatctgaagaagcaattcttcgcaccatgtttttcttgtgggaacgtctgaaaattgtagttgaacccaccggagtacttgcagccgcagccttactcgaaggtgtggtgacagcaccagagtcgaggattggtgtgatcatcagtggtggaaatgtcgatttggcgcaagttggtaaattgttttctggtggattttga

SEQ ID NO: 53538 - protein, 324 aa, Nostoc punctiforme PCC 73102
MSQTNSVTITDVQAAQERILGIAHRTPVLTSRMVNDRTNSQVFFKCENFQRTGAFKFRGAYNALAQLSVAQKQTGVITYSSGNHAQAIALAGKLLNIPTTIVMPDDAPTVKQTATRGYGAEIILYNRQEANREELAQSLASDRSLTLIPPYDHPHVVAGQGTTALELIQEVGELDLLLVCCGGGGLLSGCAIAAKALLPNCKVIGVEPALADDATRSFHTKTLQTVKNPDTIADGARTPSLGKITFPLVLHYVDDMVTVSEEAILRTMFFLWERLKIVVEPTGVLAAAALLEGVVTAPESRIGVIISGGNVDLAQVGKLFSGGF

SEQ ID NO: 53539 - DNA, 1338 bp, Nostoc punctiforme PCC 73102
  CDS (1)..(1338)
atggtgcaactaccaccagatatcttggcacagggtgtaattgcagcgtctgcgggcaaccatgctcaaggagtcgcccttgcagccaatcgtttgggaaccaaagcaattatcgtcatgccaataaccacacctcaagtcaaggtggacgcagtgagaatgaggggcggagcagtcgtgttacatggaaacacctacgacgatgcttatagctatgcccgtgaattagaagtggaaaaaggtttgacctttattcatccctttgacgatcctcatgtaattgctggacagggaaccattgggatggaaattttacggcaatatcagcaacccatccatgcaatttttgttgcaattggaggtggtggattgatttctgggattggggcttatgtaaaacgattgcgtcctgaaatcaagattattggagttgaaccagtagatgctgatgcgatgtctcaatcgctcaaagccgggcatcgggtgcgtttgtctcaagtggggttatttgctgatggtgtggcggtgcgagaagtaggtgaagaaaccttccgtttatgtcagcagtatgtagatgaaatcattttggtggatactgatgatacttgtgctgcgattaaagacgtgtttgaggatacgcgatcaattttagagccagccggtgcattagcgatcgcagctgccaaagcctacgcagaacgagaacaaattgagggacaaaccttaattgccgtagcctgtggtgcaaacatgaattttgatcgtctccgattcgtggcagaacgggcccagttaggcgaacgtcgggaagcaatctttgcagtcacaattcctgaagaacggggaagtattcgccagttttgtgaatgtattggcaaccgtaatcttactgagtttaattatcgcattgctgatgaaaaaacagcccatatttttgtaggtgtgcaaattcaaaaccgtgctgatgctgcaaagatggtagaaacctttgaagctcaaggatttgaaactcttgatttaacagacgacgaactaactaaattacatctgcggcacatggtgggtgggcactctcccctggctcaaaatgaattactctaccgttttgagtttcccgaacgtcccggcgcattgatgaaatttgtgacttctatgagtccagcctggaatattagtctttttcactaccgtaacaacggtgcagactacggacgaattgtagttggtatccaagttcctcctcacgagatggaagagtggcaagcttttctcgataacttgggctatcgctattgggatgaaaacaagaatcccgcatacaagctgtttttgggatag

SEQ ID NO: 53540 - protein, 445 aa, Nostoc punctiforme PCC 73102
MVQLPPDILAQGVIAASAGNHAQGVALAANRLGTKAIIVMPITTPQVKVDAVRMRGGAVVLHGNTYDDAYSYARELEVEKGLTFIHPFDDPHVIAGQGTIGMEILRQYQQPIHAIFVAIGGGGLISGIGAYVKRLRPEIKIIGVEPVDADAMSQSLKAGHRVRLSQVGLFADGVAVREVGEETFRLCQQYVDEIILVDTDDTCAAIKDVFEDTRSILEPAGALAIAAAKAYAEREQIEGQTLIAVACGANMNFDRLRFVAERAQLGERREAIFAVTIPEERGSIRQFCECIGNRNLTEFNYRIADEKTAHIFVGVQIQNRADAAKMVETFEAQGFETLDLTDDELTKLHLRHMVGGHSPLAQNELLYRFEFPERPGALMKFVTSMSPAWNISLFHYRNNGADYGRIVVGIQVPPHEMEEWQAFLDNLGYRYWDENKNPAYKLFLG

SEQ ID NO: 53541 - DNA, 1266 bp, Bifidobacterium longum DJO10A
  CDS (1)..(1266)
atggaacaaaaggatgttttgaaggcgctgcaacgtgatcatgcagccgaactgaagctggccgccgaacgactcaaaggcactgcccgccacacggagatcattccttctccggtgctgagcgagatgaccggccatgagattctcctgaagccggaaaacctgcaggtcaccggatccttcaagatccgcggtgcctataacaagattgcttcgctcaccgaagagcagatcgctcacggcatcgtcaccgcgtctgccggcaaccatgcccagggtgtggcctatgcggcccgcgagcgtggagccaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactga

SEQ ID NO: 53542 - protein, 421 aa, Bifidobacterium longum DJO10A
MEQKDVLKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 53543 - DNA, 1548 bp, Haemophilus somnus 2336
  CDS (1)..(1548)
atggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgacagcgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgccatctgttaggtgatcgtcctgttaccgaatttaactatcgttatgctgataaagaacaagcctgtatttttgttggggttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgaacatgatgaaattcggttcaatggtcatttagaagaacttgcttatacttatcaagatgtaacggacagccccgcttacaaatatttcttagcttga

SEQ ID NO: 53544 - protein, 515 aa, Haemophilus somnus 2336
MVKNMISNLTEQPSGAEYLKAILSSKIYELAQVTPLQPMLKLSERLSNTVLVKREDRQLVHSFKLRGAYAMIAGLSQPQKNAGVITASAGNHAQGVALSAKNLGLNALIVMPQNTPRIKVDAVRGYGGEVLLYGANFDEAKAKAIELSESKSMTFIPPFDHPAVIAGQGSLAMELLQQNSHIDRIFVPVGGGGLAAGVAVLIKQLMPDIKVIAVESKDSACLHAALKVGQPVDLERVGLFADGVAVKRIGNETFRVCQQYIDDVVLVDSDEVCAAMKDMFENVRAIAEPSGAVSLAGLKKYVKEHNIQGETLVNILSGANLNFHTLRYVSERCEIGEKHEAIFAVTIPEEKGSFLRFCHLLGDRPVTEFNYRYADKEQACIFVGVRISSEKEKLEIIQQLEQNDYKVMDLSDDEIAKTHIRYMIGGRTTSNSKERLYSFEFPEQKGALLKFLMMLGTHWNISLFHYRAYGADYGNVLAGFQLDEHDEIRFNGHLEELAYTYQDVTDSPAYKYFLA

SEQ ID NO: 53545 - DNA, 1527 bp, Actinobacillus pleuropneumoniae serovar 1 str. 4074
  CDS (1)..(1527)
atgagcaatccgacaattcaatccggcaccgattatctgcgtgtaatcctcagttcaaatatctacgacctagcgcaagttaccccgcttcaaaaaatggaaaaactctccgagcgtttaggcaaccaaattcttatcaaacgtgaagatcgccaaccggtacatagtttcaaactgcgtggtgcatttgccatgatttccaatctctcggcaagccaaaaagccgccggtgtgattaccgcttcggcaggaaaccacgctcaaggcgtggcgctttcatcaaaacacttaggacttcgtgcattaatcgttatgccgcaaaatacgccggcaattaaagtcgatgcggtgcgagggttcggtggagaagtcttactattcggtgccaattttgatgaggcgaaagccaaagcattagaactttctacagagttggggatgactttcgtaccaccgttcgatcacccgatggtgattgccggacaaggtacgatcggtatggaattagtacagcaaagatcagatttagattatgtattcgtaccggtcggtggcggcggtttagccgccggtattgcggtattaattaagcaaattctaccgaatgtaaaagtgattggcgttgaatcaaaagattccgcttgtttgcaacatgccttaaaagtcggcaaaccggataacttggaacgtgtcggcttattcgcagacggtattgcggtaaaaagaatcggtgacgaaactttccgtttatgccagaaatatatcgatgaagtggtactggtcgataacgatcagatttgtgcggcaatgaaagatatttttgaaaacgtacgtgcgattgcagaaccttccggtgcgacttcattagccggcttaaaaaaatatgtgaaagaacaccaacttgaaggcaaaaacttagcttgtgtgctttccggtgcgaacttgaatttccatacgttacgttatgtttcggaacgttgtgaaatcggcgaaaaacatgaagccttattagcggtaaccattccggaacaaaaaggcagttttttaaaattctgtgagattttaggcaatagagcggtcaccgaatttaactatcgacacgcagatgacaataaagcgtgtattttcgttggggttcgtattaccggcaatgcggaaaaagcggatatcattcgcgatctacaacagcacaattataacgtagtggatctttcggatgatgacattgctaaaacgcatattcgttatatggtcggcggtcgtcctaacagcattagcagcgagcaactttatagcttcgaattccctgagcaaaaaggcgcattattaaaattcctccaaacactgaccgattgggatatttcattattccattatcgtgcgcacggggcggattacggcgatattctcgctgcgtttactttagatgaaagcgataagcatcgccttaatcagcatttggatcaacttggttatcgttatcaaaacgtaacggatagccttgcatatcaatactttttaaaataa

SEQ ID NO: 53546 - protein, 508 aa, Actinobacillus pleuropneumoniae serovar 1 str. 4074
MSNPTIQSGTDYLRVILSSNIYDLAQVTPLQKMEKLSERLGNQILIKREDRQPVHSFKLRGAFAMISNLSASQKAAGVITASAGNHAQGVALSSKHLGLRALIVMPQNTPAIKVDAVRGFGGEVLLFGANFDEAKAKALELSTELGMTFVPPFDHPMVIAGQGTIGMELVQQRSDLDYVFVPVGGGGLAAGIAVLIKQILPNVKVIGVESKDSACLQHALKVGKPDNLERVGLFADGIAVKRIGDETFRLCQKYIDEVVLVDNDQICAAMKDIFENVRAIAEPSGATSLAGLKKYVKEHQLEGKNLACVLSGANLNFHTLRYVSERCEIGEKHEALLAVTIPEQKGSFLKFCEILGNRAVTEFNYRHADDNKACIFVGVRITGNAEKADIIRDLQQHNYNVVDLSDDDIAKTHIRYMVGGRPNSISSEQLYSFEFPEQKGALLKFLQTLTDWDISLFHYRAHGADYGDILAAFTLDESDKHRLNQHLDQLGYRYQNVTDSLAYQYFLK

SEQ ID NO: 53547 - DNA, 846 bp, Pseudomonas aeruginosa UCBPP-PA14
  CDS (1)..(846)
atgaagcacgagaaccacctgccggtgggggccttcaagctgcgcggcggcctggtgtatttccaccacctggcgcaccagggtgagcggccggccggcgtgatcagcgccacccgcggcaaccacggccagtcggtggccttctcggcgagccgctacggcatccagccgatcatcgtcgtgccgcacggcaacagccgcgagaagaacgcggcgatgcgcagcctcggcgcggagctgatcgagcatggcgaggacttccaggcctcccgcgaatacgccgccgagcgcgcccggcacgaaggcctgcacctgattccggcgttccatccctggctggtggccggggtcgccagctacagcctggagttgttcgccgcgctggccgaccttgacgaagtctacgtgccgatcggtatgggttcgggcatctgcggcctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgcctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactga

SEQ ID NO: 53548 - protein, 281 aa, Pseudomonas aeruginosa UCBPP-PA14
MKHENHLPVGAFKLRGGLVYFHHLAHQGERPAGVISATRGNHGQSVAFSASRYGIQPIIVVPHGNSREKNAAMRSLGAELIEHGEDFQASREYAAERARHEGLHLIPAFHPWLVAGVASYSLELFAALADLDEVYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 53549 - DNA, 1515 bp, Pseudomonas aeruginosa UCBPP-PA14
  CDS (1)..(1515)
atgctcgaacaatacgtcaagaagatcctcacctcgcgcgtctatgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaaccacgcccagggcctggccctggcggccaagcggcaggggatcagggcggtcatcgtgatgcccaagaccacccccgagatcaaggtccaggcggtgcgcgcccacggcgccaaggcggtgctgcacggcgacgccttccccgaggcgctggcccacgcgctgaagctggtcgacgagaagggctacaccttcgtccatccctacgacgatccggacaccatcgccggccagggcaccgtggccatggagatcctccgccagcagcccggccgcctcgatgcgatcttcgtcccggtgggcggtggcggattggtcgccggcatcgccgcctacgtcaagtacctgcgtccggagatcaaggtgatcggcgtcgagccggacgagtcgaactgcctgcaggcggccatggccgccggcgagcgggtgatgctgggccaggtcgggctgttcgccgacggcgtggcggtggcgcagatcggccagcacaccttcgacatctgcaaggaccacgtcgacgaagtgatcaccgtcagcaccgacgagatctgtgcggcgatcaaggacatctacgacgacacccgctcgatcaccgagccggccggcgcgctggcggtggccgggatcaagaagtacgttgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacatccgccacatggttggcggccatgcagtgaaagtcagcgacgagatggtgttccgcttcgaattccccgagcggcccggcgcgctgttcaacttcctcaccaagctcggcgggcgctggaacatctcgatgttccactaccgcaaccatggcgcggccgacggccgggtggtggccgggttgcaggtgccggaagacgagcgccacctgatcccgcagaccctggaggcgatcggctatccgtactgggacgagaccgccaacccggcctaccagctgttcctcggctga

SEQ ID NO: 53550 - protein, 504 aa, Pseudomonas aeruginosa UCBPP-PA14
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVMLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 53551 - DNA, 981 bp, Psychrobacter sp. 273-4
  CDS (1)..(981)
atgatcacaaatgatgatggattagtgattccaacccttgatgatatgctagaggcgcatgagcgcattaagccatatatccatcgcactcctgttttgacctctcgctttttaaacgaaatggcaggctgtgagatgttctttaaatgtgagaactttcaaaaagcgggtgcctttaaagtacgcggcgcatcaaacgcggtgtttggtctgtctgacgaagccgcaaaaaatggcgtctgtacacacagctcaggcaaccatgccctgtctttatcttatgcagcgggtcgacgcggcgtaccgtgtcatgtggtgatgccgcatagtgcaccagaagctaaaaaagcggcagtccgtggctatggtggtatcattactgagtgtgagccatcaaccacttcacgcgaagaagtgtttgccagagttcaagcagaaacaggcggcgactttgtccatccgtacaatgatccacgcgtaatcgccggacaagcgacttgctcacgtgaatttctagagcaaatggaagagatcggtcaaaaacctgacatggttgtggcacctattggtggtggtggcatgatttcaggcacttgcttaacgctatcgaacctagcccctgatgtcaaaatttatgctgcagagccagtaaatgctgatgatgctgcacgctcatttaaagccggttatattatcgctgatgatgcacccgatactatcgctgatggcttaaaagtaccgcttaaagatttgacctggcattttgtcagtaattatgtgactgacattttgactgcgactgaagaagaaatcgttgaagcgatgaagctgacttggactcatatgaaaattatcatcgagccaagttgtgcagtaccgcttgctgtcatcttgaagaacaaagacgtttttgcaggtaaaaaggttggcgtcatcatcactggtggtaacgttgatctagacaaattgccttggaactaa

SEQ ID NO: 53552 - protein, 326 aa, Psychrobacter sp. 273-4
MITNDDGLVIPTLDDMLEAHERIKPYIHRTPVLTSRFLNEMAGCEMFFKCENFQKAGAFKVRGASNAVFGLSDEAAKNGVCTHSSGNHALSLSYAAGRRGVPCHVVMPHSAPEAKKAAVRGYGGIITECEPSTTSREEVFARVQAETGGDFVHPYNDPRVIAGQATCSREFLEQMEEIGQKPDMVVAPIGGGGMISGTCLTLSNLAPDVKIYAAEPVNADDAARSFKAGYIIADDAPDTIADGLKVPLKDLTWHFVSNYVTDILTATEEEIVEAMKLTWTHMKIIIEPSCAVPLAVILKNKDVFAGKKVGVIITGGNVDLDKLPWN

SEQ ID NO: 53553 - DNA, 1554 bp, Psychrobacter sp. 273-4
  CDS (1)..(1554)
atgctgtcacattgggtacgagccatcttacaagccaccgtctatgacgttgctattcaaacaccacttgaagcggcacccaagctgacccaacgttttgctaatgacattcgttttaaacgtgaagacctgcaaccggtaaaatcctttaaattgcgcggcgcttataaccgcatcagccaattgaatgatgagcaaaaagcacgcggcgtgatttgcgcatcggcgggtaaccatgcccaaggcgttgcctactctgcccgtaaacttgcactgaacaatattattgttatgccaaccactacccctgatatcaaagtagatgccgtcagagcgcttggcggcaatgtcgacttgtatggtgacagttttgatgaagccaatcgctatgccattgatcgcgctgagcgtgaaggtctgacttttataccaccatacgatgacgagctggtaattgccggacaaggtacgattggacttgagctcacccagcaatggcgtaatatggattacgtttttgtagcagttggtggtggcggtctgatttctggtgtcgctgcatttttgggtgaagttgccccgcatgtcaaagtcatcgctgtagaagccgaccaatcagcatcactaaaagccgcgcttgaagccaatgagcgagtcaaacttgagcaagtaggactgttcgtcgatggtgtggcagttgcccaaatcggtgaattgccttttgatattgtccgtatgcagaagagcgataaatccggtcctgtcgtcgaacctcaagtcgttacttgtaccaatgatgaagtctgcgctgccatcaaagatatttttgaagagaaccgcagtatcgttgagcctgcaggggcgcttcctgtcgctggtatgaaaaaataccttgaggctcatgacctacaaggcaaaaactgcgtcgccattatctgcggtgccaatatgaattttgatcgcttgcgctacatcgctgagcgtactgagattggtgagaaaaaagaagctgtctttggcgtgaccatccctgaacagactggcgctttcttaagcttctgccgtagtctgcacggtcgtaatatcactgagttcaattaccgtgctgatagtaaaaaatcaccggactctatggaacctgcagcaatcttcgtcggtattgcattaaaagaaggcgataaagagcgtcaaactattcgtacacaattggcagctgatggctatacagcacatgacttgaccgatgacgatgtcgccaaatcacatatccgctatctaattggtggtcatgcgcatgttgaaaatgaacagttattgcaagtcactttcccagaacgtcccggcgctttattgacctttttagaaaaattgggtaacgattttaatatcacacttttccattatcgcaatcatggcgctgctgaaggtcgcgtattggtcggtttgcaagcttctgaaagcaactcgcgccaactacaagatgccttgctggatatcggttacgactgcaccatgctcaatgacaatattggttatcagttatttttaaagtag

SEQ ID NO: 53554 - protein, 517 aa, Psychrobacter sp. 273-4
MLSHWVRAILQATVYDVAIQTPLEAAPKLTQRFANDIRFKREDLQPVKSFKLRGAYNRISQLNDEQKARGVICASAGNHAQGVAYSARKLALNNIIVMPTTTPDIKVDAVRALGGNVDLYGDSFDEANRYAIDRAEREGLTFIPPYDDELVIAGQGTIGLELTQQWRNMDYVFVAVGGGGLISGVAAFLGEVAPHVKVIAVEADQSASLKAALEANERVKLEQVGLFVDGVAVAQIGELPFDIVRMQKSDKSGPVVEPQVVTCTNDEVCAAIKDIFEENRSIVEPAGALPVAGMKKYLEAHDLQGKNCVAIICGANMNFDRLRYIAERTEIGEKKEAVFGVTIPEQTGAFLSFCRSLHGRNITEFNYRADSKKSPDSMEPAAIFVGIALKEGDKERQTIRTQLAADGYTAHDLTDDDVAKSHIRYLIGGHAHVENEQLLQVTFPERPGALLTFLEKLGNDFNITLFHYRNHGAAEGRVLVGLQASESNSRQLQDALLDIGYDCTMLNDNIGYQLFLK

SEQ ID NO: 53555 - DNA, 1533 bp, Dechloromonas aromatica RCB
  CDS (1)..(1533)
atgcacccggattatctcgaaaaagttctcaacgcacaggtttacgacgtggcgatcgaaacgccgctcgacctggccagcaacctttccgcccgggtcggcaacaagattatcctgaagcgcgaagacatgcagcctgtcttttccttcaagctgcgtggcgcctacaacaagattgccagcctgtcggccgaaaagctgaagcgcggtgtcatctgtgcctcggccggcaaccacgcccaaggggtcgccctgtcggccagcaaactgggttgccgggcggtcatcgtcatgccgacctcgacgccgggcatcaagattaacgccgttaaatcgcggggcggcgaagtggtgctgcatggcgactccttcgacgaagcatacgcccatgcggtcgaactggaaaaaaccgaaaagctgaccttcgttcatcccttcgacgatccggaggtgatcgccggacagggcacggtcgccatggaaatcctgcgccagcattcgcgccacaacggcccgatcaccgccgtcttctgtgccatcggcggcggcgggctggctgctggcgtggccgcctacatcaagcgcctgcgtccggaaatcaaggtgatcggtgtcgaaaccttcgacgccgacgccatgaagcagtcgctggccgccggcaagcgcgttcgcgtcgatcaggtcgggttgttctccgacggcaccgccgtcaagctggtcggcgaagaaaccttccggctgtgcaaggaatacctggacgaggtcatcctggtcgacaccgatgccatctgtgccgccatcaaggatgttttcgaggatacccgctcgattctggaaccggccggggcgctggccgtcgccggcgccaaggaatatgcccgtcagcacaaactgaaggacaagaacctgatcgccatcacctccggcgccaacatgaatttcgaccgcctgcgcttcgttgccgagcgggccgaattcggcgaacagcgtgaagccgtcttcgcggtcacgctgcccgagaagccgggtgcctacaagaaattccttgggctgatcggtcaccgcaatgtgaccgaattcaactaccgcttccacaccgccagcgaagctcacgtcttcgtcggcgttcaggtggccgaccgcaaggaatcgctgaagctggtcgacagcctgcagaaacacggttacccgacgctcgacctgaccgatgacgaaatggccaagaaccatatccgtcacatggtcggcggccatgccccggcggtttgcgaaaagggcatgcgcgagttgctctatcgcttcgaattcccggaaaagccgggcgccctgatgaacttcctgacccagatgagcgccggctggaacatcagcctgttccactaccgcaaccatggcgccgactacggtcgcgtcctggtcggcatgcaggtaccgccggacgacatggggaaattcaaggaattcctgaccaatctcggctacgcccactgggacgagagccaaaacccggcatacaagctgttcctgggttaa

SEQ ID NO: 53556 - protein, 510 aa, Dechloromonas aromatica RCB
MHPDYLEKVLNAQVYDVAIETPLDLASNLSARVGNKIILKREDMQPVFSFKLRGAYNKIASLSAEKLKRGVICASAGNHAQGVALSASKLGCRAVIVMPTSTPGIKINAVKSRGGEVVLHGDSFDEAYAHAVELEKTEKLTFVHPFDDPEVIAGQGTVAMEILRQHSRHNGPITAVFCAIGGGGLAAGVAAYIKRLRPEIKVIGVETFDADAMKQSLAAGKRVRVDQVGLFSDGTAVKLVGEETFRLCKEYLDEVILVDTDAICAAIKDVFEDTRSILEPAGALAVAGAKEYARQHKLKDKNLIAITSGANMNFDRLRFVAERAEFGEQREAVFAVTLPEKPGAYKKFLGLIGHRNVTEFNYRFHTASEAHVFVGVQVADRKESLKLVDSLQKHGYPTLDLTDDEMAKNHIRHMVGGHAPAVCEKGMRELLYRFEFPEKPGALMNFLTQMSAGWNISLFHYRNHGADYGRVLVGMQVPPDDMGKFKEFLTNLGYAHWDESQNPAYKLFLG

SEQ ID NO: 53557 - DNA, 1542 bp, Haemophilus influenzae R2866
  CDS (1)..(1542)
atgaaaaacttactcaccaatcctcaaccttctcaatcagattatatcaatgccattgttaaacttggttcgcgcgtatatgaagctgcgcaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcggcgaaacaattaggcttaaaagcactgatcgtcatgccacaaaacaccccaagcattaaagtggatgcagtgcgtggttttggtggcgaggtgttgttgcacggtgctaatttcgatgaagccaaagcaaaagccatcgagctttcaaaagaaaaaaacatgacatttattccaccattcgatcatccattagtgatcgctggacaaggcacgttagcgatggaaatgttacaacaagtggcagatttggattatgtgtttgtacaagttggcggtggcggtttagctgcaggtgtagcaatgttgcttaagcaatttatgccagaaattaaaatcatcggtgtagaatcaaaggattctgcatgcttaaaagcggctcttgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccatacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgagcttgcgtgtttgttggagtaagaacgacaaatgagcaagaaaaagcagatattattgcagacctcactaaaaatggttttgatgttgaggatatgtctgatgatgatattgcgaaaacgcacgttcgctatttaatgggaggtcgagcagccaatgataatgaacgcttatatacgttcgaattcccagagcaaaaaggtgcgttattgaaatttttagaaaccttgcaaaatcgttggaatatttcattattccattatcgtgcccacggtgcggactatggaaatatccttgctggtttccaaattgaagaacacgaacaagcagaatttgaacagacacttgcccaactcaattatgtttttgaagatgtaacagaaagcaaatcttatcgttatttcttacgttaa

SEQ ID NO: 53558 - protein, 513 aa, Haemophilus influenzae R2866
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAMLLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRAANDNERLYTFEFPEQKGALLKFLETLQNRWNISLFHYRAHGADYGNILAGFQIEEHEQAEFEQTLAQLNYVFEDVTESKSYRYFLR

SEQ ID NO: 53559 - DNA, 1512 bp, Anabaena variabilis ATCC 29413
  CDS (1)..(1512)
atgctttgcgactacctggtacaaattctgactgctcgtgtgtatgatgttgcccaggaatcacctctggagtatgcccccaatctttcagccagactgaataataaactattgctgaagcgggaagatatgcagtctgtgttttcctttaagctgcggggtgcttacaacaagatggtgaatctaacacccgatttactagcacagggtgtaattgctgcttctgcggggaatcatgcccaaggtgtggcactaggtgcaaaacagctagggacaagagcaattattgttatgccggttactactccccaggtgaaagtagatgcagttaaagcacgagggggagaggtggtattgcatggggatacctatgatgatgcctatgcctacgcgcggcagttggaggcagagaaaggtttaacatttattcacccctttgatgatcctcatgtaattgcgggacagggaactattgggatggaaattctcagacaatatcagcaacctattcatgcgatttttgttgctattggcgggggcggtttgatttcggggattgcggcttatgtaaaacggttacgtccagaaattaaaattattggggttgagccggttgatgctgatgcaatgaaccaatccttgcaagctggtaaacgggtgcgattgtcacaggtgggtttatttgctgatggggtggcagtgcgggaggtgggagaagaaactttccgactgtgtcaggaatatgtagacgaaattattttggtggatacagatgacacctgtgcagccattaaggatgtatttgaagatacccgatctattttagaaccagcaggggcattggcgatcgctggcgctaaggcttatgtagaacgagaacaaatccaaggacaaactttagtcgctgtcgcctgcggtgcaaatatgaattttgaccgtttgcgctttgttgcagaacgggcagaatttggtgaacgccgcgaagctatctttgcagtgacaattcctgaaacacctgggagtctgcggaagttttgcgaatgtattggtagacgcaatttgacagagtttaactatcgcattgctgatgaaaaaattgcccatatttttattgggatgcagattcaaaaccgtgctgacaaaatccacatggtggagacttttgcagaatgtggttttgaaatccttgatttaacagatgatgaactgacaaaactgcatttgcgccacatggtgggcggacactctcccctagcccataatgaattactctaccgttttgaatttccggaacgtcctggagcgttaatgaaattcgttgcttccatgagtcccaattggaatatcagtatgttccactaccgcaacaatggctcagactacgggcgcatcgtggtaggaatgcaggttccaccgcaggaaatggaagaatggcaagcatttcttgattccctcggctaccagtattgggatgaaagccagaacccagcctataagttatttttgggataa

SEQ ID NO: 53560 - protein, 503 aa, Anabaena variabilis ATCC 29413
MLCDYLVQILTARVYDVAQESPLEYAPNLSARLNNKLLLKREDMQSVFSFKLRGAYNKMVNLTPDLLAQGVIAASAGNHAQGVALGAKQLGTRAIIVMPVTTPQVKVDAVKARGGEVVLHGDTYDDAYAYARQLEAEKGLTFIHPFDDPHVIAGQGTIGMEILRQYQQPIHAIFVAIGGGGLISGIAAYVKRLRPEIKIIGVEPVDADAMNQSLQAGKRVRLSQVGLFADGVAVREVGEETFRLCQEYVDEIILVDTDDTCAAIKDVFEDTRSILEPAGALAIAGAKAYVEREQIQGQTLVAVACGANMNFDRLRFVAERAEFGERREAIFAVTIPETPGSLRKFCECIGRRNLTEFNYRIADEKIAHIFIGMQIQNRADKIHMVETFAECGFEILDLTDDELTKLHLRHMVGGHSPLAHNELLYRFEFPERPGALMKFVASMSPNWNISMFHYRNNGSDYGRIVVGMQVPPQEMEEWQAFLDSLGYQYWDESQNPAYKLFLG

SEQ ID NO: 53561 - DNA, 969 bp, Ralstonia eutropha JMP134
  CDS (1)..(969)
atgaccgaactgaagctaccaacgtacgcagacgtccaggaagccgcgaagcgccttgatggcgttgccaaccgcacgccggtcaatacgtcgcgcacgctcaatgacatgctcggcgccgaagtcttcttcaaatgcgagaatttccagcgcatgggagcgttcaagttccgcggcgcgtacaacgcgctggcgaagttcagccccgcgcaacgccgagcgggtgtggtggcgttctcgtcgggcaaccatgcgcagggcatcgcgctgtcggcaaagctgcttggcattcccgccaccatcgtgatgccgcacgacgcaccggcggccaaggtcgcggccaccaaaggctacggcgccaatgtcgtgatctacgaccgctacaccgaggaccgcgaagccatcgggcgccgcctggccgacgaacacggcttcacgctgattccgccctatgaccatccggacgtcctgtccggccagggcacggcagcaaaggaactgttcgaggcggtcggcgcactggacgtcgtgctgacgccgctcggcggcggtggattgctatccggcaccgcactgaccacacgcgcgctgtcgccgcaatgcaagctctttggcgtcgaacctgaagccggcaacgatggacagcagtcgttccgcagcggcgccatcgtgcacatcgataccccgaagaccattgcggacggcgcccagacgcagcatctcgggcagtacacgttcagcatcatcaagcgggacgtcgacgatatcctgacggcgtccgatgcccaactggtggaagcgatgaagttctacgccacacgcatgaagatgatcgtcgagcccacgggctgcctaggcctggccgccgccatgcatatgaaggatgcgctgaagggcaagcgcatcggcatcatcatcagcggcggcaatatcgacctggagcggttctgcgaactggtgtcggcgtaa

SEQ ID NO: 53562 - protein, 322 aa, Ralstonia eutropha JMP134
MTELKLPTYADVQEAAKRLDGVANRTPVNTSRTLNDMLGAEVFFKCENFQRMGAFKFRGAYNALAKFSPAQRRAGVVAFSSGNHAQGIALSAKLLGIPATIVMPHDAPAAKVAATKGYGANVVIYDRYTEDREAIGRRLADEHGFTLIPPYDHPDVLSGQGTAAKELFEAVGALDVVLTPLGGGGLLSGTALTTRALSPQCKLFGVEPEAGNDGQQSFRSGAIVHIDTPKTIADGAQTQHLGQYTFSIIKRDVDDILTASDAQLVEAMKFYATRMKMIVEPTGCLGLAAAMHMKDALKGKRIGIIISGGNIDLERFCELVSA

SEQ ID NO: 53563 - DNA, 1512 bp, Methylobacillus flagellatus KT
  CDS (1)..(1512)
atgaaaatcgactacctgcagaaaatcaaatccgcccgcgtctacgacgtggcaagcaagaccccgctggacctgcttcccaacctttcccgacgcattcacaaccaggtgctgctcaaacgcgaggatatgcagcctgtattttcattcaagcttcgcggtgcttacaacaagatggcgcagctttccgccgaggcactgtcgcgcggggtcattaccgcatccgccggcaatcatgcacagggtgtagccctggccgccaagaacgcaggctgtcgcgcagtcatcgtcatgcccgtcaccacccctgacatcaaggtggatgcggtacgtcaccgcggcgctgaggtagtgttggctggagagtcctacacggactcctataaccacgccatgaagctcatggaagagcagcaacttacctttgttcatccgttcgacgatcccgacgtgatcgcgggacaaggcaccgtggcaatggaaatactgcaggacaaccccggcccaatcgaggcaattttctgccctgtcggcggcggcggcttgatcgcgggcgtggccgcctacatcaaggcagtacgtccggagatcaaggtcatcggtgtcgaggtcaatgatgccaacgcgatgacggtttcgctgcaacagggcgcgcgcgtcaccttggaccaggtcggcctgtttgcagacggcaaggccgtcaaattggtcggagaagagactttccgcctgtgccaacaatacgtcgacgagatgatcctggtcgacaacgacgccatctgcgcagctatcaaggatgtcttcgaggatacgcgcgccatcctcgagccgacgggcgcgctctccctggctggactcaaggcctatgcccagcagcacaatctgcaaggcaaaaccctgatagcggtcgcctcgggcgccaacatgagcttcgaccgcctgcgctttgtcgccgagcgcgcagaaattggcgaaaagcgcgaagctgtgctggccgtgaccatcccggaaaccccgggctcattcaagaagttctgccggctgatcggccaccgcaacattaccgagttcaattaccgctatgctgacgccacggccgcacatatctacgtcgggatcgccatccaggaccccagtgaatccggcaagctagtcacccggctgcaggagcacggactgccggcgttggacctgagtgagaatgaagtagcaaagctgcacctgcgccacctggttggcggccatgcgccgcaggcaaagcacgagcaggtctaccgcttcgaattcccggaaaaacccggtgcattgatgaattttctcgacaatatgcggcatgactggaacatcagcctgtttcattatcgtaaccatggtgcggatttcggcagggtcctggtcggcatgcaggtaccgcctggggaagagcaggagtttaccgatttcctgcagaatctgggctatccgtactgggacgaaagcaacaacccggcttataagctattcctcggctaa

SEQ ID NO: 53564 - protein, 503 aa, Methylobacillus flagellatus KT
MKIDYLQKIKSARVYDVASKTPLDLLPNLSRRIHNQVLLKREDMQPVFSFKLRGAYNKMAQLSAEALSRGVITASAGNHAQGVALAAKNAGCRAVIVMPVTTPDIKVDAVRHRGAEVVLAGESYTDSYNHAMKLMEEQQLTFVHPFDDPDVIAGQGTVAMEILQDNPGPIEAIFCPVGGGGLIAGVAAYIKAVRPEIKVIGVEVNDANAMTVSLQQGARVTLDQVGLFADGKAVKLVGEETFRLCQQYVDEMILVDNDAICAAIKDVFEDTRAILEPTGALSLAGLKAYAQQHNLQGKTLIAVASGANMSFDRLRFVAERAEIGEKREAVLAVTIPETPGSFKKFCRLIGHRNITEFNYRYADATAAHIYVGIAIQDPSESGKLVTRLQEHGLPALDLSENEVAKLHLRHLVGGHAPQAKHEQVYRFEFPEKPGALMNFLDNMRHDWNISLFHYRNHGADFGRVLVGMQVPPGEEQEFTDFLQNLGYPYWDESNNPAYKLFLG

SEQ ID NO: 53565 - DNA, 948 bp, Mesorhizobium sp. BNC1
  CDS (1)..(948)
atgtacattccgaatcttaccgacgtgcttgcagcacgagccttaatcgaaccccatattcatcgcacacccgttctcacatcgacattcatcaatggacttgctggcgccgaactcttcttcaagtgcgagaaccttcagaaggctggggccttcaaagcgcgcggcgcgtcgaacgcggtgtttggcctgaacgacgagcaggcgaagaagggtgttgcaacgcactcgtccggcaatcacggaacctgcctttcctatgcagctggtcggcgcggcattccctgcaccgtagtgatgccgcgcaccgcgccgcaggctaagaaggatgcggtccggggctacggcggtcgtgtcgtcgaatgcgagccgtcaacctcgtcgcgtgaggccgtctttgccgaggttgttgccgagaccggcgcggaattcgtgcatccctataacgaccatcgtgtcatcgccgggcaggcgacctgctctgccgagttgatcgagcaggtcgacggtctcgacgccgtggtcgcgccgattggcggcggcggcatggtgtcgggaagctgcctgacgctctccaatctcgcgcccggcgtaaagatctacgccgccgagcccgagcaggccaacgacgcctaccgtagcttcaaggccggccgcatcatcgccgacgacgcgccagaaacggtcgccgacggcctgaaagtgccgctgaaggaactgacctggcatttcgtgaagaacaacgtcaccgacatcctgacggcttccgagcaggagatcgtcgacgcgatgaagctgatctggaagcgcatgaagatcgtgatggagccgtccagcgccgtgccgctggcgaccatcctgaagaaccctgatgtctttgccggcaagcgcgtcggcgtgatcgtgacgggcggcaatgtggatctcgacaaattaccgtggaactga

SEQ ID NO: 53566 - protein, 315 aa, Mesorhizobium sp. BNC1
MYIPNLTDVLAARALIEPHIHRTPVLTSTFINGLAGAELFFKCENLQKAGAFKARGASNAVFGLNDEQAKKGVATHSSGNHGTCLSYAAGRRGIPCTVVMPRTAPQAKKDAVRGYGGRVVECEPSTSSREAVFAEVVAETGAEFVHPYNDHRVIAGQATCSAELIEQVDGLDAVVAPIGGGGMVSGSCLTLSNLAPGVKIYAAEPEQANDAYRSFKAGRIIADDAPETVADGLKVPLKELTWHFVKNNVTDILTASEQEIVDAMKLIWKRMKIVMEPSSAVPLATILKNPDVFAGKRVGVIVTGGNVDLDKLPWN

SEQ ID NO: 53567 - DNA, 975 bp, Mesorhizobium sp. BNC1
  CDS (1)..(975)
atgaccgacattgccatgatcgaagccgcgcggagccgcattgcgggccatgtgcgccgcacaccgctccttttctcgccgtttttcgatgaaatcgcaggccggcgtgttcttgtgaagaccgagtccctccagcttaccggctctttcaagttccgcggtgcctggtcggcgatatcggcgctggacccggacgttcgggcgaaaggcgtgctcgccttttcctcgggcaatcatgcgcaggccgtggcgctcgccgcgcgaatgcacggcatttcttccaccatagtcatgccatccgacgcgccgaagctgaagatcgaaaacacgcgggcctatggcgccgaagtggtgctctatgatcgcgcgaaagaggaccgtgatgcgatcggtgtgaagctcgcggctgaaaggggacttacgctgatcaagcccttcgacgagccgctggtcattgccggccagggcactacgggccttgagctcgcggagcaggccaaggaaataggcgtggaaagggcggaagtgcttgtcccctgtggaggtggcggactcacctccggcatagcgctagcgcttgaagcgcgtgcaccccggctcaaggcgcgcccctgcgagcccgcgggcttcgacgatgtgacccgctccctcgcttccgggaagatcgagcgcaatgcggcgatgtcaggttcgatctgcgacgccattgtcacgccgtcgcccggcacgatcacctttccgatcctgaggcggctttgcggcgcgggaatcgtcgtaaccgacgaggaggcgctgcatgcaatggcgctggccttcacccggctcaagatcgtggtagagccgggcggcgcggtggcgctcgcggcagcactgttccatggcgaggagatggcggctgacacggttatcgcggttgcctccggcggcaatgtggatgccgccttgtttcggcaggctctggaacggtttgcttag

SEQ ID NO: 53568 - protein, 324 aa, Mesorhizobium sp. BNC1
MTDIAMIEAARSRIAGHVRRTPLLFSPFFDEIAGRRVLVKTESLQLTGSFKFRGAWSAISALDPDVRAKGVLAFSSGNHAQAVALAARMHGISSTIVMPSDAPKLKIENTRAYGAEVVLYDRAKEDRDAIGVKLAAERGLTLIKPFDEPLVIAGQGTTGLELAEQAKEIGVERAEVLVPCGGGGLTSGIALALEARAPRLKARPCEPAGFDDVTRSLASGKIERNAAMSGSICDAIVTPSPGTITFPILRRLCGAGIVVTDEEALHAMALAFTRLKIVVEPGGAVALAAALFHGEEMAADTVIAVASGGNVDAALFRQALERFA

SEQ ID NO: 53569 - DNA, 1560 bp, Ralstonia eutropha JMP134
  CDS (1)..(1560)
atgaaccgcaagcccgcctcctccaaacccgactatctcaggaagatcctgaccgccaaagtgtatgacgtggcgcaggagaccgagctgacctttgcgcacaacctgtcggcgcgcaccggcaactcggtgtggttcaagcgcgaggacacgcagccggtgttctcgttcaagctgcgcggcgcatacaacaagatggcgtcgctgacgcaggaagaactcaggcgcggcgtgatcgcggcgtcggccggcaaccacgcgcagggcgtggcgctgtccgcggcgcgcctgcagtgccgcgcaatcatcgccatgccggtgaccacgccgcaggtgaagatcgacgcggtgcgcgagcgcggcggcaagtgggtggagatcgtgctgcacggcgattcgtacagcgacgcctacaaccatgcggcaatcctggagaagaagcacaagctgaccttcatccacccgttcgacgatccggaagtgatcgccggccagggcaccatcgcaatggaaatcctgcgccagcatccgggcccgatccacgcgatcttcgtcgcgatcggtggcggcgggctgatttcaggcatcgcgtcttacatcaaggccgtgcgccccgagatcaaggtgatcggcgtgcagaccgtggattccgacgcgatgaagcgctcggtcgaagcgggcaagcgcattgaactcaaggacgtgggcctgttctctgacggcaccgcggtgaagctggtcggcaaggaaacattccgcatcacgcgcgaactcgtcgatgagatcgtgctggtggacaccgatgcgatctgcgcgggagtgaaggatgtgttccaggacacgcgcagcattcttgaacccgcgggcgcgctggccgtcgccggcctcaagctgtatgccgagcgcgagaagctcaagggcgagcatctggtcgcgatcgcctgcggcgccaacatgaacttcgaccgcctgcgcttcgtcgccgagcgcgccgaagtgggcgaggcacgcgaaggcgtgttcgccgtcactattcccgaagagcgcggtagcttcaagcgcttctgcgaactggtgggcacgcgcagcgtcactgaattcaactaccgcattgccgaccggaacatcgcgcatatcttcgtcggcgtacagatcgccagccgcgccgagaacgacaagatcgccgcgaacttccgccgccatggcttcgacacgctggacctgtccaacgacgaactcgccaagcagcacatccgctacatggttggcggcgtctcgccgctcgcgcacgacgaactgctgtatcgcttcgaattccccgagcgcccgggcgcgctgatgaagttcctgtcgagcatgagcccgaactggaacatcagcctgttccattaccgcaaccagggtggcgacacgtccaacatcctggtcggcatccaggtgccgaagaacgaaaagcgcgctttccgcgcattcctttcgacgctgggttacgtacactgggacgagaccgagaacccggtctacaagctgttcctctccgaccgcggaaatcaagcatga

SEQ ID NO: 53570 - protein, 519 aa, Ralstonia eutropha JMP134
MNRKPASSKPDYLRKILTAKVYDVAQETELTFAHNLSARTGNSVWFKREDTQPVFSFKLRGAYNKMASLTQEELRRGVIAASAGNHAQGVALSAARLQCRAIIAMPVTTPQVKIDAVRERGGKWVEIVLHGDSYSDAYNHAAILEKKHKLTFIHPFDDPEVIAGQGTIAMEILRQHPGPIHAIFVAIGGGGLISGIASYIKAVRPEIKVIGVQTVDSDAMKRSVEAGKRIELKDVGLFSDGTAVKLVGKETFRITRELVDEIVLVDTDAICAGVKDVFQDTRSILEPAGALAVAGLKLYAEREKLKGEHLVAIACGANMNFDRLRFVAERAEVGEAREGVFAVTIPEERGSFKRFCELVGTRSVTEFNYRIADRNIAHIFVGVQIASRAENDKIAANFRRHGFDTLDLSNDELAKQHIRYMVGGVSPLAHDELLYRFEFPERPGALMKFLSSMSPNWNISLFHYRNQGGDTSNILVGIQVPKNEKRAFRAFLSTLGYVHWDETENPVYKLFLSDRGNQA

SEQ ID NO: 53571 - DNA, 990 bp, Anabaena variabilis ATCC 29413
  CDS (1)..(990)
atgtcacagcttaactctgtaaccataactgatgtgcaagcagcacagcagcgtcttgctggtattgcccatcgcacacctgtgttaacttccacaactgtcaacgatcgcactcataatcaagtctttttcaagtgcgaaaattttcaacgcacaggtgcttttaaatttaggggtgcttataatgccttagcacagctatcaccaacacaaaaacacaaaggtgtgttgactttttcttcggggaatcatggacaagcgatcgcccttgcaggtaagttactcaacatccccacaactattgtcatgcctgatgatgcacctgtcatcaagcaaacagctaccaaaagttacggtgcagaggtaattttatataatcgccaagaaacgaatcgggaagaattggcgcaaaatctcgcaagcgatcgcggtttaaccctaattcctccatacgatcatccccatgtgatcgctggacaaggtacagccgcattagaactggtgcaagaaattggtgaactggatttgctgttagtttgttgtggcggtgggggattaatttccggttgtgcgatcgccgctaaagctcttttacctaatttgcgcgtaattggtgtagaaccaacactcgctgatgatgctactcgttccttttacaccaaaaccctacaaaccgtcacaaatccccatactatcgctgatggtgcgcggactcctagcctgggacagatgacatttcccctagttttacaatacgttgatgatatggtgacggtatcagaggaagcaattattcgcaccatgtttttcctctgggaacggctgaaaatagtcgttgaacccacaggcgtattagccgcagccgctttacttgaaaatgtagtcaaagcacaaggaaagagaattggtgtgattatcagtggtggaaatgtagatttaaccaaagttgctagttatgtcaacttagtcactgaatttggtaatgggtga

SEQ ID NO: 53572 - protein, 329 aa, Anabaena variabilis ATCC 29413
MSQLNSVTITDVQAAQQRLAGIAHRTPVLTSTTVNDRTHNQVFFKCENFQRTGAFKFRGAYNALAQLSPTQKHKGVLTFSSGNHGQAIALAGKLLNIPTTIVMPDDAPVIKQTATKSYGAEVILYNRQETNREELAQNLASDRGLTLIPPYDHPHVIAGQGTAALELVQEIGELDLLLVCCGGGGLISGCAIAAKALLPNLRVIGVEPTLADDATRSFYTKTLQTVTNPHTIADGARTPSLGQMTFPLVLQYVDDMVTVSEEAIIRTMFFLWERLKIVVEPTGVLAAAALLENVVKAQGKRIGVIISGGNVDLTKVASYVNLVTEFGNG

SEQ ID NO: 53573 - DNA, 1524 bp, Burkholderia cepacia R18194
  CDS (1)..(1524)
atggcatcccacgattacctgaagaaaatcctcaccgcgcgcgtctacgacgtcgcgatcgagacggaactcgaatccgcccgcatcctgtcggcccggctgcgcaatgcggtctacctgaagcgcgaggacaaccagccggtgttctcgttcaagctgcgcggcgcatacaacaagatggcgcacattccggcggacgcgctcgcgcgcggcgtgattacggcatcggccggcaaccacgcgcagggtgtcgcgttctcggcggcccggatgggcgtgaaggccgtgatcgtcgtgcccgtcacgacgccgcaggtgaaggtcgatgcggtgcgtgcgcacggcggcccgagcgtcgaggtgatccaggccggcgagtcgtacagcgatgcgtatgcacacgcggtcaaggtgcaggaagagcgcggcctcacgttcgtccacccgttcgacgatccgtacgtgatcgccggccagggcacgatcgcgatggaaatcctgcgccagcaccagggcccgatccatgcgatcttcgtgccgatcggcggcggcgggctcgcgtccggcgtcgcggcctacgtgaaggcggtgcgcccggagatcaaggtgatcggcgtgcaagccgaagattcgtgcgcgatggcgcagtcgctggaagccggcaggcgtgtcgagctgagcgaggtcggcctgttcgcggacggtaccgccgtgaagctggtcggcgaggaaaccttccgcctctgcagcgaatacctcgacggcgtcgtgacggtgaacaccgacgcgctgtgcgcggcgatcaaggacgtcttccaggacacgcgcagcgtgctcgagccgtccggcgcgctcgcggtcgcgggcgcgaagctctacgcggaacgcgaaggcatcgagaaccagacgctcgtcgcggtcacgtccggcgcgaacatgaacttcgaccggatgcgcttcgtcgccgagcgcgcggaagtgggtgaagcgcgcgaagccgtgttcgcggtcacgatccccgaagagcgcggcagcttcaagcgcttctgctcgctcgtcggcgatcgcaacgtcaccgagttcaactaccggatcgccgatgcgcaggccgcgcacatcttcgtcggcgtgcagatcaagcgtcgcggcgaatcggccgagatcgccgcgaacttcgaatcgcacggcttcaagagcgtcgacctgacgcacgacgagctgtcgaaggaacacatccgctacatggtgggcggccgctcgccgctcgcgctcgacgagcgcctgttccgcttcgaattcccggagcggccgggcgcgctgatgaagttcctgtcgtcgatggcgccggactggaacatcagcctgttccactaccgcaaccagggcgcggactacagctcgatcctcgtcgggctgcaggtgccgcaggccgatcgcgccgaattcgaacgcttcctcgcggcactcggctatccgtatgtcgaggagagcgccaacccggcttaccgcctcttcctgtcgtaa

SEQ ID NO: 53574 - protein, 507 aa, Burkholderia cepacia R18194
MASHDYLKKILTARVYDVAIETELESARILSARLRNAVYLKREDNQPVFSFKLRGAYNKMAHIPADALARGVITASAGNHAQGVAFSAARMGVKAVIVVPVTTPQVKVDAVRAHGGPSVEVIQAGESYSDAYAHAVKVQEERGLTFVHPFDDPYVIAGQGTIAMEILRQHQGPIHAIFVPIGGGGLASGVAAYVKAVRPEIKVIGVQAEDSCAMAQSLEAGRRVELSEVGLFADGTAVKLVGEETFRLCSEYLDGVVTVNTDALCAAIKDVFQDTRSVLEPSGALAVAGAKLYAEREGIENQTLVAVTSGANMNFDRMRFVAERAEVGEAREAVFAVTIPEERGSFKRFCSLVGDRNVTEFNYRIADAQAAHIFVGVQIKRRGESAEIAANFESHGFKSVDLTHDELSKEHIRYMVGGRSPLALDERLFRFEFPERPGALMKFLSSMAPDWNISLFHYRNQGADYSSILVGLQVPQADRAEFERFLAALGYPYVEESANPAYRLFLS

SEQ ID NO: 53575 - DNA, 921 bp, Burkholderia cepacia R18194
  CDS (1)..(921)
atgccgcttcatatcccgaccccttatatccgctcgcaaattgcgtcccgccggctcggcaggaccatccggctgaagctcgatgcgctgcagccgtcgggctcgttcaagctgcgcggcatcggcgccgtttgtgaagcgcggcatgcggccggcgcgcggcgcttcgtgtcgtcgtcgggcggcaatgcgggcatcgcggtcgcgtattgcggccgcgaactcggcgtgccggtgctcgtcgtcgtgccggagagcgcgtcggcccgcgcccgcgagctgatccgcgtcgagggcgcggaggtggtcgtgcacggcgcgagctgggccgaggcgaacgcgtacgcgcagtcggcactcggcgagcacgatgcgttcgtgcatccgttcgacgaccgtgtgctgtggcagggccacgcgacgatgatcgacgagatggcggcggccggcccgaagcccggcgcggtcgtgctcgcggtcggcggcggcgggctgctgtgcggcgtgctcgaagggctggcgcgcaacggctggcacgacgtgccggtagtcgccgccgaaacggagggcgccgactgctatgcgcgctcgctggcgcaggggcgtgtggtcgagttgtcggcgatcacgagcatcgcgacgtcgctcggcgcgaagcggccatgcgatgcggcggtcgaatgggccgcgcgacacgagatccatccggtcgtcgtgtccgatgccgacgcggtggccgcgtcgctgcgcttcctcgatgaacaccggatcgttgtcgagcccgcatgcggtgctgcgctggccgcactcgagcgaccggtgcccgtgcttgcatcggcgacggatatcgccgtgatcgtctgcggcggcgtgacggcaaccgtcgagcagatgcagacgttgcgcgcgacgttgcggtag

SEQ ID NO: 53576 - protein, 306 aa, Burkholderia cepacia R18194
MPLHIPTPYIRSQIASRRLGRTIRLKLDALQPSGSFKLRGIGAVCEARHAAGARRFVSSSGGNAGIAVAYCGRELGVPVLVVVPESASARARELIRVEGAEVVVHGASWAEANAYAQSALGEHDAFVHPFDDRVLWQGHATMIDEMAAAGPKPGAVVLAVGGGGLLCGVLEGLARNGWHDVPVVAAETEGADCYARSLAQGRVVELSAITSIATSLGAKRPCDAAVEWAARHEIHPVVVSDADAVAASLRFLDEHRIVVEPACGAALAALERPVPVLASATDIAVIVCGGVTATVEQMQTLRATLR

SEQ ID NO: 53577 - DNA, 1044 bp, Burkholderia cepacia R1808
  CDS (1)..(1044): n means a or g or c or t/u
atgtcgactgaatcaacgggcccggcccatacgacgatcgacggcgagccgattccgacgctcgacgaaatcgccgcgcagcatttcgcgttgtcgccctgggtcgcgcgcacgccggtattcgaacgcgccgatctgccgacgctcgaaggtacgcacgtcaacttcaagttcgagctgctgcaggcgagcggcagcttcaaggcgcgcggcgcgttcacgcacgtgctcgcgctcgacgaagcgcgcaagaacgccggcgtcacctgcgtgtcggccggcaatcatgcggcggccgtcgcatatgcggcgatgcggctcggcagcagcgccaaggtcgtgatgccccataccgcgagcccggtgcgcatcgcgcagtgccgcgcgtatcgcgcggaagtcgtgctggccggcagcgcgtcgcaggcattcgacctcgtgcggcgcgtcgaggccgaggaaggccgcttcttcatccatccgttcaacggctatcgcacgattctcggcacggcgacgctcggctacgaatgggcgacgcagacgcccgacctcgatgcggtgatcgtgccgatcggcggcggcggcctcgcggccggcatggccaccgcattgcgcctcgcgaatccgcgcgtgcacgtgtacggcgtcgagcccgaaggcgccgacgcgatgtgccgcagcttcgcggcgaaccacacgatcaagatgggcgcgatgcagagcatcgccgattcgctgatggcgccgcacaccgaggaatacagctatcagctgtgccggcgtcacgtcgaccggatcgtcacggtgtcggacgacgcgctgcgcgcggcgatgctgttcctgttctcgcatctgaagctagcggtcgagccccgcgtgcgcggccgcgctcgcggggctgctcggcccgctgcgcgaaacgctgcagggcaagcgggtcggcgtgctgctgccgggcacgaacaccgatccgnccacgctcggcatgcatctcgcgcacgcgcagatgcagcgctgaacccgctcgcgacgctcaggtag

SEQ ID NO: 53578 - protein, 347 aa, Burkholderia cepacia R1808
  misc_feature (326)..(326): Xaa can be Ala or Asp or Gly or Val
MSTESTGPAHTTIDGEPIPTLDEIAAQHFALSPWVARTPVFERADLPTLEGTHVNFKFELLQASGSFKARGAFTHVLALDEARKNAGVTCVSAGNHAAAVAYAAMRLGSSAKVVMPHTASPVRIAQCRAYRAEVVLAGSASQAFDLVRRVEAEEGRFFIHPFNGYRTILGTATLGYEWATQTPDLDAVIVPIGGGGLAAGMATALRLANPRVHVYGVEPEGADAMCRSFAANHTIKMGAMQSIADSLMAPHTEEYSYQLCRRHVDRIVTVSDDALRAAMLFLFSHLKLAVEPRVRGRARGAARPAARNAAGQAGRRAAAGHEHRSXHARHASRARADAALNPLATLR

SEQ ID NO: 53579 - DNA, 921 bp, Burkholderia cepacia R1808
  CDS (1)..(921)
atgccgctccatattcagacgccgtacctccgctcgcacaccgcctcccgccggctcggcgccgacgtctggttgaagctcgatgcgcttcagccatccggttcgttcaaattgcgcgggatcggcgcggtgtgcgcggcgcgacaggcggccggcgcgcgtcgcttcgtgtcgtcgtcgggcggcaatgcgggcatcgcggtcgcgtattgcgggcgcgaactcggcgtgccggtgctggtggtggtgcccgagaccgcgtccgtgcgcgcacgcgaactgattcgcggcgaaggggccgaggtcatcgtgcatggcgcgagctgggtcgaggccaacgcgttcgcgctggcggccgtcggcgagcacgacgcgttcgtgcacccgttcgacgatccggtgttgtggggcggccacgcgacgatcgtcgacgagatcgcggtcgccggcccgaaacccgacgcgatcgtgctcgcggtcggtggcggcgggctgctgtgcggcgtgctggaggggctctcgcgcaacggctggcacgacgtgccggtcgtcgcggtggagacggcgggcgccgactgctatgcgcgctcggtcgcgcagcggcgtccggtggaactgccggcgatcgagagcatcgcgacgtcgctcggcgcgaagcggccgtgcgacgcggcgctcgagtgggcgagccggcatccgattcatccggtcgtcgtatcggatgcgcaggcggtggccgcctcgttgcggctggtggacgagcaccggctcgtcgtcgagcccgcgtgcggcgccgcgctggctgcgctcgaacggccggtgccggtgctggccgcggcgtcgaacatcgcggtgatcgtctgcggcggcgtgacggcgaccatcgagcaactgcagtcgtggagcgctacgttgcggtga

SEQ ID NO: 53580 - protein, 306 aa, Burkholderia cepacia R1808
MPLHIQTPYLRSHTASRRLGADVWLKLDALQPSGSFKLRGIGAVCAARQAAGARRFVSSSGGNAGIAVAYCGRELGVPVLVVVPETASVRARELIRGEGAEVIVHGASWVEANAFALAAVGEHDAFVHPFDDPVLWGGHATIVDEIAVAGPKPDAIVLAVGGGGLLCGVLEGLSRNGWHDVPVVAVETAGADCYARSVAQRRPVELPAIESIATSLGAKRPCDAALEWASRHPIHPVVVSDAQAVAASLRLVDEHRLVVEPACGAALAALERPVPVLAAASNIAVIVCGGVTATIEQLQSWSATLR

SEQ ID NO: 53581 - DNA, 978 bp, Burkholderia cepacia R1808
  CDS (1)..(978)
atgaccaacccgacccttcccacctacgacgacgtcgcggccgccgccgcgcgcctgcagggccacgcgcaccgcacgcccgtgatgacgtcgagcacgctcgacgacgcgctcggcgcgcaagtgttcttcaagtgcgagaacctgcagcgcatgggtgcgttcaagttccgcggcgcgttcaacgcgctgtcgcgcttcgacgccacgcagcgccgcaacggcgtggtcaccttctcgtcgggtaaccacgcgcaggcgatcgcgctgtcggcgcgcatgctcggcatcccggcgacgatcgtgatgccgcaggacgcgccggccgcgaagatggccgccacgcgcggctacggcggcaacgtcgtgacctacgaccgctatacggaagaccgcgagcagatcggccgcgagctggcggagaagcacgggctcacgctgatcccgccgtacgaccatgcggacgtgatcgccggccagggcacggcggcgaaggagctgttcgacgaagtcgggccgctggacgcggtgttcgcgccgctcggcggcggcggcctgctgtccggcaccgcgctcgcgacgcgggcgctgtcgccgcaagcgaagctgtacggcgtcgagcccgaagccggcaacgacggccagcaatcgttccgcagcggcgcgatcgtgcacatcgacacgccgcgcacgatcgccgacggcgcgcagacgcagcatctgggcaacctcacgttccagatcctgcgacgcgacgtcgacgacatcctgacagcgaccgacgccgaactggtcgacagcatgcggttcttcgcaacccggatgaagctcatcgtcgagccgaccggctgcctgtcgctcgcggccgcacgcaagatgaaggacgaactcgcgggcaagcgcgtcggcatcgtgatcagcggcggcaacgtcgacctcgcgaacttcgccgcactggtttccagtcccgccgcatga

SEQ ID NO: 53582 - protein, 325 aa, Burkholderia cepacia R1808
MTNPTLPTYDDVAAAAARLQGHAHRTPVMTSSTLDDALGAQVFFKCENLQRMGAFKFRGAFNALSRFDATQRRNGVVTFSSGNHAQAIALSARMLGIPATIVMPQDAPAAKMAATRGYGGNVVTYDRYTEDREQIGRELAEKHGLTLIPPYDHADVIAGQGTAAKELFDEVGPLDAVFAPLGGGGLLSGTALATRALSPQAKLYGVEPEAGNDGQQSFRSGAIVHIDTPRTIADGAQTQHLGNLTFQILRRDVDDILTATDAELVDSMRFFATRMKLIVEPTGCLSLAAARKMKDELAGKRVGIVISGGNVDLANFAALVSSPAA

SEQ ID NO: 53583 - DNA, 1056 bp, Listeria monocytogenes str. 1/2a F6854
  CDS (1)..(1056)
atgtataaaggtttactagaaaaatataaagaatatctaccagtaactgataaaacgccaatgatctcacttgcggaaggaaatacaccacttattccattaccgaatttgtccaaagaacttggggttactttatacggaaaatacgaaggcttaaatccaaccggttcttttaaagatcgtggaatggttatggctgttgcaaaagcgaaagaagaaggtgccgaagcggttatttgtgcatccactgggaatacttctgctgcggctgcggcatacgcaacacgtgcgggattaaaagcgtacattgttattccagaaggcaaagtcgctctaggaaaattagcgcaagcagttatgtatggcgcagatattatctcgattcaaggtaattttgatgaagcattaaaatcggttcgtgaattagctgaaacagaagcagtaacacttgtaaattccgtgaatccatatcgtttagaaggtcaaaaaacagctgcattcgaaatctgtgagcaattaggttccgcgccagatgtacttgcaattccagtcggtaatgccgggaatatttctgcatactggaaggggtttaaagaatggaatgaggctaaagcttctggactgccgcggatgcatggttttgaagcagaaggagctgcggcgattgttcaagggaaaccaattgataacccggaaacaattgcaacagcgattcgtatcggaaacccagctagttggcggcttgcagaagcagctcgcgatgaatctggcggatacatccattctgtaacagacgacgaaattgtgaatgcgtataaaaaaattgcagcacaagatggtgtctttatcgagccgggttctgccgcttcattagctggtgtcattcaacatgtagcaaatggaacaattaaaaaaggggaaacagttgtttgtgtctttactggaaatggcttaaaagatccagatactgcgatgagtgtgcatgaaattccaatttcccatgtggatgatatcgaagcaatgcgcacacatttacgttcaggagtgaaagcttaa

SEQ ID NO: 53584 - protein, 351 aa, Listeria monocytogenes str. 1/2a F6854
MYKGLLEKYKEYLPVTDKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEAKASGLPRMHGFEAEGAAAIVQGKPIDNPETIATAIRIGNPASWRLAEAARDESGGYIHSVTDDEIVNAYKKIAAQDGVFIEPGSAASLAGVIQHVANGTIKKGETVVCVFTGNGLKDPDTAMSVHEIPISHVDDIEAMRTHLRSGVKA

SEQ ID NO: 53585 - DNA, 1581 bp, Rubrivivax gelatinosus PM1
  CDS (1)..(1581)
atggcccgcgccgcgccgcgccccgccccccgcacttccgtcgccaaacccgctctccgcaaggctggggccaagcccgactacctgcagcgcatcctgaccgcgcgggtctacgacgtggccatcgaatcggcactgcagttcgcaccgcaactgtcggagcggatgggcaaccaggtctggctcaagcgcgaggatgaacaggcggtcttcagcttcaagctgcgcggcgcctacaacaagatggcgcacctgagcccgcagcagctggggcgcggcgtgatctgcgcttccgccggcaaccacgctcagggggttgccctgtcggcccgcaagctccgctgccaagcgacggtcgtgatgccggtcaccacgccgcaactcaagatcgaggctgtgcgggcgctcggcggcaaggtcgtgttgcacggcgagagctattccgatgcctatgcccatgcactgaaactcgaacgggagcacgggcagaccttcgtgcatcctttcgacgatcccgacgtgatcgccggtcagggcaccatcgccatggagatcctgcgccagcaccaggggccgatcgacgccgtgttcgtggcagtgggcggtggcgggctgatctcgggcatcgctgcatacatcaaggcggtccggccggagatccaggtgatcggcgtccagaccaccgattccgatgcgatgctgcgttcggtgcgcgctggcaagcgcgtgacgctgcacgacgtggggctgttctccgacggcaccgccgtcaagctggtgggcgaagagacctttcgcctgacgaagcagtgggtcgacgatttcgaagtggtcgacaccgacgcggtctgcgcggcgatcaaggatgtgttccaggacacccgctcgatcctggagccggccggcgcgctgggcgtggcggccatcaaacagtacacggcacgcaccggctgcaagggcaagaccttcgtggcgatcacctgcggcgccaacatgaacttcgaccgattgcgcttcgttgccgagcgggccgaggtgggcgaggagcgcgaggcgctgttcgccgtcactatcccggaggaacggggttccttcaagcgcttctgcgagttgctcggcccgcgcagcgtcacggagttcaactaccgcatctcggacgcgcagaccgcgcaggtgttcgtgggcctgtccacgcgggaacacggcgaatcggctcgcattgccgagcggttcgagaagcagggcttcgcgacggtcgacctgacacacgacgaactggccaagacccatatccgccacatggtcggcggccgctccgagctggcccgcgaggagcgactgttccggttcgtcttcccggagcgtccgggagcgctgatgcgcttcctgacccgcatgcaccccgactggaacatcagcctgttccattaccggaatcagggtgccgattacggtcgcatccttgtcggcctgcagattccccgcggcgcgcagcgcgcactgcgagagttcctgtccacactggattacccctgcgtcgaggagaccgacaacccggtctaccagctcttcctgcgctga

SEQ ID NO: 53586 - protein, 526 aa, Rubrivivax gelatinosus PM1
MARAAPRPAPRTSVAKPALRKAGAKPDYLQRILTARVYDVAIESALQFAPQLSERMGNQVWLKREDEQAVFSFKLRGAYNKMAHLSPQQLGRGVICASAGNHAQGVALSARKLRCQATVVMPVTTPQLKIEAVRALGGKVVLHGESYSDAYAHALKLEREHGQTFVHPFDDPDVIAGQGTIAMEILRQHQGPIDAVFVAVGGGGLISGIAAYIKAVRPEIQVIGVQTTDSDAMLRSVRAGKRVTLHDVGLFSDGTAVKLVGEETFRLTKQWVDDFEVVDTDAVCAAIKDVFQDTRSILEPAGALGVAAIKQYTARTGCKGKTFVAITCGANMNFDRLRFVAERAEVGEEREALFAVTIPEERGSFKRFCELLGPRSVTEFNYRISDAQTAQVFVGLSTREHGESARIAERFEKQGFATVDLTHDELAKTHIRHMVGGRSELAREERLFRFVFPERPGALMRFLTRMHPDWNISLFHYRNQGADYGRILVGLQIPRGAQRALREFLSTLDYPCVEETDNPVYQLFLR

SEQ ID NO: 53587 - DNA, 1239 bp, Rubrivivax gelatinosus PM1
  CDS (1)..(1239)
ttgacctcagccgagtcgccggcgacggtgaccctggcggacgtcgaggccgctgcacgccggctggccggacaggtgctcgacacaccgtgtgtcgagtcgaagacgctgtccgagatcaccggcgcgcaggtcttcctgaagttcgagaacctgcagttcaccgcttccttcaaggagcgcggcgcgttgaacaagctgctggcgctggtcgccgcgcgcgacgacggcaccgccgcgttgaagggcgtgatcgccgcctccgccggcaaccatgcgcagggcgtggcgcatcacgcgcagcggctgggcctgcgcgcggtcatcgtgatgccccggcacacgccgacggtgaaggtcgagcgcacgcgcggcttcggtgccgaggtgctgctgcacggcgagagcttcgacgaggctcgcgcgcacgcgctggaggtggccgcggcgcagggcctgagcttcgtgcaccccttcgacgatccgctggtgatcgccggccagggcacgatcggcctggagatgctgcgcgcgcaaccgacgctcgacactctggtcatcgccgtcggcggcggcgggctgatctccggcatcgcgaccgtcgcccgggcgctgaagcccgggctggagatcgtcggggtgcagacggcgcgctttccggcgatggtgaacctcgtcaagggccgcacccatccgcaaggcaccagcacgatcgccgagggcattgccgtcggtgagccggggcggatcacgcgggcgatcgttcgcgacctcgtcgacgacatggtgctggtggacgaagcggacatcgagcatgccctggtgatgctgctggagatcgagaagacgctggtcgagggggccggcgccgcgggtctggctgcgctgctgaaggcgcccgggcgctacgccgggcgacgcgtgggcctggtgctgtgcggcggcaacatcgatccgctgctgctgtcggcgatcatcgagcgcggcatggtgcgggcggggcggctggcacgcatccgcgtcgacgcgcgcgacgcccccggcgcgctggcgcgcatcaccgccaccgtggccgaggccggcgcgaacatcgaggaagtgcatcaccagcgggccttcaccacgctgtcggcgcagaacgccgaggtggagttggtgttgcagacgcgcaatcacgcccatatcggcgcagtgatcgcgtccctggtggctcaggggttcgaggccaaggcctactga

SEQ ID NO: 53588 - protein, 412 aa, Rubrivivax gelatinosus PM1
MTSAESPATVTLADVEAAARRLAGQVLDTPCVESKTLSEITGAQVFLKFENLQFTASFKERGALNKLLALVAARDDGTAALKGVIAASAGNHAQGVAHHAQRLGLRAVIVMPRHTPTVKVERTRGFGAEVLLHGESFDEARAHALEVAAAQGLSFVHPFDDPLVIAGQGTIGLEMLRAQPTLDTLVIAVGGGGLISGIATVARALKPGLEIVGVQTARFPAMVNLVKGRTHPQGTSTIAEGIAVGEPGRITRAIVRDLVDDMVLVDEADIEHALVMLLEIEKTLVEGAGAAGLAALLKAPGRYAGRRVGLVLCGGNIDPLLLSAIIERGMVRAGRLARIRVDARDAPGALARITATVAEAGANIEEVHHQRAFTTLSAQNAEVELVLQTRNHAHIGAVIASLVAQGFEAKAY

SEQ ID NO: 53589 - DNA, 1515 bp, Pseudomonas fluorescens PfO-1
  CDS (1)..(1515)
atgctcgaacagtacgtcaagaagatcctcacctcgcgcgtttatgacgttgccgtagaaaccccgctgcagaacgcccgccagctctccgagcggctgggcaacgacatctggctcaagcgcgaagacttgcagccggtgttctcgttcaagattcgcggtgcctacaacaagctgacccagttgagcgacgaagagcgcgctcgcggcgtggtcaccgcgtcggcgggcaaccatgcacagggcctggccctggcggcgaaagtgttgggcgtgaaagcgaccatcgtgatgcccaagaccaccccggagatcaaggtcgaaggcgtgcgctcgcgcggtggcaaagtggtgctgcacggcgattccttcccggaagcgctggcctactcgctgaagctggtcgacgaaaaaggctacgtctacatccacccgtacgacgatccgcacaccattgccgggcagggcaccgtggcgatggaaattctgcgccagcacccgcagccgctggatgcgattttcgttccggtgggcggcggcggtctgatcgccggcatcgcggcctacgtgaaatacctgcgtccggacatcaaggtcatcggcgtcgagcccgacgactccaactgcctgcaagcggcgatggcggcaggcgaacgcgtggtgctgccgactgtaggcatcttcgccgacggcgtggcggtggcgcagatcggccagcacaccttcgatatctgcaaggattacgtcgacgaggtgatcaccgtcagcaccgacgagatttgcgcggcgatcaaggacatctacgacgacacccgttcgatcaccgaaccggccggcgccctgggcgtggccgggatcaagaagtatgtcgagcagcgcggcgtcagcggccagaccttcgtcgccatcgactccggggccaacgtcaacttcgaccgcttgcgccacgtcgccgagcgcgccgaactgggtgaaggccgcgaagcgatcatcgccgtgaccatcccggagaaggccggcagcttcaaggccttctgcgaggccatcggcaagcgccagatcaccgaattcaactaccgctataacaatggcagcgaagcgcacatcttcgtcggcgtgcagacccacccggacaacgacccgcgcagtgctttgctggcgagcctgaccgaacagggtttcccggtgctcgacctgaccgacaacgaactggccaaactgcacatccgccacatggtcggcggtcgcgccgcgcacgtggtcgatgaagtggtgctgcgcttcgagttcccggagcgtccgggcgcgctgttcaacttcctcaacaagctcggcgggcgctggaacatctcgatgttccactaccgcaaccacggtgcagcggacggtcgtgtggtggcgggtctgcaagtgccccacgacgagcgtcatctggtgcccgcagcccttgaggaaatcggctacccatactgggacgaaagcgacaacccggcctatcagctgtttcttggctga

SEQ ID NO: 53590 - protein, 504 aa, Pseudomonas fluorescens PfO-1
MLEQYVKKILTSRVYDVAVETPLQNARQLSERLGNDIWLKREDLQPVFSFKIRGAYNKLTQLSDEERARGVVTASAGNHAQGLALAAKVLGVKATIVMPKTTPEIKVEGVRSRGGKVVLHGDSFPEALAYSLKLVDEKGYVYIHPYDDPHTIAGQGTVAMEILRQHPQPLDAIFVPVGGGGLIAGIAAYVKYLRPDIKVIGVEPDDSNCLQAAMAAGERVVLPTVGIFADGVAVAQIGQHTFDICKDYVDEVITVSTDEICAAIKDIYDDTRSITEPAGALGVAGIKKYVEQRGVSGQTFVAIDSGANVNFDRLRHVAERAELGEGREAIIAVTIPEKAGSFKAFCEAIGKRQITEFNYRYNNGSEAHIFVGVQTHPDNDPRSALLASLTEQGFPVLDLTDNELAKLHIRHMVGGRAAHVVDEVVLRFEFPERPGALFNFLNKLGGRWNISMFHYRNHGAADGRVVAGLQVPHDERHLVPAALEEIGYPYWDESDNPAYQLFLG

SEQ ID NO: 53591 - DNA, 957 bp, Pseudomonas fluorescens PfO-1
  CDS (1)..(957)
atgcacgtattcactcgcgacgacatcgaaaacgccgcccgccaggtttatcaggtgatgtcggccaccgcccaataccgttggccattgctcgccgagcggttgggctgcaccgtttgggtcaagcatgaaaaccacacgccgaccggcgccttcaaagtgcgtggcggtattacctttatgcactggctgcgtcgtgagcatccgactgtcaaaggcatcgtttctgcgacacgtggcaatcacggtcagagtctggcgctggcggcgcgggccgtgggactgaaagcgttgatcgtggtgccgcagggcaactcgctggagaagaacaacgccatgcgtggctttggtggtgaagtggtcgaatacgggcgcgattttgacgaggctcgtgaagaggcggcgcgcctggcacagaagcacgacctttttctggtgccaccgtttcacgttgaactggtcaagggcgtagcgacctatgcgctggagctgttcggtgcggcgccggatctggatacggtttacgtgcccattggttgcggatcggggatctgtggtgtgatcgctgcccgcgacgccctaggactgaataccgaagtggtgggggtggtgtcgacagaggccgcggccgccaagctgtcgtttgaagcgaacgcgatttgcgaaaccgcttcggcgaatacgttcgcggatggtttggctgttcgcaagccgattgcgcaggcgttcgatatctataaagaaggggcggcgaggattctctcggtcagcgaagttgagattgccgaagccatgcgcgtgtattacaccgacacccacaatcttgcggagggcgcgggtgccgcagcgttggcggcgttgatgcaggatcgggggaggatggaggggaaaaaggtcggggtggttctgtccggagggaatattgaccgatcggtgtatgcaaaggtgattggttga

SEQ ID NO: 53592 - protein, 318 aa, Pseudomonas fluorescens PfO-1
MHVFTRDDIENAARQVYQVMSATAQYRWPLLAERLGCTVWVKHENHTPTGAFKVRGGITFMHWLRREHPTVKGIVSATRGNHGQSLALAARAVGLKALIVVPQGNSLEKNNAMRGFGGEVVEYGRDFDEAREEAARLAQKHDLFLVPPFHVELVKGVATYALELFGAAPDLDTVYVPIGCGSGICGVIAARDALGLNTEVVGVVSTEAAAAKLSFEANAICETASANTFADGLAVRKPIAQAFDIYKEGAARILSVSEVEIAEAMRVYYTDTHNLAEGAGAAALAALMQDRGRMEGKKVGVVLSGGNIDRSVYAKVIG

SEQ ID NO: 53593 - DNA, 918 bp, Pseudomonas fluorescens PfO-1
  CDS (1)..(918)
atgttgcacatccgcacgccgctgatcctccatccgaccctgtcgactgcgtcccggcgcatgtggctgaagctggaaaacctgcaaccctgtggctcgttcaagctgcgcgggatgggcttgttgtgcagtcaggcagcggcgcagggcaagcgcaaggtcgtatgcccgtccggcggcaatgccgggctggccacggcggtggcagcggtcagcctgggtttgcaagcctgcatcgtggtgccgcacaccacgcctgaagcgacccgcgcgcgtattcgccgcaccggcgcggacgtcatcgtccacggcaaagtctgggacgaggccaatcagcgagcgcgagaactggccagcgcggcggacaccgaatacgtgccggccttcgatcacccggtgttgtgggaagggcacagctcgatggtcgacgaaatcctcgacgactgcccgcaggtcgataccgtggtcacgtcggtcggcggcggtggtttgctggcgggcatcctcaccgggctgctgcgccatgaccgccgagactgccgcatcatcacctgcgaaaccacaggcgccgcctcgttcgctgcggccgtccaggctggccatccggtgcgcctgagtcggatcgacagtgtcgccacctccctcggcgccgcccaggtggcggcttggccggtagagcatatcggcgagttcgatcatgagtgtctggtgctgtcagatgacgacgcgatcatgggcgtggtgcgttatgccagtgatctgcggcaattggtggagcctgcgtgcggggtttcgctggcggtggcgtacctcgatcatccggcgttggcgggggcgaatgatgtggtggtcattgtttgcggcggggtgagtatcagtgcgcaactggtggcggggtgggcgcggttgggatcttga

SEQ ID NO: 53594 - protein, 305 aa, Pseudomonas fluorescens PfO-1
MLHIRTPLILHPTLSTASRRMWLKLENLQPCGSFKLRGMGLLCSQAAAQGKRKVVCPSGGNAGLATAVAAVSLGLQACIVVPHTTPEATRARIRRTGADVIVHGKVWDEANQRARELASAADTEYVPAFDHPVLWEGHSSMVDEILDDCPQVDTVVTSVGGGGLLAGILTGLLRHDRRDCRIITCETTGAASFAAAVQAGHPVRLSRIDSVATSLGAAQVAAWPVEHIGEFDHECLVLSDDDAIMGVVRYASDLRQLVEPACGVSLAVAYLDHPALAGANDVVVIVCGGVSISAQLVAGWARLGS

SEQ ID NO: 53595 - DNA, 993 bp, Rhodospirillum rubrum
  CDS (1)..(993)
atgacccggcccttgcccgagactcccggggtcggcgcccaggacgtggtcgatgccggccaccgcctgaagggtcttgtcgtcaccacgccgcttgtcgaaagcccggtgctcaacgccagcatcggtggccggctgctggtcaaggccgaatgcctgcagcggacgggatcgttcaagatgcgcggggcgaccaacgccctggcccagatggacgacgcggcgcgggcgcgcggcgtcatcacccattcgtcgggcaatcatggtcaggccttggcctcggccgcccgggccttcggcctgcgggcgaccgtggtgatgcccgatgacgcgcccgccctcaagatcgagctgacccgggcccatggcgccgaggtggtcttctgtccgcgccacgcccgcgagcagacggtggcccggctagccggcgaaagcggcgccgtggtgatccatccctatgagacccccgccgtcatcgccggccaggggacggtgggcctggaaatcgtcgagcaatgcgccgccatcggcgtggtgcccgatcaggtgctggtctgctgtggcggcggcggtctgaccgccggggtggccctggccatcgaccggctgctgcccggcgtgccggtgatcgccgtcgagcccgagggctgggacgataccaagcgctccctggccgccggtgctatcgtcgccaatgacggtctgacggccacggcctgcgacgccttgcaggcgatgtgtccgggcaccctcagcttctcgctcaatcgccatctgctggccggggcggtgagcgtggacgaggcgatggtgcgccacgccatgcgccaagccttcgttcatctcaagctggtggccgaacccggcggcgccgtggccctggccgccgccctggccggcaaggtcgagaccgccgatcgcctcagcgtcgtcgtgctctcgggcggcaatgtcgatcccggccgcttcgcgagcgtgctggccggggattag

SEQ ID NO: 53596 - protein, 330 aa, Rhodospirillum rubrum
MTRPLPETPGVGAQDVVDAGHRLKGLVVTTPLVESPVLNASIGGRLLVKAECLQRTGSFKMRGATNALAQMDDAARARGVITHSSGNHGQALASAARAFGLRATVVMPDDAPALKIELTRAHGAEVVFCPRHAREQTVARLAGESGAVVIHPYETPAVIAGQGTVGLEIVEQCAAIGVVPDQVLVCCGGGGLTAGVALAIDRLLPGVPVIAVEPEGWDDTKRSLAAGAIVANDGLTATACDALQAMCPGTLSFSLNRHLLAGAVSVDEAMVRHAMRQAFVHLKLVAEPGGAVALAAALAGKVETADRLSVVVLSGGNVDPGRFASVLAGD

SEQ ID NO: 53597 - DNA, 1269 bp, Rhodospirillum rubrum
  CDS (1)..(1269)
atgtcgcccttccccccgtttccggccgcttcggccgtccccgccgtcaccctggccgatgtggaagccgcggcccggctgatcgcccatgccgtgccccataccccgctgctcccctcgcgcaccctgtcgcggctgaccggggccgaggttttcatcaaattcgagaaccaccagttcaccgcctcgttcaaggagcgcggcgcgctcaaccggttgagcgcgctgagcgagaccgagcgggcgcgcggcgtcatcgccatgagcgcgggcaatcacgcccagggcgtggcctatcacgcccagcgcctgggcattcccgccgttatcgtcatgcccgctgacacgcccttcgtaaaggtcaagcacacccgtgatttcggcgcccgcgtggtgctggaaggcgagaccgtggccgaatcgcggctggtggccgagcgcatccgcgaggaggagggactgaccttcgttcatccctataatgatccctgggtgatcgccggccaggggacggtggccttggaaatgcttgccgatcagcccgacctcgacatcctggtcgccccgatcggcggcggcggcctgctgggcggcatggcggtggcggccaaggcggtcaaaccggccattgagatgatcggcgttcaggtcgggctttatccttcggcctataacgccctccacggcctgccgccttgcaccggcggcgccacggtggccgagggcatcgccgtcaaggaaccgggcgatctgaccttgccgctgctgcgcgctttggtctcgcgcatcatcctggtcgatgagacggcggtcgaggaagccatctcgctctatctctcggtcgaaaagaccgtggccgagggggcgggggcggcgtcgctcgccgccctgttgaccgagccccagcgctttcgcggcaaaaaggtcggtctggtgctgagcggcggcaatatcgatccgcggatcatggcctcggtcatcatgcgcagccttgtgcgcgagggccgaatcgcccatctctcgatcaggatcggcgacaagccggggcaactcgcccgggtggcgacggtgatcggcgaaaccggcggcaatatcgtcgaggtccgccatgaacgcctgacctcggatatttcggtcaaatccaccgatctgcgggtgatcctggagacccgcgaccatacccatctggccgagatccttgaacgcctcgccgccgccggttttccggccaacgaacgctcgttcagcggcccggccgccggcgattaa

SEQ ID NO: 53598 - protein, 422 aa, Rhodospirillum rubrum
MSPFPPFPAASAVPAVTLADVEAAARLIAHAVPHTPLLPSRTLSRLTGAEVFIKFENHQFTASFKERGALNRLSALSETERARGVIAMSAGNHAQGVAYHAQRLGIPAVIVMPADTPFVKVKHTRDFGARVVLEGETVAESRLVAERIREEEGLTFVHPYNDPWVIAGQGTVALEMLADQPDLDILVAPIGGGGLLGGMAVAAKAVKPAIEMIGVQVGLYPSAYNALHGLPPCTGGATVAEGIAVKEPGDLTLPLLRALVSRIILVDETAVEEAISLYLSVEKTVAEGAGAASLAALLTEPQRFRGKKVGLVLSGGNIDPRIMASVIMRSLVREGRIAHLSIRIGDKPGQLARVATVIGETGGNIVEVRHERLTSDISVKSTDLRVILETRDHTHLAEILERLAAAGFPANERSFSGPAAGD

SEQ ID NO: 53599 - DNA, 1536 bp, Ralstonia metallidurans CH34
  CDS (1)..(1536)
atgacccgcacgcccgccaagcccgactatctgaaaaaaatcctgaccgccaaggtctatgacgtggcccaggagaccgaattgacctatgcgcccgcgctgtcggcacgcaccggcaatgcggtctggttcaagcgcgaggacacccagccggtgttctcgttcaagttgcggggggcgtacaacaagatggcgtccctcacgcccgaggaactcaagcgcggcgtgatcgctgcttcggcaggcaaccacgcccagggcgtggcgctggcggcggcccgcatgcagtgcaaggcgatcatcgccatgccgaccaccacgccgcaggtgaagatcgacgccgtgcgcgagcgcggcggcgagtgggtgcagatcgttctgcacggtgagtcgtacagcgatgcctacctgcacgcggccgaactcgagaagaagcacaagctcgcgttcatccacccgtttgacgaccccgaggtcatcgccggccagggcaccatcgcgatggagatcctgcgccagcaccctggcccgatccacgcgatctttgtcgccatcggcggcggcggcctgatctccggcatcgccgcctacgtcaaggcggtgcgccccgagatcaaggtgatcggcgtgcagaccttcgattccgatgccatgaagcgctcggtggacgccggcaagcgcgtggaactgaaggatgtgggcctgttctcggacggtaccgccgtcaagctggtgggcaaggaaacgttccgcatcacgcgtgaactggtcgacgacatcatcctggtcgataccgatgcgatctgcgcgggcctgaaggatgtgttccaggacacccgcagcatcctcgagccggccggcgcgctggccgtggccggcctcaaggcgtacgccgagcgcgagaagctcaagcaccagcacctggtggcgatcgcctgcggcgccaatatgaacttcgaccgcctgcgctttgtggccgagcgcgccgaagtgggtgaagcgcgcgaagcggtcttcgccgtgacgatccccgaggaacgcggcagcttcaagcgcttctgcgaacaggtcggcacgcgcagcgtgaccgagttcaactaccgcatcgccgacaagggcgtggcgcatatcttcgtcggcgtgcagatcgccagccgcgcggagagcgacaagatcgccgccaacttccgccgccatggctttgacacgctcgacctgtcgaacgacgaactggccaagcagcacatccgctacatggtcggcggccattcgccgctggcgcatgacgaactgctgtatcgcttcgagttcccggagcgcccgggcgcgctgatgaagttcctgtccagcatgagcccgaactggaacatcagcctgttccactaccggaaccagggcgcggatacgtcgaacatcctggtcggcatccaggtgccgaagaacgagaagcgcgcgttccgcagcttcctttcgacgctcggttacgtacactgggatgagaccgacaaccccgtctacaagctgttcctttcctga

SEQ ID NO: 53600 - protein, 511 aa, Ralstonia metallidurans CH34
MTRTPAKPDYLKKILTAKVYDVAQETELTYAPALSARTGNAVWFKREDTQPVFSFKLRGAYNKMASLTPEELKRGVIAASAGNHAQGVALAAARMQCKAIIAMPTTTPQVKIDAVRERGGEWVQIVLHGESYSDAYLHAAELEKKHKLAFIHPFDDPEVIAGQGTIAMEILRQHPGPIHAIFVAIGGGGLISGIAAYVKAVRPEIKVIGVQTFDSDAMKRSVDAGKRVELKDVGLFSDGTAVKLVGKETFRITRELVDDIILVDTDAICAGLKDVFQDTRSILEPAGALAVAGLKAYAEREKLKHQHLVAIACGANMNFDRLRFVAERAEVGEAREAVFAVTIPEERGSFKRFCEQVGTRSVTEFNYRIADKGVAHIFVGVQIASRAESDKIAANFRRHGFDTLDLSNDELAKQHIRYMVGGHSPLAHDELLYRFEFPERPGALMKFLSSMSPNWNISLFHYRNQGADTSNILVGIQVPKNEKRAFRSFLSTLGYVHWDETDNPVYKLFLS

SEQ ID NO: 53601 - DNA, 969 bp, Ralstonia metallidurans CH34
  CDS (1)..(969)
atgacgaccctgcaactgcccacctacgccgacgtcgaagccgccgccaaacggatcgaaggctttgccaaccgcacgccggtcaacacgtcgcgcacgctcaacgaaatgctcggcgcggaagtcttcttcaagtgcgagaacttccagcgcatgggcgccttcaagttccgaggcgcgttcaacgcgctggcgaagttcaccgccgagcaacgccgtggcggcgtggtcgcgttctcgtccggcaatcacgcgcagggcatcgcgctgtccgcgaagctgctgaacatgcccgccacgatcgtgatgccccacgacgctccggccttgaaggtagcggcgacgcgggggtatggcgcgaccgtggtgagctatgaccgctacaaggaagaccgtgaagccatcggccgcgatctggccgaaaagcacggcatgacgctgatcccgccgtatgaccatccggatgtgctgacgggccagggcaccgccgccaaggaactgttcgaggaagtgggcgcgctcgacgccatcttcaccccgctgggcggcggcggactgctctccggcaccgcattgaccacgcgcgcgctggcgccacagtgccagatctacggcgtggagcccgaggcgggcaacgacggccagcaatcgttccgcagtggttcgatcgtccatatcgacaccccgcagaccattgccgatggcgctcagacgcagcacctgggtcagtacacgttcagcatcatcaagcgtgacgtgactgatatcctgaccgcaacagacgcgcaactggtcgaggccatgcgcttctacgccgaacggatgaagatgattgtcgagccgaccggctgcctgggcctggcggcggtcatgcagatgaaggacgcgctcaagggcaagcgcgtgggcgtagtgatcagcggcggcaacgtcgacctggagcgattctgctcgctgctgtcagcctga

SEQ ID NO: 53602 - protein, 322 aa, Ralstonia metallidurans CH34
MTTLQLPTYADVEAAAKRIEGFANRTPVNTSRTLNEMLGAEVFFKCENFQRMGAFKFRGAFNALAKFTAEQRRGGVVAFSSGNHAQGIALSAKLLNMPATIVMPHDAPALKVAATRGYGATVVSYDRYKEDREAIGRDLAEKHGMTLIPPYDHPDVLTGQGTAAKELFEEVGALDAIFTPLGGGGLLSGTALTTRALAPQCQIYGVEPEAGNDGQQSFRSGSIVHIDTPQTIADGAQTQHLGQYTFSIIKRDVTDILTATDAQLVEAMRFYAERMKMIVEPTGCLGLAAVMQMKDALKGKRVGVVISGGNVDLERFCSLLSA

SEQ ID NO: 53603 - DNA, 966 bp, Burkholderia fungorum LB400
  CDS (1)..(966)
atgcaagcgcttcccgctcccactttcgacgacgtactcgacgccgctgcgcgtcttgaaggcgtcgcccaccgcactcccgtgctgacctcgagcacgtttgacgaacgaacgggcgcgtcggtgttcttcaagtgcgagaattttcagcgcatgggcgccttcaagtttcgcggtgcctataacgcgatctcgcatttcgacgcggagcaacgcaaagccggcgtgctgacgtattcgtcgggtaaccacgcgcaggcaattgcattgtcggcgcggcttgccggcattcgcgcgacgatcatcatgccgcacgacgcaccggccgccaaagtcgcggcaaccaaaggctacggcggcgaagtgatcacctacgaccgctacaccgagaaccgcgaagagatcggccggcgtctcgccggagagcgtggcatgacgctgattccaccatacgatcatccacatgtgatcgccgggcagggcacggcggtgaaagaactgatcgaggaaaccggcccgctcgacatgctgttcgtgtgcctcggcggcggcgggctgatcagcggcagcgcgttgtccgccgcggcgttgagcccggcgtgcacggtgatcggcgtcgagccggaggcgggtaacgacggccagcagtcgctggcgcgcggcgagatcgtgcatatcgacacgccgcgcacgatcgccgacggcgccgcctccacgcatctgggcgactacacgtttgcgatcatccgcaagctggttgcgcggatcgaaacggtcagcgacgggcaactgatcgacacgatgcgctttttcgcgcagcgcatgaagatcgtggtcgagccgacgggttgtctcgccgcggcggcggtgctcaacggcatcgtgccggtgaagggcaagcgtgtcggcgtggtggtcagcggcggcaacgtcgatctggaaaagctcgcgcagtatctcgcctga

SEQ ID NO: 53604 - protein, 321 aa, Burkholderia fungorum LB400
MQALPAPTFDDVLDAAARLEGVAHRTPVLTSSTFDERTGASVFFKCENFQRMGAFKFRGAYNAISHFDAEQRKAGVLTYSSGNHAQAIALSARLAGIRATIIMPHDAPAAKVAATKGYGGEVITYDRYTENREEIGRRLAGERGMTLIPPYDHPHVIAGQGTAVKELIEETGPLDMLFVCLGGGGLISGSALSAAALSPACTVIGVEPEAGNDGQQSLARGEIVHIDTPRTIADGAASTHLGDYTFAIIRKLVARIETVSDGQLIDTMRFFAQRMKIVVEPTGCLAAAAVLNGIVPVKGKRVGVVVSGGNVDLEKLAQYLA

SEQ ID NO: 53605 - DNA, 1035 bp, Burkholderia fungorum LB400
  CDS (1)..(1035)
atgtccgttccttcgctggccgatctatcgttagccgatgtctaccgcgcacgccgccgtatcgaggggcgtgtgcgccatgcgccgctcgtcgaatcgcagagcctgtcggcgctcgcgggcgtgccggtgtttctcaaactcgaaaccgtgcagccgactggcagcttcaaggtgcgcggcgcgacaaacgcgctcggtcatctcgccgaacagggctgccggaaagtcgtgaccgcgtcgacgggcaatcacgggcgcgcggttgcgcatgcggcccgcacgctcggtatcgacgcgacggtctgcatgtcggcgctcgtgccggccaataaggtcgacgcggtgcgcgcgctcggcgcgcacgtgcggattgtcggcaaaagccaggacgaggccgagcacgatgcgttgagactggtacgcgaagaaggcttcgcttatgttccgccgttcgacgatccccatgtgatcgccggtcaggcgacgatcggtctggaaatcgtcgaggcgttgccggatgtagccaacatcgtcgtgccgctatcgggcggcggcctgttcgcgggcgtcgcgttcgccgccagaagcgcgaatcgcgcgatcggcctgaccggcgtgacgatggcgcgcggtgcggcgatgcatgccagtctggtggccggccagccggtgctggtcgaagaagtggcaacgctcgccgattcgctcggcggcggcatcgggctggaaaaccgctacacgtatgcgctcacgcgcgatctgatcgaccagaccgtgctgctcgatgaggcctcgatcgcgcgcggcatcgcgcatgcgtaccggcatgaacggctcgtcgtggaaggcgcggcggcggtgggcattgccgcgttgctcgatggcgtgctgcccgccggacgtatcgggcgcgggccgctcgtgctcatcgtgaccggcgccaacatcgatatggacctgcatcggcggatcgtcgatgcggattccatgcaacccgactcgacgcaatccggtttacatcccatctcatga

SEQ ID NO: 53606 - protein, 344 aa, Burkholderia fungorum LB400
MSVPSLADLSLADVYRARRRIEGRVRHAPLVESQSLSALAGVPVFLKLETVQPTGSFKVRGATNALGHLAEQGCRKVVTASTGNHGRAVAHAARTLGIDATVCMSALVPANKVDAVRALGAHVRIVGKSQDEAEHDALRLVREEGFAYVPPFDDPHVIAGQATIGLEIVEALPDVANIVVPLSGGGLFAGVAFAARSANRAIGLTGVTMARGAAMHASLVAGQPVLVEEVATLADSLGGGIGLENRYTYALTRDLIDQTVLLDEASIARGIAHAYRHERLVVEGAAAVGIAALLDGVLPAGRIGRGPLVLIVTGANIDMDLHRRIVDADSMQPDSTQSGLHPIS

SEQ ID NO: 53607 - DNA, 1512 bp, Magnetococcus sp. MC-1
  CDS (1)..(1512)
atgtccgaacaactgtttcgccacattcttacttcccgcgtctacgaggctgcggtggagacccctttggaacagtcggcttggctttcggcgcagctacgcaaccaagtttttattaaacgcgaggatctacagcctgtcttttcgtttaaattacgcggggcctacaacaaaatggcgcagcttacccctgagcagcgggcccggggcattattgcggcctctgcgggcaaccatgcgcaaggggtggcctttagcgcccgtcagttggggttatctgccaccattgtgatgccctgcaccaccccagagatcaaggtgggggcggtcaaacagtttggtgcccaggtggtgctgcatggggataactactccatcgccgccgaccactgtaaagagctggctcagcacaacggcatgacctttattcacccctttgacgatgagctggtgatcgccggacagggtaccgtggggctggagattatgcgccagagcggtaatcaactggacgccatttttgttccggtcggcggcggggggttgattgcgggcattgccacctatgtaaaaaatctgctaccgcagatccgtattattggcgtagaacccaccgatagcgatgccatggcccgcgccctagaggcgggcaagattgtctctttagaccaagtgggcatctttgccgatggggtggcggtgcgtgaggttggtacacgcaccctggcgctgtgtgaacagtatgtggatgagatggtgcgggtcaatgtggatgagatctgtaccgccatcaagtggacctatcaagccacccgtgccattgtagagcccgcaggggccttagcgctggctggtttacgccgctatgtggcggaaaaaggcataaccggtcaacgcttggtggtcatcaatagcggggccaatatgaactttgagcggctccgttatgtaaccgaacgcaccatggttggggagcaacgcgaggcgctgtttgccatcaccatacctgaacagcccggtgctctacgccacttttgccaagaggtggtgggggaccataatattaccgaatttaactaccgtctatcggggcgcgatgccgcccatatctttgtgggcattgatctgcgtgaaccagccgaacgacaactgctcgcccatcggttacagagtttccactatcaatttgtggatcttaccgaaaacgatctggccaagacccacctgcgtcatatggttggcgggcgttcccatgtggtgcagcatgagcgtcttttgcgttttcgtttccccgaacggcccggtgccttggcccactttcttaccaccatgcaggcggattggaacatctcactgtttcaataccgactacacggcggggagtatggtcgggtgttgattggtctggaggtgccccctgagcaacacgatcaattgcaaagctgcctagataagctgggttttcgctatgtagatgagagtgagaatcctgcctataagctgtttctctag

SEQ ID NO: 53608 - protein, 503 aa, Magnetococcus sp. MC-1
MSEQLFRHILTSRVYEAAVETPLEQSAWLSAQLRNQVFIKREDLQPVFSFKLRGAYNKMAQLTPEQRARGIIAASAGNHAQGVAFSARQLGLSATIVMPCTTPEIKVGAVKQFGAQVVLHGDNYSIAADHCKELAQHNGMTFIHPFDDELVIAGQGTVGLEIMRQSGNQLDAIFVPVGGGGLIAGIATYVKNLLPQIRIIGVEPTDSDAMARALEAGKIVSLDQVGIFADGVAVREVGTRTLALCEQYVDEMVRVNVDEICTAIKWTYQATRAIVEPAGALALAGLRRYVAEKGITGQRLVVINSGANMNFERLRYVTERTMVGEQREALFAITIPEQPGALRHFCQEVVGDHNITEFNYRLSGRDAAHIFVGIDLREPAERQLLAHRLQSFHYQFVDLTENDLAKTHLRHMVGGRSHVVQHERLLRFRFPERPGALAHFLTTMQADWNISLFQYRLHGGEYGRVLIGLEVPPEQHDQLQSCLDKLGFRYVDESENPAYKLFL

SEQ ID NO: 53609 - DNA, 933 bp, Thermobifida fusca
  CDS (1)..(933)
atgacgtcacgcatcactgtgtcccgtcaggtccccacgaccttcgacgtgcacctcgctgtccaacgcaccgctccctatctgcgtcgcaccccgctcctgcgcactcgtctgcggggccgccccctgctgctgaagctggagcatttgcagctcaccggtgcgtttaaactacgcggcgccttgaatgcgctactcaccggggacaggggtgaacgggtggttaccgcctcgggtggcaaccacggcctcggagtggccaccgccgcgcacctgctcggcggtacggccaccgtgtacgtacccgagaccgttcccgcggtcaaggagcggcggttgcgggacgccggtgccgacgtggttcgggccggcaccgagtacgcggcagcggaagccgcagcccgcgcctacgcggacaccgaagggctccgctacatccacgcctacaacgacccggacgtggtcgcaggccaaggcacgctcggccacgagatcgtcgccgacgcacccgactgcgatgcagtcgccgtggccgtaggcggcggcggtctcgccgcaggcgtgagcctgggcatcggcgacgaacggctcaccgtcgcggtagagccgcgcggctgcgccagcctgcacgccgcattcgccgccggcgagcccgtggacaccccggtcgattcagtagcggcctcggccttgggcgcctcccgggtgggcgacatcccgttcgcggtactgcgcgaccgcaacgtgacctccaccctcgtctcggaccccgagatccttgccgcccgcgacctgctgtgggaggaattccggatcgcggtggagcccgccgcggctactcccatggctgcctggctggccgggcacgtccccggcgaactgccgtgcgtggtgatctgcggcgccaacgccgactggcgtcccctggactga

SEQ ID NO: 53610 - protein, 310 aa, Thermobifida fusca
MTSRITVSRQVPTTFDVHLAVQRTAPYLRRTPLLRTRLRGRPLLLKLEHLQLTGAFKLRGALNALLTGDRGERVVTASGGNHGLGVATAAHLLGGTATVYVPETVPAVKERRLRDAGADVVRAGTEYAAAEAAARAYADTEGLRYIHAYNDPDVVAGQGTLGHEIVADAPDCDAVAVAVGGGGLAAGVSLGIGDERLTVAVEPRGCASLHAAFAAGEPVDTPVDSVAASALGASRVGDIPFAVLRDRNVTSTLVSDPEILAARDLLWEEFRIAVEPAAATPMAAWLAGHVPGELPCVVICGANADWRPLD

SEQ ID NO: 53611 - DNA, 1266 bp, Novosphingobium aromaticivorans DSM 12444
  CDS (1)..(1266)
atggaaaatgcagcgctcacgcccgtagtgcagggggccgccgacgacgcggacgccctgctgactctcgccgacgttcgtgcggcggcggagcgcattgccggccaggtggtgcgcaccccgaccctgcacagcaagacgctgagcgcgattaccggcgcgaacatctggatcaagttcgagaacctgcagttcaccgccgcctacaaggagcgaggtgcgctcaatgccctgctgctcctttcgcaggaacagcgcgcgcggggcgtgatcgccgcgtcggcgggaaaccacgcgcaggggctttcctaccacggaacccgcctgggcgttcccgtgaccatcgtcatgccgcgcacgacgccgacggtgaagatcatgcagaccgaggccgtgggcggcaaggtcgtgctcgagggcgagaccttcgacgaggcctatgcccatgcgcgcaagctggagcgcgaactgggactgacgttcgtccacccgttcgacgagcgcaatgtcgcggccggacagggtacggtcgcgctcgagatgctcgaggatgcgcccgagatcgacatgctggccgttcccatcggtggcggtggcctgctttcgggcatgggcacggcggcgcgcgggatcaagccggagatcggcctgatcggcgtgcaggcacagctcttcccgtcgatgttcgcgcggctcaagcacctcgatttgccatgcggcggcgatacgctggccgagggcatcgcggtgaaggagccgggggcgttcacctccgccgtgctgcgcgatctggtcgacgatgtggtgctggtgaacgaagccgcgctggaatcggccgtggcgctgctgctccagatcgagaagaccgtggtcgaaggcgcgggcgccgcggggctggcggcggtgatgcagaaccgggagctgttcgcgggccgcaacgtgggcgtcgtgctgacgggcgcgaacatcgatacgcgcctgctggccaacgtgctgctgcgcgatcttgcacggtcggggcgcctcggccgcctgcgcatcacattgcaggaccgtcctggcgcgctgttcaaggtggtcgaggagttcaaccgtcaccaggtgaacatccttgaagtttggcaccagcgcatcttcacttcgctgccggccaagggcctgaccgccgagatcgagtgcgaggcgcgcgatcgcgagcagatcgaccggctcgtcgccgggctgcgcggcaagggctacgacgtcgagcaggtcgaactggggtag

SEQ ID NO: 53612 - protein, 421 aa, Novosphingobium aromaticivorans DSM 12444
MENAALTPVVQGAADDADALLTLADVRAAAERIAGQVVRTPTLHSKTLSAITGANIWIKFENLQFTAAYKERGALNALLLLSQEQRARGVIAASAGNHAQGLSYHGTRLGVPVTIVMPRTTPTVKIMQTEAVGGKVVLEGETFDEAYAHARKLERELGLTFVHPFDERNVAAGQGTVALEMLEDAPEIDMLAVPIGGGGLLSGMGTAARGIKPEIGLIGVQAQLFPSMFARLKHLDLPCGGDTLAEGIAVKEPGAFTSAVLRDLVDDVVLVNEAALESAVALLLQIEKTVVEGAGAAGLAAVMQNRELFAGRNVGVVLTGANIDTRLLANVLLRDLARSGRLGRLRITLQDRPGALFKVVEEFNRHQVNILEVWHQRIFTSLPAKGLTAEIECEARDREQIDRLVAGLRGKGYDVEQVELG

SEQ ID NO: 53613 - DNA, 1206 bp, Ferroplasma acidarmanus
  CDS (1)..(1206)
atgttaagttatgatagaatagtcagagcaggaaatgagataaaggggaagatacatagaacgccattattccattcaacaacattcagcaatatgttttcatgtgacgtttactttaaaatggagaattttcagaagacggggtctttcaaatccagaggagctatggtaaaattttcaacgttgaccgctgaacagaaaaaaaatggagtaataaccgccagtgcaggaaatcacgcacagggagtggcttttgcggcttcctattatggcgttgatgcaaaaattgtcatgcctgaaacaacaccgcctgccaaggtaaacgctgtccaatcctatggcggcacagttatactaaagggcaatagctacgacgaagcacatgaatatgcggtacaggtttcagtggacgagaaaagggaatttattgaagcttataacgatgaggatgttattgccgggcaggggacaataggccttgaaattttagaagatgtgaaaccggacattgtaatagtgccaataggtggtggagggcttatttcagggatatcatttgcaattaaatcaaaaaacaaggatataaaaataataggggtagagtccgaaaaggcaaatgccatggaattatctataaaggaaggcaaaatagttccatacaccagcaacgatacaattgctgatggaatcgccgtaaaatatccgggaaatataacatttgaactggtaaagaaatatgtggatggagttgttacagtatcggatgagaatattgcatatgcactattcaagctgcttgaaagggaaaaagtgcttgtggagccttccggcgcagctggccttgcagcattatttgaaaataaaattgatgttaagggcaagaaagttgttattgtactttcaggagggaacgtaaacttcctactgctgtcaaacataatatacagggcgcttgaaatggaaaacaagttgcttcgccttgaattcaatctgcctgaccacccgggtataatggaaaaaatagtaaatgccatatcatcttccggagccaatatataccatgctgaggtggataatttaaacaaggatacgcctataggataccagtatctcctattcacaataaacatccttgacaaatcgagaatagatgaattgctcgggagcctcgataaacttggctataaataccggataataggatag

SEQ ID NO: 53614 - protein, 401 aa, Ferroplasma acidarmanus
MLSYDRIVRAGNEIKGKIHRTPLFHSTTFSNMFSCDVYFKMENFQKTGSFKSRGAMVKFSTLTAEQKKNGVITASAGNHAQGVAFAASYYGVDAKIVMPETTPPAKVNAVQSYGGTVILKGNSYDEAHEYAVQVSVDEKREFIEAYNDEDVIAGQGTIGLEILEDVKPDIVIVPIGGGGLISGISFAIKSKNKDIKIIGVESEKANAMELSIKEGKIVPYTSNDTIADGIAVKYPGNITFELVKKYVDGVVTVSDENIAYALFKLLEREKVLVEPSGAAGLAALFENKIDVKGKKVVIVLSGGNVNFLLLSNIIYRALEMENKLLRLEFNLPDHPGIMEKIVNAISSSGANIYHAEVDNLNKDTPIGYQYLLFTINILDKSRIDELLGSLDKLGYKYRIIG

SEQ ID NO: 53615 - DNA, 1254 bp, Cytophaga hutchinsonii
  CDS (1)..(1254)
atgaatagtaaagtgaaggttgaagacattgttgaagcggcaaaccgtttgaaaaatgttgtgacgcatacgccattaaccaaaaatgagcatctttctcaggaatataactgcaacctatggttaaaaagggaagatctgcaattggttcgttcctataaacttcgtggagcatataattttatgtgcagtcaaaaacgcgaagatatagaaaagggtgttgtatgtgccagtgccggaaaccatgctcagggcgttgcctattcctgccaggcgttgaaaattaaaggccggatctatatgccgagcacaacacccaaacaaaaagttacgcaggtaaaattttttggtaaagagtttgttgaagttgttctgaccggcgatacgtttgatgattcgtacaaagaggcaatgaattattgcacagagaataaattattatttgtacatccgttcgatgatcctaaagtaatagccgggcaaggtacagtaggttttgaaatattaaatgatattgttggaaccattgattatatctttgtgccgattggcggcggcgggcttgcagcaggactttgtacctacataaaagaattgagcccgcatacaaaaatcattggggtggagccgttaggtgcgccggcaatgaaacgctcactggaagaagggaaagttgttgtactggaagaaatcgataagtttgtggatggtgctgccgtgaagcgggtaggcgatctcaattttgatatctgttcagaatatctagatgatgtacagttggtaccggaagggaaaacatgcagcacgatcataaagctgtataatgaagaagccattgtagcagaacctgcaggggcattaagcattagtgtgctggattattataaagatgaaataaaagggaagaatgttgtgtgtgtgatcagcggcagtaacaacgatatcgaccgcatgcaggagatcaaggaacggtcgttgttgtatgaagggctgaaacattatttcataatccgctttaagcagcgtacaggagcactcagagagtttctggatgaggttttagggccaaatgatgatattacctattttgaatatacaaagaaaacaaaccgtgaaaatggcccggcaatggttggtattgaggttaaaatgaaagaagattttaatttactcatcgaccgtatgaacgcaaaaaatgtcgactatacgttagtaaattcagattcaaacttatttagttttctgatcatgtaa

SEQ ID NO: 53616 - protein, 417 aa, Cytophaga hutchinsonii
MNSKVKVEDIVEAANRLKNVVTHTPLTKNEHLSQEYNCNLWLKREDLQLVRSYKLRGAYNFMCSQKREDIEKGVVCASAGNHAQGVAYSCQALKIKGRIYMPSTTPKQKVTQVKFFGKEFVEVVLTGDTFDDSYKEAMNYCTENKLLFVHPFDDPKVIAGQGTVGFEILNDIVGTIDYIFVPIGGGGLAAGLCTYIKELSPHTKIIGVEPLGAPAMKRSLEEGKVVVLEEIDKFVDGAAVKRVGDLNFDICSEYLDDVQLVPEGKTCSTIIKLYNEEAIVAEPAGALSISVLDYYKDEIKGKNVVCVISGSNNDIDRMQEIKERSLLYEGLKHYFIIRFKQRTGALREFLDEVLGPNDDITYFEYTKKTNRENGPAMVGIEVKMKEDFNLLIDRMNAKNVDYTLVNSDSNLFSFLIM

SEQ ID NO: 53617 - DNA, 1512 bp, Microbulbifer degradans 2-40
  CDS (1)..(1512)
atgccccagacttaccttaaacgcatattagatgcgcgaatatacgatctagccatagaaaccccactagagtccgtgccgcttatttctattcgcacaggcaacaacgtgttgcttaaacgcgaagacttgcagccggtgttctcttttaaaattcgcggtgcctacaacaagttgcgcctattaagcgaagaggccagaaaggtcggtgtaattgctgcttctgcaggtaaccatgcacaaggtttggctttggctgctaagcatatgggggttgcggccactattgttatgccgcgcaccacgccagctattaaggtagatgcggtgcgccgtcgcggcgccaaagtggtgctaatgggcgacgcctacgacgaagctgcagcccatgctaaaaaactggtggaagagaaaggccttacctatatccacccgttcgatgacccagacgtgatcgcgggccaaggcacagtgggtatggagatattgcgccagcaccccggcgatatagatgtggtgtttgtacctgttggcggcggcggcttatgtgccggtgtagcggcttatatcaagcacgtgcgcccagaaaccaaggtcatagcggtggaggcagaagattctgcctgtttaaaattggcaatggataaaaaacgccgtgcggtgttgcccagtgtgggtatttttgccgagggcgtggctgtggcgcaaataggtaaagaaacctaccgcgtaattaaagagtgcatcgacgaagttataaccgttaacactgacgaaatgtgcgcggcaataaaagatatattcgaagatacccgctctattgccgagcctgcgggcgcgctttctcttgcgggcttaaaaaaatatgttgcgcgtacaggctgtgtagataaaacgctaatcgccattgatagcggcgccaacaccaactttgaccgtttacgctatatctctgaacgcactgagtttggcgaaaaacgcgaagctatattcgccgttaccctgccagaaaagcccggcgcctataaaaaattctgtaaagatttgggcaagcgcaatattaccgagtttaattatcgctacgccgataatcagcaggcacacatttttgtgggcttgcaaataacgcccgataaaaacgaccgtgaagacatcgtcaatacgcttacaaaaggcggttatgatgtagtggatatgaccgataacgaagtggccaagttgcacgttcgctatatggtgggcggccatgcaactgtgccagatgaaattgtgtatcggtttgagttccccgagcgcccaggtgcgctaatggaattcttaactaaaattgccgggcgctggaatatttctatgttccattaccgcaaccacggtgcggcgtttggcagagtgttggtgggcatgcaggtgcctaagggcgagcgcaaagacttaaaagatttgctcgacgaacttaattacacctattgggatgagacccaaaacgaagcctattcatttttcttggggtag

SEQ ID NO: 53618 - protein, 503 aa, Microbulbifer degradans 2-40
MPQTYLKRILDARIYDLAIETPLESVPLISIRTGNNVLLKREDLQPVFSFKIRGAYNKLRLLSEEARKVGVIAASAGNHAQGLALAAKHMGVAATIVMPRTTPAIKVDAVRRRGAKVVLMGDAYDEAAAHAKKLVEEKGLTYIHPFDDPDVIAGQGTVGMEILRQHPGDIDVVFVPVGGGGLCAGVAAYIKHVRPETKVIAVEAEDSACLKLAMDKKRRAVLPSVGIFAEGVAVAQIGKETYRVIKECIDEVITVNTDEMCAAIKDIFEDTRSIAEPAGALSLAGLKKYVARTGCVDKTLIAIDSGANTNFDRLRYISERTEFGEKREAIFAVTLPEKPGAYKKFCKDLGKRNITEFNYRYADNQQAHIFVGLQITPDKNDREDIVNTLTKGGYDVVDMTDNEVAKLHVRYMVGGHATVPDEIVYRFEFPERPGALMEFLTKIAGRWNISMFHYRNHGAAFGRVLVGMQVPKGERKDLKDLLDELNYTYWDETQNEAYSFFLG

SEQ ID NO: 53619 - DNA, 927 bp, Haemophilus influenzae 86-028NP
  CDS (1)..(927)
atgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccaggggattccctag

SEQ ID NO: 53620 - protein, 308 aa, Haemophilus influenzae 86-028NP
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNQGIP

SEQ ID NO: 53621 - DNA, 1056 bp, Pediococcus pentosaceus ATCC 25745
  CDS (1)..(1056)
atgttagtagagaaagaacccagaaaccaagttgtagcagcaaccgataatttattaaatctaaaccagattgaagaagcccgcgaggttattaaaaaatatgcgcgtcggacaccattagttaagtccatgtttttgagcaacaacgttgtccatggggatgtctatttaaaattagagaatatgcaattaaccggttcttttaaatttagaggggcgaataacaaaattaaccacttgaatgaagaagaaaaacaacgaggcgtaattacagcttcagctggaaatcatgcacaaggagtagctttgaccggtaagttgctgggaattaaaactacggtagtgatgccggatgaggcgccccaaatgaagcgcgatgcaacccgaggatatggagcggaagtagatattcatggcgcaacttttgatgacgctcacgaatggatgcgagaaagagctgaaaaagaaggaaaaaccattgtagatccgtttaatgatgctttaatttgtgctggacaaggaactatcggtttggaaattctagaagatttagtggatgtagaaaccgttgtagttccagtcgggggcggtggtctaatttcaggaatcgccacggctttaaaatcaatcaatccttcaattcatatcgtcggagttcaatcggaaaatgtgcatggcatgaaggcgtctgttgatgcaggcaaaattgttaaacatcaccaagattttacgctagcagacggaactgatgtagcaaccccaggtaatattacatttgggattgtttccaaactagtggatgagattgtcttggttagtgaagaagaaatttcaaaagcgatgaaagatttaatgcagagaaccaaggtggttgctgaaggagcaggagcattgccaacggccgctttagaagcaggtaagattgatccaaaatggactaaagataagaaggttgtagctttagtttccggtggaaatgtggatctacagcgagtttcacagattattgatcacttctttactcctgttgatacgcataaaggtgccattgggtaa

SEQ ID NO: 53622 - protein, 351 aa, Pediococcus pentosaceus ATCC 25745
MLVEKEPRNQVVAATDNLLNLNQIEEAREVIKKYARRTPLVKSMFLSNNVVHGDVYLKLENMQLTGSFKFRGANNKINHLNEEEKQRGVITASAGNHAQGVALTGKLLGIKTTVVMPDEAPQMKRDATRGYGAEVDIHGATFDDAHEWMRERAEKEGKTIVDPFNDALICAGQGTIGLEILEDLVDVETVVVPVGGGGLISGIATALKSINPSIHIVGVQSENVHGMKASVDAGKIVKHHQDFTLADGTDVATPGNITFGIVSKLVDEIVLVSEEEISKAMKDLMQRTKVVAEGAGALPTAALEAGKIDPKWTKDKKVVALVSGGNVDLQRVSQIIDHFFTPVDTHKGAIG

SEQ ID NO: 53623 - DNA, 1245 bp, Moorella thermoacetica ATCC 39073
  CDS (1)..(1245)
atgagcaatataacccaactacgctgtataaactgcagccgtacctatcaaccccggcccggcttttatacctgccccatctgcgggtcgacggacggcatcctggatgtcgaatacgattacgattatataaacaaatccatctccaggcagagcctggccagcaaccgggaacattccctctggcgttaccgtcccttcttgccggtggcccaggagggaccgctgccccctctgcgggtgggttggagccccctgtaccgggcccggcgcctgggggacgaactggggttgaaagagctatatatcaaggacgatgggattaatcccacggggtctttaaaagacaggccttcggccgtggcggtggcccgagccctggccgaaggagctaaggtggtcgcctgctcttcaaccggcaacgctgcttcctccctggcgggggcagcagcttccgtgggcctgaaggcggtaatctttgtaccgggacgggcaccgcaagggaaggtagcccaactcttgattttcggggccaccgttatcagtgttcagggatcctatgaggatgccttcaagctttcggcggcggccatagccgagcacggctggtacaaccgcaatgccgccattaacccttatctggtagaaggcaaaaagacagtttgcctggaagtggcggaacagctaaactgggaggtacccgactgggtggtcctttccgtgggcgacggttgtaccatggccggtgcctggaaggcctgggtggacctgaaaaaggccggttggattgacaaactgccgcggatgctgggggtccaggccgagggttgctgccccattaccagggccttccgggagggaaccagggtaaaacccatgcccgaaaataccctggcggacagcatcgccgtcggcgtgccccgcaatccagaaaaggctctgcgggccgtaagggattccgggggtacgatgatcaacgtcagcgatgaagaaatccttgcagccatgcgcaccctggggcggaccagcggcatcttcggcgaacctgccggtgcagccgggaccgccggccttatcaaagccgtccaggaaggaataattaaatccggagataaggtggtcgtcctggtaacaggcaacggcctcaaggatgtggccaatgccatcaaagcggccggagagcctatccgggtggagccctccctggaggccttaaaggaagccctggctcggtacgggaaatga

SEQ ID NO: 53624 - protein, 414 aa, Moorella thermoacetica ATCC 39073
MSNITQLRCINCSRTYQPRPGFYTCPICGSTDGILDVEYDYDYINKSISRQSLASNREHSLWRYRPFLPVAQEGPLPPLRVGWSPLYRARRLGDELGLKELYIKDDGINPTGSLKDRPSAVAVARALAEGAKVVACSSTGNAASSLAGAAASVGLKAVIFVPGRAPQGKVAQLLIFGATVISVQGSYEDAFKLSAAAIAEHGWYNRNAAINPYLVEGKKTVCLEVAEQLNWEVPDWVVLSVGDGCTMAGAWKAWVDLKKAGWIDKLPRMLGVQAEGCCPITRAFREGTRVKPMPENTLADSIAVGVPRNPEKALRAVRDSGGTMINVSDEEILAAMRTLGRTSGIFGEPAGAAGTAGLIKAVQEGIIKSGDKVVVLVTGNGLKDVANAIKAAGEPIRVEPSLEALKEALARYGK

SEQ ID NO: 53625 - DNA, 1518 bp, Thiobacillus denitrificans ATCC 25259
  CDS (1)..(1518)
atgagccacccagacgactacctcgaacgcattctcacctcgcgcgtctatgacgtcgcgatcgaatcgccgctcgaggtcgcgcacaatctttcgcgtcgcctcgacaaccagatcctgctcaagcgcgaggacctgcagccggtgttctcgttcaagtgccgcggcgcgtacaacaagatggcgaagttgaccgccgcgcaactggcgcgcggcgtcgtcgcggcgtccgccggcaaccacgcgcagggcgtcgctttggcggccgaaaagctcggcgcgacggccaccatcgtcatgccggcgacgaccccgaggatcaaggtcgacgcggtcgcggcgcgcggcgcccgcgtgatcctgcacggcgacaactacgacgaagcctacgagcatgcgatgcagctggcgaaggaggcgaaggcgaccttcgtccatccctacgacgatcccgacgtgatcgcgggccagggcacggtcgcgatggagttgctgcgccagcacccgggcccgatccactccgtctacatcccggtcgggggcggcggtctgatcgcgggtatggccgcctacatcaagcggctgcggccgcagatcaagatcgtcggcgtcgagcccgaggacgccgacgcgatggcgcgttcgctgtgcaagaacacgcgcgtgacgctgccgcgcgtcggcatttttgccgacggcgtcgcggtaaaaaaggtcggcaaggaaaccttccggctggcgcagctctatgtcgacgaaatcatccgcgtgaacaacgacgcgatctgcgcagcgatcaaggacgtcttcgaggacacccgttcgatcctcgaacccgcgggcgcgctttcgatcgccggcatgaaagcggcgatcgccggtgacaggctgaaggggaagacgcttgccgccgtggcgtctggcgccaacatgaacttcgaccgcctgcgccatattgcggagcgcgcggaactgggcgagaagcgcgaagcgattctcgcggtgaccattcccgaaacgccgggcagcttcaagaccttctgcggcctgctcggcgcgcgcaacatcaccgaattcaactatcgctacgccgatccgcgtgtggcgcgggtgttcgtcggactgtccgtacccggtgagggcgagagcaagcgcgtcgtcgaactgctcgggcggcacggcctcgaagcgatcgatctgagcgacaacgaaatggccaagctccacatccgccacctggtcggcgggcgcgcgcccgacgcggtgaacgaggtgctgtaccgcttcgagtttcccgagcgcccgggcgcgctgatgcagttcctgcaaagcatgagccgcggctggaacatcagcctctttcattatcgcaaccacggcaccgactacgggcgcgtgctggtcggcatccaggtgccggacaaggaaaaaccggtctttcagaaattcctcgaaggcctcggctaccgctactgggacgagtcgcgcaacccggcgtacacgctcttcctgggctga

SEQ ID NO: 53626 - protein, 505 aa, Thiobacillus denitrificans ATCC 25259
MSHPDDYLERILTSRVYDVAIESPLEVAHNLSRRLDNQILLKREDLQPVFSFKCRGAYNKMAKLTAAQLARGVVAASAGNHAQGVALAAEKLGATATIVMPATTPRIKVDAVAARGARVILHGDNYDEAYEHAMQLAKEAKATFVHPYDDPDVIAGQGTVAMELLRQHPGPIHSVYIPVGGGGLIAGMAAYIKRLRPQIKIVGVEPEDADAMARSLCKNTRVTLPRVGIFADGVAVKKVGKETFRLAQLYVDEIIRVNNDAICAAIKDVFEDTRSILEPAGALSIAGMKAAIAGDRLKGKTLAAVASGANMNFDRLRHIAERAELGEKREAILAVTIPETPGSFKTFCGLLGARNITEFNYRYADPRVARVFVGLSVPGEGESKRVVELLGRHGLEAIDLSDNEMAKLHIRHLVGGRAPDAVNEVLYRFEFPERPGALMQFLQSMSRGWNISLFHYRNHGTDYGRVLVGIQVPDKEKPVFQKFLEGLGYRYWDESRNPAYTLFLG

SEQ ID NO: 53627 - DNA, 903 bp, Silicibacter sp. TM1040
  CDS (1)..(903)
atggtgaaaacgccaaccgtctcggttcagagctttggcctcgcatttccggtcgaattgaagctcgagcatctccagcatgcaggcagttttaaggcgcgcggtgcgtttaacacgctcctgtcgacccctgtccccgaagcaggtctggtggcggcctccggtggcaatcatggcgcggcggtggcctttgccgcccgcgctttgggtcacaacgccaagatctatgtccccgagattgcaggccagaccaagattgacctgatccgctcaaccggagcggagcttgaggtcgtgcccggcgcctatgccaatgcactcgaagcggcacaggattgggagctacaaacgggtgccatgcagatccatgcctatgacgcacccgcaacggtcgctggacagggcactttgtttgctgaatgggaggaacaggggctcgaggctgacaccattttgatcgcagtgggcggcggtggtctcatcggcggagcgctgggctggtttgagggccggcgcaaggtggtcgcagtagaacctgcaacctcttgcgcgctgaaaaccgcactgatgaatggcaaacctaccaatgttgacgttggcggcatcgctgccaatgccttgggggcgcgccgcattggagacatctgttttgaccttgcgcataacgcgcgcacgccaagcgtgattgtcccagatgctgccatcgaggccgcacaacacgcgctctggcgcgatcatcgcctcctggtggagcctgcaggggcaactgcgcttgcggctttgatgtgcggggcctatctgcctgcgcgtgatgaaaaggtttcggtgctcttgtgtggtggcaacattgacccagaaccgctgacggatcccgccacacgacttgatgtctcgttcaactaa

SEQ ID NO: 53628 - protein, 300 aa, Silicibacter sp. TM1040
MVKTPTVSVQSFGLAFPVELKLEHLQHAGSFKARGAFNTLLSTPVPEAGLVAASGGNHGAAVAFAARALGHNAKIYVPEIAGQTKIDLIRSTGAELEVVPGAYANALEAAQDWELQTGAMQIHAYDAPATVAGQGTLFAEWEEQGLEADTILIAVGGGGLIGGALGWFEGRRKVVAVEPATSCALKTALMNGKPTNVDVGGIAANALGARRIGDICFDLAHNARTPSVIVPDAAIEAAQHALWRDHRLLVEPAGATALAALMCGAYLPARDEKVSVLLCGGNIDPEPLTDPATRLDVSFN

SEQ ID NO: 53629 - DNA, 966 bp, Silicibacter sp. TM1040
  CDS (1)..(966)
atgaaggacaccgcaatgtatatcccaacctacgaggacatgctggcggcgcatcaacgtatcgcgccacacatccaccgcaccccggtgcgccagtccgcctacctcaacgaactgaccggcgcgcagctgtttttcaaatgcgaaaactttcaggagccgggggccttcaaggtgcgtggcgccaccaatgcagtctttggtctggacgcagcacaggcggccaagggcgtggcgacgcattccagcggcaaccatgcctcctgcctgtcctatgcggcgatgctgcgcggcattccctgcaacgtggtgatgccgcgcaccgcgccgcaggccaaaaaagacaccgtgcgccgctatggcgggaagatcaccgaatgtgagccctcgaccacctcgcgcgaggagacatttgcccgcgtacaggccgaaaccggtggcgattttgtgcatccctacaacgatcctcgggtgatcgctggccaaggcacctgcgccaaggagtttgtcgagcagaccgacgggcttgattgtgtgctcgcgccgattggcggcggcggcatgatttcgggcacctgtctgacgctgtcgacgctggcacccgaaacacggatcatcgccgccgagcccgagcaggctgatgacgcctaccgcagcttcaaggcgggctacatcattgccgatgatgcgcccaggaccatcgccgacgggctgctggtgccgctcaaggatctgacctggcattttgtgtcgaaccatgtgtccgacattctgaccgcatctgaccctgagatcatcgacgcgatgaagctcatctggaagcacctgcgcgtggtgatggagccctcctctgcggtgccgctcgccaccatcctgaaaaaccccgagacctttcgcggcaaacgcgttggcatcgttttgaccggtggcaatgtcgatctggatcgtctgccctggacgatttga

SEQ ID NO: 53630 - protein, 321 aa, Silicibacter sp. TM1040
MKDTAMYIPTYEDMLAAHQRIAPHIHRTPVRQSAYLNELTGAQLFFKCENFQEPGAFKVRGATNAVFGLDAAQAAKGVATHSSGNHASCLSYAAMLRGIPCNVVMPRTAPQAKKDTVRRYGGKITECEPSTTSREETFARVQAETGGDFVHPYNDPRVIAGQGTCAKEFVEQTDGLDCVLAPIGGGGMISGTCLTLSTLAPETRIIAAEPEQADDAYRSFKAGYIIADDAPRTIADGLLVPLKDLTWHFVSNHVSDILTASDPEIIDAMKLIWKHLRVVMEPSSAVPLATILKNPETFRGKRVGIVLTGGNVDLDRLPWTI

SEQ ID NO: 53631 - DNA, 1284 bp, Silicibacter sp. TM1040
  CDS (1)..(1284)
atgcgtgaaacgctgcgccctcttgccttgggcgtggctttgggtcacgaaatccatatgaccaacttcagaacccaggccaaagcggccgaggcggcgatgcgcgatgtcttcccgcccacgccgctgcaacgcaacgaactcctgtcgcagcgctttggtgcggagatttacctcaaacgcgaggatctcagcccggtgcgctcctacaagattcgcggcgcgctcaacgcgatgcgaaagcagaccagcaaggatctgtttgtctgtgcttcggcgggaaatcacgcgcagggcatggcttacatgtgtcggcaaatggacaaacggggtgtgatctttatgccggtgaccacacctcagcagaagatccagaagacccgcatgtttggcggtgacaacgtcgaggtgcatctgatcggggattacttcgacgatacattgtccgccgcgcaggcgtggtgcgcagaaaaaggagggtatttcctctctccttttgacgacgcggatgtcatcgaaggtcaggcatcaatcgcagtggaaatcgaggcgcaactcggcaaggcgccggatcatatcgttctaccggtgggcggcgggggtatgtcctctggcgtggttcggtattttggcgaggatgtgcatgcgcttcttgtggagcctgagggcggcgcctgcctgaaggcggcgcttgaggcaggtcatcccacaccgctcaaccgggtggatacctttgtggacggcgccgccgttggcaaaattggcgagcggccttttgatattttgcgcagcgtgccgttgccggatgtcctgactgtgtcagaggaccggatctgcaccaccatcctcgagatgctcaatgtcgaaggtatcgttctggaacctgcaggcgcgctcgccgtcgaggcgctgggcgacctgcgcacatggattaagggtaagaccgtggtttgtctgacttccggcgggaactttgatttcgagcgactgccagaggtcaaggaacgggcgcagcgctattccggggtgaagaaatacttcctgctgcgcctgccgcaacgtcccggcgcgctcaaggaattcctgaacattcttgggccggatgatgacatcgcacgttttgaatacatgaagaagtctgcgcgcaacttcggctcggtcctgatcgggatcgagaccaagcgcccagagaacttcgcgccgctgtttgcgcaactggatgcggcgggtttcacctacaccgacatcacaaatgacgagacactggcgcagttcgtgatctga

SEQ ID NO: 53632 - protein, 427 aa, Silicibacter sp. TM1040
MRETLRPLALGVALGHEIHMTNFRTQAKAAEAAMRDVFPPTPLQRNELLSQRFGAEIYLKREDLSPVRSYKIRGALNAMRKQTSKDLFVCASAGNHAQGMAYMCRQMDKRGVIFMPVTTPQQKIQKTRMFGGDNVEVHLIGDYFDDTLSAAQAWCAEKGGYFLSPFDDADVIEGQASIAVEIEAQLGKAPDHIVLPVGGGGMSSGVVRYFGEDVHALLVEPEGGACLKAALEAGHPTPLNRVDTFVDGAAVGKIGERPFDILRSVPLPDVLTVSEDRICTTILEMLNVEGIVLEPAGALAVEALGDLRTWIKGKTVVCLTSGGNFDFERLPEVKERAQRYSGVKKYFLLRLPQRPGALKEFLNILGPDDDIARFEYMKKSARNFGSVLIGIETKRPENFAPLFAQLDAAGFTYTDITNDETLAQFVI

SEQ ID NO: 53633 - DNA, 1002 bp, Rickettsia akari str. Hartford
  CDS (1)..(1002)
atgactttattactacaatcttctcaaaatgtagctactgcacatactagaataaaacaatatctacatttaactccaatcgttcactctgaaagcttaaatgagatgctcggtcatgagattttttttaaggttgaatcattacaaaaaaccggtgcattcaaagttagaggagtattaaatcatttattagaattaaaagagcaaggcaaattacctgataaaatagtctgttatagtacgggtaaccatggggttggtcttgcttatgcaagtaaattattcggtcttaaaacaaggatttatttaccgttaaatacttcaaaagtaaaacagcaagcagctctttattacggcggtgaagttatatatacatatactcgacaagaagcagaagaaaaagcaaaagaagatgaaaagcaaggattttactatatacatccttccgatagtgattctacaatagcaggagcaggcactttatgctatgaagcattacagcagctaggctttagtcctgatgctatttttgcctcttgcggcggcggcggtttaatttccggctcataccttgccaaggaattaatatcaccgataagcttgttaataggttcagaaccgcttactgctaatgatgcttatttatcggttaaaaataataagatatataaatttgataaggcaccgactaccatcgcagacggtcttaaaaccttaagtgtatcagcccgtacatttgaatatctgaaaaaacttgatcatttttatttagcagaagaatatgaaatatattactggacggcgtggcttactaatttacttaaagttatatgcgagccgtcaagtagtataaatatggtgtcagtggtgaattggttaaaaatacaatccaaacctcaaaaattactggtactaatctcaggcggtaatatagaccctattctttataacgaactatggaaagaggagtatttaaccgttccaccaagtattactaactaa

SEQ ID NO: 53634 - protein, 333 aa, Rickettsia akari str. Hartford
MTLLLQSSQNVATAHTRIKQYLHLTPIVHSESLNEMLGHEIFFKVESLQKTGAFKVRGVLNHLLELKEQGKLPDKIVCYSTGNHGVGLAYASKLFGLKTRIYLPLNTSKVKQQAALYYGGEVIYTYTRQEAEEKAKEDEKQGFYYIHPSDSDSTIAGAGTLCYEALQQLGFSPDAIFASCGGGGLISGSYLAKELISPISLLIGSEPLTANDAYLSVKNNKIYKFDKAPTTIADGLKTLSVSARTFEYLKKLDHFYLAEEYEIYYWTAWLTNLLKVICEPSSSINMVSVVNWLKIQSKPQKLLVLISGGNIDPILYNELWKEEYLTVPPSITN

SEQ ID NO: 53635 - DNA, 1236 bp, Chloroflexus aurantiacus
  CDS (1)..(1236)
atgagccgattcgcaattgaactggccgatattcagtctgcacggcgggcgttgcgggatattatcctacccacgccagtattgccggcaacccgcctgagtgctgaactgggtgggtcaattttttacaaggctgaaaatacccagcagagtggttcgttcaaaattcgtggtgcttacaacacgatcattcatctgtcacctgaagagaaacaacgcggcgtgattgcaccgtctgccgggaatcacgctcagggtgtcgcgcaggcagcccagttattgggggtaaaagcaacaattgtgatgcctgagcgcgctccattgaccaaagtggtggcaacccgccggttgggcgccgaggtcattctgcacggcgccaccttcgatgatgcgatggcctacgcacacgctctcaaagaagaacgtggcttaacctacgtccatgccttcgatcatccacgggtgattgcaggtcagggaacgattggcctggaactggttgaagccctgcccgatttaaaccaactggtcgtaccaatcggcggtggtggcctgatcagcgggattgccctggccgtgaagacattgttgccgcacgtgcgtatcatcggtgtgcaggctgccggctgtgcgccggtgccggcctcgctcgccgccggtcatccggtgacggcaccgactgcgcatacgattgcagatggtattgccgtgaagcgtcccggcgaactcaccctgccgatgatccaggccctggttgatgacgttgtcaccgttgatgacgaagagattgtgatggcaatcgcgcacgtgttgcaatacagtcgtctggtggtcgagggagccggcgccgcaggtgttgctgccctgctcagtggtaaggtgccggtacaaccacaccaggtgacggcgacgatcctttgcggtgggaatatcgatgcgaatctgctgatgcgggtgattgagtatgccctggttcgccagggacgctacctcttgctccgcaccagcgtcgatgatcgtccgggcggcctggccggcctggtcaatcacgttgcctcgaccggtgccagcgtcatggatctcttccatcgccgtgggatgtggcgagtgccaatcgaccgtgccggcgttgaactcatcctcgaagtccgtgatgaagaacacgctcagatggtcatcaattctctcgaacaggccggctaccattgcgagcgcgaaccgaactggccgatataa

SEQ ID NO: 53636 - protein, 411 aa, Chloroflexus aurantiacus
MSRFAIELADIQSARRALRDIILPTPVLPATRLSAELGGSIFYKAENTQQSGSFKIRGAYNTIIHLSPEEKQRGVIAPSAGNHAQGVAQAAQLLGVKATIVMPERAPLTKVVATRRLGAEVILHGATFDDAMAYAHALKEERGLTYVHAFDHPRVIAGQGTIGLELVEALPDLNQLVVPIGGGGLISGIALAVKTLLPHVRIIGVQAAGCAPVPASLAAGHPVTAPTAHTIADGIAVKRPGELTLPMIQALVDDVVTVDDEEIVMAIAHVLQYSRLVVEGAGAAGVAALLSGKVPVQPHQVTATILCGGNIDANLLMRVIEYALVRQGRYLLLRTSVDDRPGGLAGLVNHVASTGASVMDLFHRRGMWRVPIDRAGVELILEVRDEEHAQMVINSLEQAGYHCEREPNWPI

SEQ ID NO: 53637 - DNA, 993 bp, Chloroflexus aurantiacus
  CDS (1)..(993)
atgtctaccgagaaaaccattacccctgccgacatcctggctgctcgccgtcgcatcagcggtatcgttcaaccaactccgcttgaggtgagtcgccccttgagcgccctgaccggtgccgaggtctggttgaagctggaactggcacaggtgaccggcagttttaagctgcgtggtgcagccaatgctctgcgccagttaccacctgccacgcatgtcgtggcctgctcggcgggcaatcacgcgctcggtgttgcccataccgccgcgttgaccggtacgccggccaccctggtggtgccgacaaccgcctcgccggcgaaggtcaccgcattgcgacgctatccggttgaggtgatattgcacggtgccggctacgacgaggctgaaaccgaagcgctccggctggcagcccaccacggctggcattttgtgtcaccctacaacgacccggcagtgattgccgggcagggaacgctggcaattgaggtctgggacgcattgcccgacgtcgatatggtggtagtcgcggtcggtggcggtgggttagccagcggcgttggtatctgggccagagcgatgaacccgcgcgtccgcatcattggcgtacaggcagccgcttccgcggcaatggcggcggcgttgcgggccgggcgggtcgttccggcacctgatgaaccaacgctggccgacggtctggctggaggtatcgccagcgataccatcacgctcccgatcctgcaacaggttttagacgagatgatcctggtcgaagaggcagctattgcccgcgctatgcgctggttaatcgacgaacaccatctgattgtagaagggagtgctgcggtgacggtggcagccctgctcgaaggtcagatcacccatcttgtcggcaaacggatcgtggcactgctctgcgggcgtaatgttgccatttccaccttgcaccacattctcgcagttccgcccaaagacggagcatcatcccattga

SEQ ID NO: 53638 - protein, 330 aa, Chloroflexus aurantiacus
MSTEKTITPADILAARRRISGIVQPTPLEVSRPLSALTGAEVWLKLELAQVTGSFKLRGAANALRQLPPATHVVACSAGNHALGVAHTAALTGTPATLVVPTTASPAKVTALRRYPVEVILHGAGYDEAETEALRLAAHHGWHFVSPYNDPAVIAGQGTLAIEVWDALPDVDMVVVAVGGGGLASGVGIWARAMNPRVRIIGVQAAASAAMAAALRAGRVVPAPDEPTLADGLAGGIASDTITLPILQQVLDEMILVEEAAIARAMRWLIDEHHLIVEGSAAVTVAALLEGQITHLVGKRIVALLCGRNVAISTLHHILAVPPKDGASSH

SEQ ID NO: 53639 - DNA, 1518 bp, Chloroflexus aurantiacus
  CDS (1)..(1518)
atgcccaaccctgattttacctacgttcaacgcatcctgaccagtcgggtctatgatgttgtcaaagagaccccattgcaacatgcgcctcttctcagcgcccgcctgggagcacagatatttttcaaacgtgaggatctgttgcccatcttctcttttaagctccgtggtgcctataaccgcatggctcatctcagtcctgccgagaaagaacgcggcgtcatcacagcctctgccggcaatcacgcccagggagtcgccttttctggccagcagctcggcgtgcgcacgctgattgtcatgccggcaaccaccccagagatcaaggtggcagcctgtcggcgtcggaatgcagaagttgtcctgtacggcgacagctatagtgacgctgaagcgcacgcctaccgcttacagcaagaattgggcttaaccttcatccatccctacgacgatccgctggtgattgccggtcagggtacgattgggctggagatttcccaacagatgcgcgccgagcgataccgtgtcttcgtgccggtaggtggcggcggtctgattgccggcatcgcgatcttcttgaagagcatcaatcccaatattgagatcattgccgtcgagccagatgactctgatgcgatgtaccagagcgtccgggccggctatcgggtcacccttgatcaggtcggaatctttgttgatggcgtggcagttcggcgggttggcgaacacacctttgcgattgttcagcgctacgtcgatgattttgtgcgggtgacaaccgacgaggtctgtgcggcgatcaaagatgtctttgaggacacccgggccattatggagccagccggcgcgctggccgtcgccgggttaaagcgctatatcgccgaacacggggccgatctaccggcagtagccttaacgtgtggcgctaacatgaactttgaccgtctgcgccacgttgccgaacgggccgaaattggcgaacggcgtgaggcgttgtttgctgtgaccatccctgaacgacccggctcattcaagcaattttgtcgcgtgatcggaccacacaatatcaccgaattcaactaccgctatgcaccgcgccccgaagccaatgtctttgtgggtgtacaactgaccaatgccaatcagcgccacgagctggccgaacgtatgcgcaacgccggttatacggtgcttgacctgaccaacgacgagctggcaatcattcatctacgccacatggttggtggacgagcacccgaagcaaccgacgaacggctcttcaccttcgagttcccggagcgaccgggagcgctcttgcaatttctcgagtcgctcgatgcctcgtggaacatcagcctcttccactaccgcaaccatggcagcgcccatgggcgggtactggccggtattcaggtgcccgatgccgatctcgaccgtttctacgcctcactggctcgcctgggatacccgtatcaggagcagagtgataatccggcgtaccacctgtttttgaaatga

SEQ ID NO: 53640 - protein, 505 aa, Chloroflexus aurantiacus
MPNPDFTYVQRILTSRVYDVVKETPLQHAPLLSARLGAQIFFKREDLLPIFSFKLRGAYNRMAHLSPAEKERGVITASAGNHAQGVAFSGQQLGVRTLIVMPATTPEIKVAACRRRNAEVVLYGDSYSDAEAHAYRLQQELGLTFIHPYDDPLVIAGQGTIGLEISQQMRAERYRVFVPVGGGGLIAGIAIFLKSINPNIEIIAVEPDDSDAMYQSVRAGYRVTLDQVGIFVDGVAVRRVGEHTFAIVQRYVDDFVRVTTDEVCAAIKDVFEDTRAIMEPAGALAVAGLKRYIAEHGADLPAVALTCGANMNFDRLRHVAERAEIGERREALFAVTIPERPGSFKQFCRVIGPHNITEFNYRYAPRPEANVFVGVQLTNANQRHELAERMRNAGYTVLDLTNDELAIIHLRHMVGGRAPEATDERLFTFEFPERPGALLQFLESLDASWNISLFHYRNHGSAHGRVLAGIQVPDADLDRFYASLARLGYPYQEQSDNPAYHLFLK

SEQ ID NO: 53641 - DNA, 975 bp, Polaromonas sp. JS666
  CDS (1)..(975)
atgctgcaacttcccgtttacgacgacgtcctcgccgcagccgcgcggcttgagggccacgcgcaccgcacgccggtactgacctccgccacggccgatgcccgctggggttcccagtttttcttcaagtgcgaaaacttccagcgcatgggggcgtttaagttccgtggagcgttcaatgcgctgtcaaagttcgacgcgggccagcgccgggccggggcgatcgcgttttcgtcgggcaaccatgcacaggcggtggcgctgtcggcgcggctgctcggcatgcccgcgttgatcgtgatgccgcaggacgcaccggctgccaagctggccgcgacgcgtggctacggcgccgaggtggtgctgtacgaccgcttcagcgaagaccgcgaggcgctcacgcagcggctggcggccgagcggggtatgaccctgattccgccctatgaccatcccgacgtgattgccggccagggcacggccgccaaggaactgcttgaagagaccggtccgctcgaccgcctgtatgtctgcctgggcggtggcgggctgaccagcggctcggcgctggccgcgcgggccctggcgccgcaatgcaaggtgtatggcgtggagcccgaagccggcaacgatggccagcagtcgctgcgcgcgggccggattgttcatatcgaaacgcccaagaccattgccgacggtgcgcaaacccagcatctgggtcagtacaccttcggcatcattcgacgcgatgttgatgacatcctcacggtgagcgacgcgcagctggtcgaggccatgcgcttttttgccgagcgcatgaagatggtggttgagcctaccggttgcctggcgtttgccggggcctgcgcggcgcttgaagcggacgcggccctcaagggcaggcgtgttggcgtcatcgtgagcggcggcaatgtcgacctggcgcgctacgcggagctgctggctgcacgctga

SEQ ID NO: 53642 - protein, 324 aa, Polaromonas sp. JS666
MLQLPVYDDVLAAAARLEGHAHRTPVLTSATADARWGSQFFFKCENFQRMGAFKFRGAFNALSKFDAGQRRAGAIAFSSGNHAQAVALSARLLGMPALIVMPQDAPAAKLAATRGYGAEVVLYDRFSEDREALTQRLAAERGMTLIPPYDHPDVIAGQGTAAKELLEETGPLDRLYVCLGGGGLTSGSALAARALAPQCKVYGVEPEAGNDGQQSLRAGRIVHIETPKTIADGAQTQHLGQYTFGIIRRDVDDILTVSDAQLVEAMRFFAERMKMVVEPTGCLAFAGACAALEADAALKGRRVGVIVSGGNVDLARYAELLAAR

SEQ ID NO: 53643 - DNA, 1647 bp, Polaromonas sp. JS666
  CDS (1)..(1647)
atgatgttggactgcgagaaaaacatgccaacccacaccccccctgctgcctacccctcccctcaagcggccaaaaccgcacgcaaagtgtctgcgcaaggcctcacgcccgcggattacctgaagaaaatcctcaccgcgcgcgtctacgacgtcgcgctggaatcggccctggagcccgccaaaaacctgggccgccggctgaacaacaccgtgctgctcaagcgtgaagaccagcagcccgtcttcagcttcaagctgcgcggcgcctataacaagatggcgcacctcagcagcgcccagctcaagaaaggcgtgatttgcgcctcggccggcaaccatgcccagggcgtggccctgagcgcgcaaaaactcggcacccgcgccgtggtggtgatgccgacgaccacgccacaggtcaagatcgatgcggtcaagggctggggcgcagaagtggtactgcacggcgacagctactcggatgcctacgcccacgccgtgctgctggaaaaaaagcgtggattgacctttgtacatcctttcgacgacccggacgtgattgccggccagggcacgattgcgatggaaatcctgatgcagctgcaaagcctggggtcgcgccggctggacgccgtgtttgtcgccattggcggcggcggcctgattgccggggtggccaactacatcaaggcggtgcgacccgagatcaaagtcatcggcgtgcagatgaacgactccgacgcgatgatgcagtcggtgaccgcgaaaaagcgcgtcaccctgaatgacgtgggcctgttttcagacggcacggccgtcaagctggtgggcgaggaaacctttcgcatcagccgcgaactggtcgacgaattcatgaccgtggacaccgatgcggtgtgcgccgccatcaaggacgtgtttgtggacacgcgcagcatcgtggagcctgccggcgcgctggccgtggccgccatcaagcagtacgtggccacgcacaagaccaaaggggaaacctacgcagccattttgtgcggcgccaacatgaacttcgaccgcctgcgctttgtggccgagcgggctgaagtgggcgaggaacgcgaggcgctgtttgccgtgacgattcccgaagagcgcggcagcttccggcacttttgcgaactgattggcgagttgcccggcggcccgcgcagcgtgaccgaattcaactaccgcatcagcgacgacgagaaagcccatgtctttgtgggcctgaccacctcggccaagggcgagagcagcaagatcgcggccaacttctcccgccacggcttcaaggcgctcgacctcacgcatgacgagctcgccaaggaacatatccgccacatggtgggcgggcacagcgcactgtccaaggacgaacgcctgctgcgcttcatctttcccgagcggcccggcgcgctgatgaaatttttgtccagcatgcagccgggatggaacatcagcctctttcactaccgcaaccagggcgccgactacggccgcatcctggtgggcctgcaggtgcccaaggccgacaacaaggccttcaaggccttcctggacaccctgggctacccccacgtggaagaaaccgacaaccccgtctaccggctgtttctgcagagctga

SEQ ID NO: 53644 - protein, 548 aa, Polaromonas sp. JS666
MMLDCEKNMPTHTPPAAYPSPQAAKTARKVSAQGLTPADYLKKILTARVYDVALESALEPAKNLGRRLNNTVLLKREDQQPVFSFKLRGAYNKMAHLSSAQLKKGVICASAGNHAQGVALSAQKLGTRAVVVMPTTTPQVKIDAVKGWGAEVVLHGDSYSDAYAHAVLLEKKRGLTFVHPFDDPDVIAGQGTIAMEILMQLQSLGSRRLDAVFVAIGGGGLIAGVANYIKAVRPEIKVIGVQMNDSDAMMQSVTAKKRVTLNDVGLFSDGTAVKLVGEETFRISRELVDEFMTVDTDAVCAAIKDVFVDTRSIVEPAGALAVAAIKQYVATHKTKGETYAAILCGANMNFDRLRFVAERAEVGEEREALFAVTIPEERGSFRHFCELIGELPGGPRSVTEFNYRISDDEKAHVFVGLTTSAKGESSKIAANFSRHGFKALDLTHDELAKEHIRHMVGGHSALSKDERLLRFIFPERPGALMKFLSSMQPGWNISLFHYRNQGADYGRILVGLQVPKADNKAFKAFLDTLGYPHVEETDNPVYRLFLQS

SEQ ID NO: 53645 - DNA, 1203 bp, Polaromonas sp. JS666
  CDS (1)..(1203)
atgctcagtctgaccgatattgaacaagccgcccagcgcctgcagggccatttgctggataccccctgcgtggagtccaggacgctgtcacagctgaccggggcgcagatttacctgaaatttgaaaacctgcagtacacggcctctttcaaggagcgtggcgcctgcaacaaacttgcgcaactctcaggcgacgaacggcgccgcggcgtgatcgcgatgagcgccggcaaccatgcccagggtgtggcttatcatgcccagcgcctgggcctgagggccgtcatcgtgatgccgcgcttcacgcccggcgtcaagaccgagcgtacccgcggctttggcgcggaggtggtgctgcacggcgacacgctggaggagtcgcgcgcccacgcgctgatgctggccgagcgcgagggcctggtgtttgtgcacccctacgacgacgaagctatcgtggcgggccagggcaccgtggggctggaaatgctgcacgccgtccccggcctggacacgctggtcgtcgccgtgggcggcggcgggctgatcgcgggcatggccatcgccgccaaggccctgaagcccgagattgaaatcgtgggggtgcagacctcgcgctttccggccatggtcaacgccatcaagggcacgcaccacccgcagggcaccagcaccattgccgagggcatcgccgtgggcacgccgggggtcatcccgcaagccatcattgaaaagctggtggacgacctggtgctggtcgatgaaggggatatcgagcaggccatggtgatgctgctggaaattgaaaaaaccctggtcgagggtgcgggcgcggccggcttggcggcggtgctcaaatacccggcgcgctttgccggcaagaaagtcgggctggtgctgtgcggcggcaatatcgacccgctgctgctggcggccatcatcgagcgcggcatggtgcgcgccgggcggctggcccgcatcaaggtcagcgtgcgtgacgtgccaggctcgctggccaagatcaccgcgacggtagccgatgcgggcgccaacatcgacgaggtacaccaccagcgcgccttcaccacgctgtcggtccagaatgtggagatcgagctggtgatccagacgcgcgggcgcgagcacatcgcgcaggtgctggcggcgctggccgcagccggatttgaggcgtccgagcagcactga

SEQ ID NO: 53646 - protein, 400 aa, Polaromonas sp. JS666
MLSLTDIEQAAQRLQGHLLDTPCVESRTLSQLTGAQIYLKFENLQYTASFKERGACNKLAQLSGDERRRGVIAMSAGNHAQGVAYHAQRLGLRAVIVMPRFTPGVKTERTRGFGAEVVLHGDTLEESRAHALMLAEREGLVFVHPYDDEAIVAGQGTVGLEMLHAVPGLDTLVVAVGGGGLIAGMAIAAKALKPEIEIVGVQTSRFPAMVNAIKGTHHPQGTSTIAEGIAVGTPGVIPQAIIEKLVDDLVLVDEGDIEQAMVMLLEIEKTLVEGAGAAGLAAVLKYPARFAGKKVGLVLCGGNIDPLLLAAIIERGMVRAGRLARIKVSVRDVPGSLAKITATVADAGANIDEVHHQRAFTTLSVQNVEIELVIQTRGREHIAQVLAALAAAGFEASEQH

SEQ ID NO: 53647 - DNA, 1008 bp, Polaromonas sp. JS666
  CDS (1)..(1008)
atgagcaccacgctgcacggcacgcccacggtcaccccgcgggccgatggccttccttcgctgcgcgccatcgaagaggcggccggcgtggtctaccgggagttccaggccacgccgcaataccgctggggcctgtccagccagcggctgggcaccgactgctggatcaagcacgagaaccacacgccggttggcgccttcaagatccgcggcggcctcacctactttgacgccctgaaaaaaagcggcacgctccccctcgaggtcatcagcgccacacggggcaaccacggccagagcataggctgggccgcccgcgcccatggtgtggcctgcaccatcgtcgttccgcacggcaattcgatcgagaagaatgcagccatgcgtgcgctcggcgtgacgctgatcgagcacggccaggacttccaggagagccgcgaatttgccatccagctggccgccgaacgcggcgcccacatggtgcccagctttcacgctgacctgctgcgcggcgtggctaccagctggtgggaattcatgcaggccgtgccgcagctggacgtggtgtacgtgccgattggccagggctccggggcctgctcggccattgccgccaaactggcgctcggacgtaagctgcgcatcgtcggcgtggtgagcgcgcatgccaccacctacgccgattccctggcggcaggccgcgtggtcgaggcaccggtgacaacccggctggccgacggcatggcctgtcgtatcgcggaccctgcggcgctcgaactcatggcgccccatatcgaccacctggtgcaggtcaccgatgacgaggtcgcgcaggcgatgcgcgatctgtatgcggacacgcacaacgtggccgaaggggcaggcgcggccagctttgccgccgccatgcaggagcgcagcgagctcaagggacaggtggtcggcaccacgctgtgcggcagcaatgtggacagcaccacgctggccagcgtactcggggcctgctga

SEQ ID NO: 53648 - protein, 335 aa, Polaromonas sp. JS666
MSTTLHGTPTVTPRADGLPSLRAIEEAAGVVYREFQATPQYRWGLSSQRLGTDCWIKHENHTPVGAFKIRGGLTYFDALKKSGTLPLEVISATRGNHGQSIGWAARAHGVACTIVVPHGNSIEKNAAMRALGVTLIEHGQDFQESREFAIQLAAERGAHMVPSFHADLLRGVATSWWEFMQAVPQLDVVYVPIGQGSGACSAIAAKLALGRKLRIVGVVSAHATTYADSLAAGRVVEAPVTTRLADGMACRIADPAALELMAPHIDHLVQVTDDEVAQAMRDLYADTHNVAEGAGAASFAAAMQERSELKGQVVGTTLCGSNVDSTTLASVLGAC

SEQ ID NO: 53649 - DNA, 942 bp, Polaromonas sp. JS666
  CDS (1)..(942)
atgaccaaccgccatcaaatcgagaactgcctgggcgcgttcaatcaggattaccgccactttattcgtcaaacgccgctgtggaaactgcccggcaaggcgctgggcgtggcctgcgcggaagtctggctcaagctggagcacctgcagacgggcggcagcttcaaggcgcgcggcatgctcaaccggctgctgtccaatccgataccgcccagcggggtgatcgtcgcgtcgggcggcaatgccggcattgccaccgcggcagccgccaaagagctgggtgtgcactgcgaggtgtttgtgcctgaagtgtccagcccggccaagcgcgcccgtctcgccgcgctgggctcccgggtcgtggtcacgggcgcggcttacgccgacgcgctgcaggcctgcctggcgcgccagcaggaaaccggcgcgctgctcacgcatgcctatgaccagcccgaagtgctcacgggggccggcacgatggcgctggagatcgagcagcagggcggcctgcccgatgccgtgctggtcagcgtcggcggcggtggcctgattggcggcgtggccagctggtttgaacagcgctctagagtggtggcgctggagcctgaactggcgccaacgctgttcaaggcccgcgaagccggcgagccggtggacgtggccatcagcggcattgcagccgactcgctgggcgccaagcgcattggcagcatggcgtgggacgcgacccaggcccatgtgcgcgatgcgctgttgctcagcgacgaatccatccgggcggcgcagttgtggctctggaacgaactgaaactggccgttgaacccgccgccgcgttgccgctggccgcgttgcacagcggccgctacgtgccgcgcaccgatgaaaaggtctgcctcatcatttgcggcgccaacctggacccagcgtcgcttgtctga

SEQ ID NO: 53650 - protein, 313 aa, Polaromonas sp. JS666
MTNRHQIENCLGAFNQDYRHFIRQTPLWKLPGKALGVACAEVWLKLEHLQTGGSFKARGMLNRLLSNPIPPSGVIVASGGNAGIATAAAAKELGVHCEVFVPEVSSPAKRARLAALGSRVVVTGAAYADALQACLARQQETGALLTHAYDQPEVLTGAGTMALEIEQQGGLPDAVLVSVGGGGLIGGVASWFEQRSRVVALEPELAPTLFKAREAGEPVDVAISGIAADSLGAKRIGSMAWDATQAHVRDALLLSDESIRAAQLWLWNELKLAVEPAAALPLAALHSGRYVPRTDEKVCLIICGANLDPASLV

SEQ ID NO: 53651 - DNA, 1212 bp, Campylobacter lari RM2100
  CDS (1)..(1212)
atggttgaattaaataaaatttatcaagcaaaacagaaaatcgcagattttgtattaaaaaccccttttgtacactcttcttttttgagtgagtttttagaaactgatgtttttttaaaatgtgaaaatttgcaaaaaacaggtgcttataaaatcagaggagcttataatacaatagctaatttaactaaagaacaaaaacaagcaggcgtaatagctgcaagtgcaggaaatcacgcacaaggagtagcaattagtgctaaaaaatttggcatagaagctgtgattgttatgcctgaagccacgcctttgttaaaagtaagtgcgactaaaaatttaggtgcaaaagtgattttaaaaggagataattttgatgaggcttatgcttatgcactaaattatgccaaagaacatcatttaaatttcattcatccttttgaaaatgaaagtattatagcagggcagggtactttaatgcttgaaatgcttgatgaaataagtgatttagatatgattttagctccagttggtggaggaggtttgattagtggagtggcaagtgctgctaagcaaattaatcctgctataaaagtcattggagtgagtgctaaaggagctcctgcgatgtatgagagttttaaaagtaaaaaaatgattaactcaaaagctgttagaactatagctgatggtatagcagtgcgtgatgtgaataaaattaattttgatattattcttgaatgtgttgatgattttattcaagttgatgatgaggaaatagctaatgcggtattgtatttacttgaaaaacataaaatcacagttgagggagcaggcgcatcagcagtagctgcgcttttgcataaaaaaatagatttaaaaaatcataaaaaaattggcgtgattttaagtggtggaaatatcgatgtgcaaatgttaaatatcattatagaaaaaggcttgtttaaagcttttagaaaaatgcttattaatgttactttgattgataaaccaggggctttgagtgctttgagtgatgcgatcaaagaagcgcaggctaatatagttaaaattgattatgatagattttcaactaaactcgaatacggcgatgcaatgatttcaatcactttagaaaccaaaggaaaggaacatcaagaattagttagaaaaatactttatgataaaggttttaattttaatgaaattttatga

SEQ ID NO: 53652 - protein, 403 aa, Campylobacter lari RM2100
MVELNKIYQAKQKIADFVLKTPFVHSSFLSEFLETDVFLKCENLQKTGAYKIRGAYNTIANLTKEQKQAGVIAASAGNHAQGVAISAKKFGIEAVIVMPEATPLLKVSATKNLGAKVILKGDNFDEAYAYALNYAKEHHLNFIHPFENESIIAGQGTLMLEMLDEISDLDMILAPVGGGGLISGVASAAKQINPAIKVIGVSAKGAPAMYESFKSKKMINSKAVRTIADGIAVRDVNKINFDIILECVDDFIQVDDEEIANAVLYLLEKHKITVEGAGASAVAALLHKKIDLKNHKKIGVILSGGNIDVQMLNIIIEKGLFKAFRKMLINVTLIDKPGALSALSDAIKEAQANIVKIDYDRFSTKLEYGDAMISITLETKGKEHQELVRKILYDKGFNFNEIL

SEQ ID NO: 53653 - DNA, 1038 bp, Leuconostoc mesenteroides
  CDS (1)..(1038)
atgacgactgagggaaagctaacggctgaagaaatagatgaggcgcatcgagtcttgtcaaaggtagtaacgcatacgccattggcatatgatgactatctatcaaaaaaatacagagctaatgtgtatcttaaacgagaagatatgcaacgggttcgttcgttcaaaattcgtggtgcctactacaatatcattaaggcagagaaagaaaaactcaataatggggttgttgctgcttcagctggaaaccacgcgcaaggcgtagccgatacatgtcataatttaaagatacaagcaactatttttatgccagtcactacaccaaatcaaaaagtagaagcggttaaacgttttggtagtcaatatgttacggtaatcctagtcggtgatacctttgacgaagcacaaagtgcagcgtttgaatacactgaaaaacataatatgttctttgtagcaccatttgatgatcggcgtaccatggctgggcaaggcacggtggcggttgaggtatttgaagatgctgtagagcaaaatattaatgttgattatttgattgcttctgttggtggtggcggtttaatcggtggtctgtcgacctattctaaaaaggtatcaccacaaaccacagtagtaggtgtcgaaccagaaacggcacagtcaatgaaagcggattttcaagctcaaaaacctaccaccgtcgagaatattgatcactttgttgatggtgctgccgttgcgcgtgtcagtcagtttacctataatcaagcacagcagtatgttgacaaactgctggctatccctgaaggaaaggttgctcaagcagtattagacttgtacacttatgaggcgatagttgccgaaccagctggagcgatgcctatcgctagtttggattttatggccagtgatatcgtagggaaaaacgtcgttctagttgtttctggtggaaacaatgatatcggccgtatgcaagaaatggaacaaaaggcattaatgtataagggtcgccaacagttttacttagttgagtttccgtaa

SEQ ID NO: 53654 - protein, 345 aa, Leuconostoc mesenteroides
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVTTPNQKVEAVKRFGSQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKADFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFP

SEQ ID NO: 53655 - DNA, 1500 bp, Caenorhabditis elegans
  CDS (1)..(1500)
atggttgctccatctcgaaagaagtcgattattcatcatcatgatcactctcatgaatcaacacctcaaaaaactcaccatcatcgagtgaagcaggctgaacgtaaacggacagcaagcatcagtaaagaagatggaatggaatataacaaaagagttcgaaagcttcataaggcattcttaacccatggagccgagtccccacatgttgatgataaacagacttctggaagtaacagtgatactgaagctccacttttcgatccggattgtgatccagagaacccaaagaaattgaaattttctgatatttcaagtgctgcatttaacattaaaaatggagttcaaacaacaccatgtgtgcgatctcttcaactgtcatccaagtgtgaaatggacctttatttcaaaaaagaatatctgcaagtgacaggatcattcaaagaacgaggagcaagatacgctctttcaaaaatggctgagcaattcaaaaaagcaggagtgatcgctgcgagcgcaggaaatcatgctctagctctcagttatcatggacaacaaatggggattccagtgacagtggtcatgcctgttattgctccacttatgaaaattcaattctgcagaagcttgggagcaacagttattctcaagggagagagtattgcagtggccaaggactttgcacttcgtcacgctaaagagaatcacttaaagtacattaatggttatgatgcaattgatattcttgctggacaaggaacaattggacttgaaattcttgatcaagttccagatgttgatacaattcttgtaccagttggaggtggtggattaattgctggaatcgcaacagctgttaagacattgaagccggatgttcatatttatggaattgaatcagaaacctgcccatcgttcactgaagcatatgaagctggccatataataacttcccaggccaaagcgtcacttgctgatggtctcgccgttcccacagtcggcggaaattctttggagacagcaaaaggcttggttgataaggttatcacagtgaaagaagaaagcattgcgctgagtattttaagacttttggaagttgaaaaggctgttgttgaaggaggaggagctgttggattagcagctattttggaaggaaaagtaccagaattgaaaggaaagaaagttgtttcaattctttccggtggaaatattgatacaacagtacttggaagatcaattgaaagaggattagctgtagatggaagacttgttcgtttagaagttgtcgtatcagatagaccaggaggtattgctgaactaacaactacaattgctcatcttggagcatcaatcaaagatattttccacgaaagagcatggatctcaacggatgtattccacgttaaagttaaggttgtggcagaaactcgtggaaaagagcacgtggaggagattgagactgcattgaagaaaatttatgataatgttatacttcattga

SEQ ID NO: 53656 - protein, 499 aa, Caenorhabditis elegans
MVAPSRKKSIIHHHDHSHESTPQKTHHHRVKQAERKRTASISKEDGMEYNKRVRKLHKAFLTHGAESPHVDDKQTSGSNSDTEAPLFDPDCDPENPKKLKFSDISSAAFNIKNGVQTTPCVRSLQLSSKCEMDLYFKKEYLQVTGSFKERGARYALSKMAEQFKKAGVIAASAGNHALALSYHGQQMGIPVTVVMPVIAPLMKIQFCRSLGATVILKGESIAVAKDFALRHAKENHLKYINGYDAIDILAGQGTIGLEILDQVPDVDTILVPVGGGGLIAGIATAVKTLKPDVHIYGIESETCPSFTEAYEAGHIITSQAKASLADGLAVPTVGGNSLETAKGLVDKVITVKEESIALSILRLLEVEKAVVEGGGAVGLAAILEGKVPELKGKKVVSILSGGNIDTTVLGRSIERGLAVDGRLVRLEVVVSDRPGGIAELTTTIAHLGASIKDIFHERAWISTDVFHVKVKVVAETRGKEHVEEIETALKKIYDNVILH

SEQ ID NO: 53657 - DNA, 1137 bp, Sorghum bicolor
  CDS (1)..(1137)
atgcatgtgattgattgcttcctcgtcctacctagatttgggagttccaccgccaccgtcgtcgtcctcgttctcctttctcctagtccttggcgcgttgtggcgaactggagaggcctgatgggaagcagagatggcaccggtgacagcacgggacgccagggctatgctgccgacattgattccatcagggaggcgcaggcacgcattgcgccgtacgttcacaggacgcccgttctgtcgtcggcgtccatcgatgccatggtggggaagcagctcttcttcaagtgcgagtgcttccagaaagcaggggcattcaagatccgaggtgcttcgaattcgatattcgcacttgacgatgagcaggcatcaaagggcgttgtgacacatagcagtgggaaccatgccgccgccgtggctttggctgcaaagctgcgtggcatacctgcacacattgtcataccaagaaatgcaccagcgtgtaaggttgaaaatgttaagcggtatggtggtcatattatccggagcgatgtcagcattgaatcgagagaatctgtttgtaaaagagtccaggaggagactggtgctgttcttatccatcccttcaatgataaatacactatcagtggtcagggtacagtatctcttgaacttttggagcaagtccctgaaattgacacaataattgttcctattagtggcggtggtttaatttctggtgtgacccttgctgcaaaggccataaacccttcgatacgcattctggcagcagaaccaaaaggtgctgatgattctgcccagtctaaggctgctggaaagatcatcacattgccttccacaaacaccattgctgatggtctacgagcttttcttggtgacttgacatggcctgtggtgcgtgacttggtggacgatgttatcgttgtggatgacacagcgattgtggacgccatgaaaatgtgctacgagatcctgaaggtggctgttgagcctagtggcgcaattggcctggccgcagcactgtccgacgagtttaagcaaagctctgcttggcacgagagcagcaagataggaataattgtttccggaggcaatgttgacctcggcactctttgggagtctctgtacaaacaatga

SEQ ID NO: 53658 - protein, 378 aa, Sorghum bicolor
MHVIDCFLVLPRFGSSTATVVVLVLLSPSPWRVVANWRGLMGSRDGTGDSTGRQGYAADIDSIREAQARIAPYVHRTPVLSSASIDAMVGKQLFFKCECFQKAGAFKIRGASNSIFALDDEQASKGVVTHSSGNHAAAVALAAKLRGIPAHIVIPRNAPACKVENVKRYGGHIIRSDVSIESRESVCKRVQEETGAVLIHPFNDKYTISGQGTVSLELLEQVPEIDTIIVPISGGGLISGVTLAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWESLYKQ

SEQ ID NO: 53659 - DNA, 1002 bp, Saccharopolyspora spinosa
  CDS (1)..(1002)
atgaccttcaagcaacaccaggatgccagcggttttacgctgcctttcgaagcgattaccgctgcacatgatcgaattcgagaacgaatcatcgaaacgccgctgctggagagcgcggccctcaacgcactggtcggcgcacgagttctggtcaaagccgagtcgttgcagaagacgggctcgttcaagtttcgtggggcttgcaatcgcgcgctgcaactcgcgccgcacgagcggtccggcggaatcgtcgcctggtcgtccgggaatcacgcgctggcgatctcggccgtatgtgcggaactgggcgtgccggccaccatcctcatgcccttggacgcaccccgggcgaaggtcgacggcgccaagagctacggggccgaggtccggctttacgaccggcaaaccgaggatcgagaggcactcggcagggagatcgccgaccggacgaacgcggtcatcgttccgccttatgacgatccggagatcatggccggtcagggaacggtcggactcgaactcctcgcccaggcgcgcgaggccggtctaaagcccgacgccgtactcgccagtgcgagcggcggagggctgatcgccggcgtggcaaccgctgtgcgcacgaccctgcctgatgcacaggtattcgcggtcgaacctgaaggcttcgacgaccacgcacgttcccttgccgcaggcgcacgtgtgcggaacgaaccgggggcgcagtcgatctgcgactcgctccacgtgcccacgccaggagaactcacgttctccgtcaaccaccgccttctcactggtggcctcacggtcagcgacaccgaagttcgccgagcgatgcgggtggctttcgagacgctcaagctcgtggcggagcccggaggcgccgcacccctcgccgccctcctcgcggggaagttggacgtgtccggcaagaccgtcgtgacggtgctcagtggcggcaatgtcgatgcggacatgttccagtccgcattctcctga

SEQ ID NO: 53660 - protein, 333 aa, Saccharopolyspora spinosa
MTFKQHQDASGFTLPFEAITAAHDRIRERIIETPLLESAALNALVGARVLVKAESLQKTGSFKFRGACNRALQLAPHERSGGIVAWSSGNHALAISAVCAELGVPATILMPLDAPRAKVDGAKSYGAEVRLYDRQTEDREALGREIADRTNAVIVPPYDDPEIMAGQGTVGLELLAQAREAGLKPDAVLASASGGGLIAGVATAVRTTLPDAQVFAVEPEGFDDHARSLAAGARVRNEPGAQSICDSLHVPTPGELTFSVNHRLLTGGLTVSDTEVRRAMRVAFETLKLVAEPGGAAPLAALLAGKLDVSGKTVVTVLSGGNVDADMFQSAFS

SEQ ID NO: 53661 - DNA, 978 bp, Xenopus laevis
  CDS (1)..(978)
atggattttgcagagcaagctccttttcatattgtcactcctctgaaagagagtcgtgctttatccaaattggctgggactgaagttctcatgaaactggaaaatgttcagcctgcagggtctttcaagatacgtgggattggacactattgtcagaagcttgcgaagaaaggctgcacgaggtttgtctgttcctcagggggtaatgctgggcttgcagcagcttatgcttgtaggggactgaacctcccagcaaccattgttgttccacaaagtactggagcagatattgtacagaagctgcaggatctgggagctgatgttgtgataattggaaaggtctgggatgatgctgatgcacatgctcaccagctgactgaaactcctggcagtgtgtatatctctccatttaaccatcctctcgtctgggaaggccactccagccttgtgtgtgaactaaaggcctctttgggttctcagaagccaggggcactggttgtttctgtagggggtggtgggctcctggctgggctagctgaagggctgaagaaggtgggctggtctgatattcccataattgcaatggagactaaaggggcccactgtttgaatgcagctcttgaagcaggaaaacccatcagccttccagatattaccagtgttgccaagtgtctcggtgccaagacagtatgtgacagagcctttgagtgtacaagggagcacaacgttatttccattactgttgatgacagagaagccatacgggctgtggaaatgtttttggatgatgagttaatttttgtggagcctgcatgtggagctgcccttgctgctgtctattcaggacatatccaacgcctgcagcaggagggaatcttgaagacaccccttgaccccattgtgatggtagtgtgtggaggcagttcgatcagcatttctcagctaaaacacttcaaatcccagctgaatatgaattga

SEQ ID NO: 53662 - protein, 325 aa, Xenopus laevis
MDFAEQAPFHIVTPLKESRALSKLAGTEVLMKLENVQPAGSFKIRGIGHYCQKLAKKGCTRFVCSSGGNAGLAAAYACRGLNLPATIVVPQSTGADIVQKLQDLGADVVIIGKVWDDADAHAHQLTETPGSVYISPFNHPLVWEGHSSLVCELKASLGSQKPGALVVSVGGGGLLAGLAEGLKKVGWSDIPIIAMETKGAHCLNAALEAGKPISLPDITSVAKCLGAKTVCDRAFECTREHNVISITVDDREAIRAVEMFLDDELIFVEPACGAALAAVYSGHIQRLQQEGILKTPLDPIVMVVCGGSSISISQLKHFKSQLNMN

SEQ ID NO: 53663 - DNA, 1536 bp, uncultured bacterium 311
  CDS (1)..(1536)
atgacatttgctaaatctaaaaaatatttaaaaaaaatagaagagagcagtgtttatgatgtagctgatattacacccttgtctcttgcaagccatctaacaaaagaaacaaagaataatatctttttaaaacgcgaggaccttcagccggtattttcttttaaattgaggggggcttataacaaaatttcatatcttaagaagatcggtaccatagaaagagtgataactgcttctgcaggcaatcatgcacaaggagttgcttactctgcaagaaagctcagactcaaagcaaccattgtgatgccagtaacgactcccagtattaaagtaagtgcggttaaaaatctaggtgctcaagttgttcttgtaggggatacttatgatgaagcttatgaacatgctattaagttatcaaaaaaaccaaactatgcttttgtacatccttatgacgacccagacgttatcgctggacaaggaactatcggaaaagagattttagatcaagctggtaatgatttagatgccgtatttgttcctgttgggggcgggggcctgctggcaggcataggagcttatattaaaactctaaggccagatgtaaaaattattggagtagagcctgaggaagcagctggactttatgaagcccttaaagcaaatcggatagtaactttaaaacaagtagggatttttgtagacggggtagccgtaaaacaggttggtaaagttacttttcctataattaaagaatgggtagatgaagtggttacagtatctgtcgatgagatttgtgcagctattgaagatatttttcaagagactagaacaatatctgaacctgcaggagctttatccttggcaggcttgaagaaattaactaaaagtaaaggctggaagaataagaatctagtagctattaattcaggtgcaaaccttaactttgatcgtctttctcacatagtcgaacgagtacagttgggagagaagaaagaagctcttctaagtgtctgcattccagaagaaaaaggcagtttcagacaattttgtaaggatctaggcaaaaggatgattactgaatttaattatcgaattgatgatgaaaaagaagcaaacatttttgtagcttgtagagtaaatgagggaataaaagaaaaaagtagatttataaagaatttgcgcaagaaaggttattcccctaaagatttatctgataatgaaatggctaaattgcatgtcaagcacatggtaggaggcagggctccaaaagacattatttcttacggggaagagatttttagagttgagttcccggaaagacctggagcactgatggatttcttaagtttgttaggagacaaatggaatataactttgtttcactatagaaatcaaggttcagcttatggaagggtgttagtaggctttcaagctaatccaaaagaaactgaaaaattaacaaagcacctcgttaaaacaggctttccattttggaatgaatctaagaactcagcttatttatccttccttgaatga

SEQ ID NO: 53664 - protein, 511 aa, uncultured bacterium 311
MTFAKSKKYLKKIEESSVYDVADITPLSLASHLTKETKNNIFLKREDLQPVFSFKLRGAYNKISYLKKIGTIERVITASAGNHAQGVAYSARKLRLKATIVMPVTTPSIKVSAVKNLGAQVVLVGDTYDEAYEHAIKLSKKPNYAFVHPYDDPDVIAGQGTIGKEILDQAGNDLDAVFVPVGGGGLLAGIGAYIKTLRPDVKIIGVEPEEAAGLYEALKANRIVTLKQVGIFVDGVAVKQVGKVTFPIIKEWVDEVVTVSVDEICAAIEDIFQETRTISEPAGALSLAGLKKLTKSKGWKNKNLVAINSGANLNFDRLSHIVERVQLGEKKEALLSVCIPEEKGSFRQFCKDLGKRMITEFNYRIDDEKEANIFVACRVNEGIKEKSRFIKNLRKKGYSPKDLSDNEMAKLHVKHMVGGRAPKDIISYGEEIFRVEFPERPGALMDFLSLLGDKWNITLFHYRNQGSAYGRVLVGFQANPKETEKLTKHLVKTGFPFWNESKNSAYLSFLE

SEQ ID NO: 53665 - DNA, 972 bp, Rhizobium sp
  CDS (1)..(972)
atgcgcaattaccccaccattcaggacatccgtgaagcccgggaacggctgagaccacacgtcaggcacacgccgctgttgcgcgcggacaagattgagaaagctgctggttgtcagctctatctcaaacccgaaaccctgcagattactggcgccttcaagatccgcggcgccctgaacaaggctctctcgctctcgagagaagagatcgcaaacggcatcatcgcgacgtcgtcgggcaaccatgcccaggggctttcttacgcggccaagatgctcggcgtaaaggtgatattggtacttccggtgaccacacccaaaatcaagattgaaaatacaaaagcccttggcgcggaagtcattctttttgatggtgataatgctgctagatggaaaaaggtctacgaaatcgctgaaggaaacaagtatgcggttattcacggctttgaagaccccattgtaatggctggccagggaacgatcgggtgcgagatactcgaagacttggacgatgtggacacggtcatcgtccccttaggcggcggaggcctaatctcgggaatcgctaccgccataaaagaaacgaaaccatcggtgcgcgttatcggggcagagcctgccttgacaccgaagtattatcacagccggatcaacaaggagcgcacatcgcttccgttgaagaacaccattgcggatggcttgaggttaagtgttccgggtaaaaacccgtatccgattatcgaaaaatatgtggacgagattgttcttgttgaagacgagcacatcatctccgggatgcgcgcgcttgccagggatgcgaagttgatcgctgaaccagccgcctcgattggcattggagccttgttggcgggcagcatagacgtcaagcccgatgaaaaagtctgtgcggtgttgtctggcggcaactgggacctaggcgatcttgcagagatatacaaggcagcggggtaa

SEQ ID NO: 53666 - protein, 323 aa, Rhizobium sp
MRNYPTIQDIREARERLRPHVRHTPLLRADKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPIVMAGQGTIGCEILEDLDDVDTVIVPLGGGGLISGIATAIKETKPSVRVIGAEPALTPKYYHSRINKERTSLPLKNTIADGLRLSVPGKNPYPIIEKYVDEIVLVEDEHIISGMRALARDAKLIAEPAASIGIGALLAGSIDVKPDEKVCAVLSGGNWDLGDLAEIYKAAG

SEQ ID NO: 53667 - DNA, 969 bp, Acinetobacter baumannii
  CDS (1)..(969)
atgaaaaatttaacccttccaaattatgaagatgtcgcagccgctgctgaacgtataaaaggttttgtaaataaaactcctgttttaacttcacgtacggtgaacaatgaatttgaagcagaagtgttctttaaatgtgagaattttcagcgtgtaggcgctttcaaatttcgtggtgccatgaatgcacttttgcaatttaatgagactcaaaagaaagcaggtgtagttgctttttcttcgggaaatcatgcacaagctattgcgctttcatcaaaaattcttggtattccagcaaccattatcatgcctaaagatgcacctgctgcaaaaatggcagcaacgcgagaatacggcggtaatattgttgaatttgaccgttatacggaagatcgggaaaaaattggaaaagagattgccgaacaaaatggtctaacattaattccgtcttatgaccatccgcatgtgattgcaggtcaaggtacagctgctaaagagttatttgaagaagtcggtgatttagattacctgtttgtatgtttaggtggcggcggtttgttggcaggttctgccctgtcggctcgccagctttctccgaactgtaaaatatatggcgttgaaggtgcgctaggaaatgatgggcaaatgtcttttagaaaaggcgaaattgttcatattgataccccattaaccattgccgatggcgcgcagactcaatatttgggcaaattgacctttcctattattcaacagaaagttgatgatattttgacggtcacagacgaagaactcattaacgctatgaagttctttgctgaaagaatgaagatggtggttgaaccgacaggatgtctcggatttgcggctgcccgtaatttaaaacatgagttaaaaggcaaacgtatcggcattattattagtggtggcaatgtcgatatttctaaatacgcggagtttttatctgcctaa

SEQ ID NO: 53668 - protein, 322 aa, Acinetobacter baumannii
MKNLTLPNYEDVAAAAERIKGFVNKTPVLTSRTVNNEFEAEVFFKCENFQRVGAFKFRGAMNALLQFNETQKKAGVVAFSSGNHAQAIALSSKILGIPATIIMPKDAPAAKMAATREYGGNIVEFDRYTEDREKIGKEIAEQNGLTLIPSYDHPHVIAGQGTAAKELFEEVGDLDYLFVCLGGGGLLAGSALSARQLSPNCKIYGVEGALGNDGQMSFRKGEIVHIDTPLTIADGAQTQYLGKLTFPIIQQKVDDILTVTDEELINAMKFFAERMKMVVEPTGCLGFAAARNLKHELKGKRIGIIISGGNVDISKYAEFLSA

SEQ ID NO: 53669 - DNA, 3522 bp, Dictyostelium discoideum
  CDS (1)..(3522)
atggcaaagaaacattcaagagaagaaacaataacatcaccaagtccaagtggaaatacaactacaacatctacaacaagtccaacatcaacaacaccaacaaaagaaaaaagaacaaaaatttcaaatggaaataataaagaaaaagaaaccaatagtaataataatataaatacaagtaatacaaatattttaaatggtagtgttaatagtttaaataatagtagtacaaatttatttacaacacatcaaaataatccagtaaagaatttaaaaggatttgatgatattggtgaaggtatacttagattcgaaggatcaaaagaaattgatttcattggatcagtaaagagagttcattcaatgatgaaagattatttaaagaaaactccacaatatgattacgaattattaagtcaattattcaaatgtgatttacaattgaaattagagaatcttcaattgtttggtgatatttatgttagaaattgttttagtatccttttatcaaattattttaatcaagccaaagatttaggtaaagagtttagacaaattggtggtttcgttttagtgattaatccaatggatattgaaagtcaaccaatggtaactggtagtattttaactgctcttcatttaaaaatgaaatgtattatttatgttggtcctggtaatttaccattatcacaaattacaagattatatatgtgtcatgctagaggtgcaaaaattatatttcataaaggtgatgtatcatcatgttatacaagagcatggcaacatgcaaaagatatgagtatggtatttttagattgtaaatttataccacattttagtttattgggtgcagcaactattgcacatgaaatgatggaggatagtccagatagggagacaattatcataccattaagattatattcacagggttggagttatgtcagtggtatttcaattttctataagattatgaaacctgaaatcaagattatagtagttcaaatgactgatgatctctttggtaaagatattgaaggtaaagaatttaatagacaatcattattccctgaccgtttagagattggttggttagcattaattcatgatcaatcagatcttaccaatgttttcgacgctttcgattcaagaaatcaaggtaaattctctgataaagatttagaggcattattgataagcattggtggtgatccaactagaaataaatcaatgtgtccaaaatcatcactttctcaaactgaatttgttcatgaagtaatcacagagatcacaaatggtttagagcaattggaggagaaatttagctactttttaccacaattcaaattggataacttaatcaatcataaaatcatcgatcaattagtaacagcaaccgaggatcaagcttcaatcgctttcattaaatgtttagagtatacccatactctcaccaatggtaagggttcaattgctttgggtggtctaatgagtggtaatattcatttaagacccgatgaaaaagtattggttatgttatcaggtggttatgtcgatgtaatcgattttcaaactattttaaactatggtttagatatcactggtcaaagctttgaaattgaattggatttacccgataatactacatcactaaataaagtattaaatgttattggtgaaaataaagtatcagttatggaggtattaatggatcgttcttgtgaaactttaaaacaatatcatgttagaacttcaattcaatgtcattcaagaaattttgaacaacaatttaaaatctttgatgttattaaatctttaggttttaaatatagtttaagaaaatctgcaattctaaataaagaagaatctggtttcctctcaccaccaatgattaagccttcaacaaatttatcaatttctcaatcaattaatattggtagtagtgtaacgagtttaccatcatttccaaatactttaaattcaagtagttcaaatgcatttaatagatttggtaatggtaatggtagttcatcaaatacaacatcaccatcaccaccaccacaactaccaccacaattacaatataaaatttcaccaaaaccatatcatcaacaaaaaagaaatattggtgatataacagttcaatcaattagagaagcacataatagaattaaacatattatgactcaaccacccatttatcattcaactacctattcaaagatttgtggttgcaaagttacattaatgttagagaatactcaaaagactggtagttttaagattagaggttcatcgaatatggtgttaagagcattggaaggtgcaatggtaaacactgatgaaagaccagttggtttagttgctgcctctgcaggcaatcatgctcaaggtgtagctttaatctctgcaaaagttggtttaccttgtacaatcgtttgtccagagtatgcaccagattcaaaattatcatcaactcgtcaatatggtgccgaagtcattaaaaagggtaaaagtcttgaagaggctgtcaaattggccgatgaaatctgtaaggaaagaaattggacattggttagaccttacaatgatgttgatgtaatcgaaggtcaaggtacaatgggttgtgatatctatgataaagtaccagatgtcgatactgtggttgtaaatgttggtggtggtggtatgatcgctggtatcgcactattcttgaaacgtatcaatccaaacattagaatcattggtgttcaatcagcaaacgtttcaccattatcagaatttaaacaaaccaatcaattccgttatatcgaaccagcagttttatcattggccgatggtacaaatgtaaagatgccaggtggtgtacacactcaagtacttcatgatatggtcgatgagtatgtaaccgttagtgaaaatgaaatcgcttcgaccatagttcatctactttataatagtcgtacagtttcagagggtgcaggttgtttaggtttggctgcattaatgcataagaaaattaaagttagaaaggatgaaagggtttgtgtcatcatttgtggtggtaatatcgatatgtcaacacttcgtcaagtctatgaatatggtttacgttcacttggtcgttctttcacaattcatttaacaacttgggattatcctgggaccctaagtaaaatcattggtttggctgcccgtgccgaattaaaagttcgtgaaattagacatatccgtggtggtggtaatatcaattggaatgaagttatcatttccctctccttctatagtaactcttttaatcatcaaaactttttcttatctctattggctcaagaaggtctcttcccaaagattgtcggtagaaaatacattaaagataatgaaatagtctataaaattttcgataaatctgttgataaaaagaataaagaattaaaagataccttttcagaaagacaacaactatttttagaacaatatggaaaacaagccaatgtttctttggaaagtaaaatgaattaa

SEQ ID NO: 53670 - protein, 1173 aa, Dictyostelium discoideum
MAKKHSREETITSPSPSGNTTTTSTTSPTSTTPTKEKRTKISNGNNKEKETNSNNNINTSNTNILNGSVNSLNNSSTNLFTTHQNNPVKNLKGFDDIGEGILRFEGSKEIDFIGSVKRVHSMMKDYLKKTPQYDYELLSQLFKCDLQLKLENLQLFGDIYVRNCFSILLSNYFNQAKDLGKEFRQIGGFVLVINPMDIESQPMVTGSILTALHLKMKCIIYVGPGNLPLSQITRLYMCHARGAKIIFHKGDVSSCYTRAWQHAKDMSMVFLDCKFIPHFSLLGAATIAHEMMEDSPDRETIIIPLRLYSQGWSYVSGISIFYKIMKPEIKIIVVQMTDDLFGKDIEGKEFNRQSLFPDRLEIGWLALIHDQSDLTNVFDAFDSRNQGKFSDKDLEALLISIGGDPTRNKSMCPKSSLSQTEFVHEVITEITNGLEQLEEKFSYFLPQFKLDNLINHKIIDQLVTATEDQASIAFIKCLEYTHTLTNGKGSIALGGLMSGNIHLRPDEKVLVMLSGGYVDVIDFQTILNYGLDITGQSFEIELDLPDNTTSLNKVLNVIGENKVSVMEVLMDRSCETLKQYHVRTSIQCHSRNFEQQFKIFDVIKSLGFKYSLRKSAILNKEESGFLSPPMIKPSTNLSISQSINIGSSVTSLPSFPNTLNSSSSNAFNRFGNGNGSSSNTTSPSPPPQLPPQLQYKISPKPYHQQKRNIGDITVQSIREAHNRIKHIMTQPPIYHSTTYSKICGCKVTLMLENTQKTGSFKIRGSSNMVLRALEGAMVNTDERPVGLVAASAGNHAQGVALISAKVGLPCTIVCPEYAPDSKLSSTRQYGAEVIKKGKSLEEAVKLADEICKERNWTLVRPYNDVDVIEGQGTMGCDIYDKVPDVDTVVVNVGGGGMIAGIALFLKRINPNIRIIGVQSANVSPLSEFKQTNQFRYIEPAVLSLADGTNVKMPGGVHTQVLHDMVDEYVTVSENEIASTIVHLLYNSRTVSEGAGCLGLAALMHKKIKVRKDERVCVIICGGNIDMSTLRQVYEYGLRSLGRSFTIHLTTWDYPGTLSKIIGLAARAELKVREIRHIRGGGNINWNEVIISLSFYSNSFNHQNFFLSLLAQEGLFPKIVGRKYIKDNEIVYKIFDKSVDKKNKELKDTFSERQQLFLEQYGKQANVSLESKMN

SEQ ID NO: 53671 - DNA, 1053 bp, Dictyostelium discoideum
  CDS (1)..(1053)
atgggtcttaaaacaactatttcaccagattcttcatttgataaaataataaataccaaaacttcacctccattacatataaattctccaatgttggaatcattggctttatcaaaattatttaaagaagaaaatgcaaaagtatggatgaaagtagatgcacttcaaccatcaggctcattcaaaatccgtggagtaggccttctctgtaatcaacttttaaaagaaaaaaaatcaaaaaatgaagaagctcattttatttgttcatcaggaggtaatgcaggtaaaagtgttgcatatgcaggtagaaaattaaatgtaaagacaacgatagttttaccaaatactataccagaggcaacaattgaaaagattaaagatgaaggagcaaatgtaattgtacatggtactatttgggatgaagcaaatacatttgcattggaattggcagagaaagaaggttgtacagattgttatatccatccattcgatcatccattactttgggagggtcattccacaatgattgatgaaatctatcaagatgttcaaaatggtgtttgtgaaaaaccagatgtaattttattttcagttggtggtggtggtatgatgattggtattttacaaggtttagatagatatggttggaatgatataccaattgttactgttgaaactgttggtagtcatagtttttggaaaagttttcaagagaaacaattgacaaaattggatgtatcagaggttacaagtgtaattaaaaccttatcaactcgttcagtttgtagtgaagcttgggaaatttcaaaaagatttaatattaaaccaattttagtcactgatagagatgctgtagatgcttgtttaaaatttgttgatgatgaaagaatcttagtagaaccatcttgtggtgcaacattatctgtactctattcaaaaaaattatcaacacttttagatataaattcaaaaaatattttaacaatcgtttgtggtggaaatggaactagtattttacaattgaatgatttattacaaactttaccaaaatag

SEQ ID NO: 53672 - protein, 350 aa, Dictyostelium discoideum
MGLKTTISPDSSFDKIINTKTSPPLHINSPMLESLALSKLFKEENAKVWMKVDALQPSGSFKIRGVGLLCNQLLKEKKSKNEEAHFICSSGGNAGKSVAYAGRKLNVKTTIVLPNTIPEATIEKIKDEGANVIVHGTIWDEANTFALELAEKEGCTDCYIHPFDHPLLWEGHSTMIDEIYQDVQNGVCEKPDVILFSVGGGGMMIGILQGLDRYGWNDIPIVTVETVGSHSFWKSFQEKQLTKLDVSEVTSVIKTLSTRSVCSEAWEISKRFNIKPILVTDRDAVDACLKFVDDERILVEPSCGATLSVLYSKKLSTLLDINSKNILTIVCGGNGTSILQLNDLLQTLPK

SEQ ID NO: 53673 - DNA, 1740 bp, Giardia lamblia
  CDS (1)..(1740)
atgcatgccctaatccagtctggagagctcatgaacttcgttgtcaagctcaacacacttgatgggaatctcatgacccgtttgacagatatcctctccaagcactcgattaatattcttagctttcacgtaaagactatacaacaccagcaggtctctatcaaggcctcgggccctggctaccagcacttagtttctttgtacaatgagttgtccgaggtcttcggtgatgagaacatcctggggttggcgatccctaagtacaatataaaggaggaggggctgcgcgatgtctcctatgaggagttcaatgagggagcttcgtccagtggcgagcccatcagaacatatgtttcccccatcaagtcgtgtgatgagataacgccggcaactattgagcttgcttacaacaagcttcaggcagctaaagccatacacgagaccccctgcatcatctccaaggcgtacagcaatattttgcagaagaagacaggcgttgaccacaccgttattctccagtttgaaaatgttcagcagacgggctcgtttaagatccgcggggcgagcaatatgctcattaagagcaaggagtgggccgagagcaataatactgagatctctggggttgtggcatgctctgcaggaaaccacgcccagggagtcagcaagacaagtgacttgttgggtattcgctgcacaatagtttgccctgagacggctccgactgtcaaattggttaacacaaagcgatacaacgccgaagtgattaagcacggtgctgtcttcgatgaggcaagcaagtattcccaggaactctgtgagaagcgcggctggatgtttatcccgccctataactcgttcgacgtcattgagggccaaggaacaattgctcacgaactgatgaacaagatggtcgggcaagggcacgtttcctccattgaccgcatcctggtcaatattggaggaggcggtatgatttcaggaatctccctttacgctaagagagtcaatccaaatatcaagatcacagggatccaagcagagaaggtgtttcctctccgcaactacaaagagagtggccagcttgtccctgttgacaaaacggctggaacaatagcagatggctgcaatgtcaaggttcttggaggaatccacaacgatgtcctcaagaactacgttgacgagttcatttcggtgactgagaacgagatcgccagtgcggttgttcatgctcttatcacgacagggacgctctgcgagggcgccggagcaatgggtattgcggccctgatgtatgacaagctgacccttgctgagcgtgagaacatagctgtcgttctgtgtggtggcaatatcgacctcactagagtcagacagatctataactacggactcattgctctagggaggatgctcagcgttgagatcagacaggcagacacatatggcagccttgcaaagctcagcaagattgccttgaaatactactctaccatacgatatgttacatacctgcgaggcggagatgaccttgattgggaccagatggtcgtgaaggtggacatcaagattccaagccctgcagtctatggcttgcttagccaagagattcgtgcgtcctttgatacagttacatttctgggtgaaaccgttatccctcgttaccctgtgtcagcccatgcacctgagctgggatcgtctgctgtggagaactctcaggtacgcgtcgttaagaagtga

SEQ ID NO: 53674 - protein, 579 aa, Giardia lamblia
MHALIQSGELMNFVVKLNTLDGNLMTRLTDILSKHSINILSFHVKTIQHQQVSIKASGPGYQHLVSLYNELSEVFGDENILGLAIPKYNIKEEGLRDVSYEEFNEGASSSGEPIRTYVSPIKSCDEITPATIELAYNKLQAAKAIHETPCIISKAYSNILQKKTGVDHTVILQFENVQQTGSFKIRGASNMLIKSKEWAESNNTEISGVVACSAGNHAQGVSKTSDLLGIRCTIVCPETAPTVKLVNTKRYNAEVIKHGAVFDEASKYSQELCEKRGWMFIPPYNSFDVIEGQGTIAHELMNKMVGQGHVSSIDRILVNIGGGGMISGISLYAKRVNPNIKITGIQAEKVFPLRNYKESGQLVPVDKTAGTIADGCNVKVLGGIHNDVLKNYVDEFISVTENEIASAVVHALITTGTLCEGAGAMGIAALMYDKLTLAERENIAVVLCGGNIDLTRVRQIYNYGLIALGRMLSVEIRQADTYGSLAKLSKIALKYYSTIRYVTYLRGGDDLDWDQMVVKVDIKIPSPAVYGLLSQEIRASFDTVTFLGETVIPRYPVSAHAPELGSSAVENSQVRVVKK

SEQ ID NO: 53675 - DNA, 1848 bp, Podospora anserina
  CDS (1)..(1848)
atggcttccacaaattcgaatgcacctcgtcatgaggggagtgtggcagagcagacggccggccatgttaacggtgactatgtggtcaatggcgtgccacagctgcccaccgcattccgcaacggcaacggcggccttggtgctgggggtttgcccaggaacatgtcgctgaacagcttcgctctgacagagtacagcgcaaagccaacaccccccgctgaagacaagaaagatgaagtgaaaaaggtcgtgccagacgagtatctgctaccgaatggtaacccagatctcattatcctacgtgtacagtatcttcgccttatcatcacctcctacccgcgggtgagagaggtgtgcaaagaaactcctttggtgcacgctgttggcctgagcaaccgactggagcgcaaggtcctgttgaagcgcgaggatgagcaaccggtattcagtttcaaactcagaggagcgtacaacaagatggctcatctcgacgctaccgagtcctggaagggtgtcgtttgttgcagcgctggcaatcatgctcagggcgttgcttactcggcccgcaggttgaaaatcccagccactattgtgatgcccaagggcacaccaagcatcaagcatctcaatgtatcgagaatgggcggacacgttgttcttcacggcgccgactttgacgaggccaaggaggaatgtgctcggcgggaaaagcaggatggcctgataaacattcccccgttcgacgacccttatgttattgccggccaaggaactatcggtatggagattctctcacaaacaaacctgcagaagcttgatgccatcttctgctgcgtgggtggaggcggcctgatcgccggcgttggtgtgtacgtcaagcgtattgcaccgcatgtcaagatcattggcgtggaaacgtacgacgcggatgcgatgactcagtctctcgacaagggggagcgtgtgcttctcaaggatgttgggttgttcgccgatggcgccgcggtcaagattacgggcgaggaaacgttccgtatttgtcaggaggttgtggacgaaatggttcgggtaaccacagacgaggcctgtgccgctatcaaggacatgtttgaggataccaggtctatcattgaaccagctggtgccctggccattgccggtctgaagaagtgggtggccgccaatccaaccccggatcctacacggtctgtcgtggccatcacatccggcgcaaacatgaactttgaccgcttgggctttgttgcagcccgtgctacgtacggcgagggaagagaggctttacttgcagcccgcatcccagaaagcccgggagccttcgctgaactcatcaacgccgtcatgcctcactctgtcaccgagtttagctatcgttacgccagcccaactgaagcaaatgtgctcctgggtatctcattaaccgccgttggtagtgaacgcgcacagcaactgcagtcggttatcagccgcatcaaggagtccggcaccatggatatcaccgatctgtccaacgacgagttagcaaagagtcacattcgatacatggttggtggccgttctagtgtgcctaacgagcgtctgtacacattccgattcccagaacggcccggtgctcttgagcgcttcctacagaccttgcgtgtcaaatacaacatcagtctgttccagtacagaaaccacggtggtgatattgggcaggttttgacaggcatcgtttgcccgaacgaggagattggcgaactagaaacattcctcaagaagatcggctatccgtgggaggactgcacagatgcaccggtgttcaagacattcttacggtcggagtcatag

SEQ ID NO: 53676 - protein, 615 aa, Podospora anserina
MASTNSNAPRHEGSVAEQTAGHVNGDYVVNGVPQLPTAFRNGNGGLGAGGLPRNMSLNSFALTEYSAKPTPPAEDKKDEVKKVVPDEYLLPNGNPDLIILRVQYLRLIITSYPRVREVCKETPLVHAVGLSNRLERKVLLKREDEQPVFSFKLRGAYNKMAHLDATESWKGVVCCSAGNHAQGVAYSARRLKIPATIVMPKGTPSIKHLNVSRMGGHVVLHGADFDEAKEECARREKQDGLINIPPFDDPYVIAGQGTIGMEILSQTNLQKLDAIFCCVGGGGLIAGVGVYVKRIAPHVKIIGVETYDADAMTQSLDKGERVLLKDVGLFADGAAVKITGEETFRICQEVVDEMVRVTTDEACAAIKDMFEDTRSIIEPAGALAIAGLKKWVAANPTPDPTRSVVAITSGANMNFDRLGFVAARATYGEGREALLAARIPESPGAFAELINAVMPHSVTEFSYRYASPTEANVLLGISLTAVGSERAQQLQSVISRIKESGTMDITDLSNDELAKSHIRYMVGGRSSVPNERLYTFRFPERPGALERFLQTLRVKYNISLFQYRNHGGDIGQVLTGIVCPNEEIGELETFLKKIGYPWEDCTDAPVFKTFLRSES

SEQ ID NO: 53677 - DNA, 981 bp, Burkholderia pickettii
  CDS (1)..(981)
atgacccagctagacaccaccactcttcccgacctgtccgccatcgccggcctgcgcgcccggctgaaacaatgggtgcgcaccacgcccgtattcgacaagaccgacttcgaacccgtgccgggcacggcggtgaacttcaagctcgaactgctgcaggccagcggcaccttcaaggcgcgcggcgcgttctcgaacctgctagcgctggacgacgatcagcgcgcggccggcgtcacctgcgtgtcggcaggcaaccatgccgttggggtggcctacgccgccatgcgcctgggcatcccggccaaggtggtcatgatcaagaccgccagcccggcccgcgtggcgctgtgccgccagtacggcgccgaagtggtgctggccgaaaacggccagacggcattcgataccgtgcaccgcatcgaaagcgaggaagggcgcttcttcgtgcaccccttcaatggctaccgcacggtgctgggcaccgccacgctaggtcacgaatggctggagcaggctggcgcgctcgacgccgtgatcgtgcccatcggcggcggcgggctgatggcgggcgtcagcacggcggtgaaactgctggcgccgcaatgccaggtcatcggcgtagagcccgaaggcgccgacgccatgcaccgcagctttgaaaccggcggccccgtcaagatgggctccatgcagagcatcgccgacagcctgatggcgccgcacaccgagcaatacagctacgaactgtgccgccgcaacgtcgaccgcctggtcaaggtgtccgacgatgaactgcgcgccgccatgcgcctgctgttcgaccagctcaagctggccaccgagccggcatgtgccaccgccacggccgcgctggtcggcgggctgaaggccgaactggccggcaagcgggttggcgtgctgctgtgcggcaccaacaccgacgccgccaccttcgcgcggcacctgggcctcggctga

SEQ ID NO: 53678 - protein, 326 aa, Burkholderia pickettii
MTQLDTTTLPDLSAIAGLRARLKQWVRTTPVFDKTDFEPVPGTAVNFKLELLQASGTFKARGAFSNLLALDDDQRAAGVTCVSAGNHAVGVAYAAMRLGIPAKVVMIKTASPARVALCRQYGAEVVLAENGQTAFDTVHRIESEEGRFFVHPFNGYRTVLGTATLGHEWLEQAGALDAVIVPIGGGGLMAGVSTAVKLLAPQCQVIGVEPEGADAMHRSFETGGPVKMGSMQSIADSLMAPHTEQYSYELCRRNVDRLVKVSDDELRAAMRLLFDQLKLATEPACATATAALVGGLKAELAGKRVGVLLCGTNTDAATFARHLGLG

SEQ ID NO: 53679 - DNA, 1779 bp, Arabidopsis thaliana
  CDS (1)..(1779)
atgaattccgttcagcttccgacggcgcaatcctctctccgtagccacattcaccgtccatcaaaaccagtggtcggattcactcacttctcctcccgttctcggatcgcagtggcggttctgtcccgagatgaaacatctatgactccaccgcctccaaagcttcctttaccacgtcttaaggtctctccgaattcgttgcaataccctgccggttacctcggtgctgtaccagaacgtacgaacgaggctgagaacggaagcatcgcggaagctatggagtatttgacgaatatactgtccactaaggtttacgacatcgccattgagtcaccactccaattggctaagaagctatctaagagattaggtgttcgtatgtatcttaaaagagaagacttgcaacctgtattctcgtttaagcttcgtggagcttacaatatgatggtgaaacttccagcagatcaattggcaaaaggagttatctgctcttcagctggaaaccatgctcaaggagttgctttatctgctagtaaactcggctgcactgctgtgattgttatgcctgttacgactcctgagataaagtggcaagctgtagagaatttgggtgcaagggttgttcttttcggagattcgtatgatcaagcacaagcacatgctaagatacgagctgaagaagagggtctgacgtttatacctccttttgatcaccctgatgttattgctggacaagggactgttgggatggagatcactcgtcaggctaagggtccattgcatgctatatttgtgccagttggtggtggtggtttaatagctggtattgctgcttatgtgaagagggtttctcccgaggtgaagatcattggtgtagaaccagctgacgcaaatgcaatggctttgtcgctgcatcacggtgagagggtgatattggaccaggttgggggatttgcagatggtgtagcagttaaagaagttggtgaagagacttttcgtataagcagaaatctaatggatggtgttgttcttgtcactcgtgatgctatttgtgcatcaataaaggatatgtttgaggagaaacggaacatattggaaccagcaggggctcttgcactcgctggagctgaggcatactgtaaatattatggcctaaaggacgtgaatgtcgtagccataaccagtggcgctaacatgaactttgacaagctaaggattgtgacagaactcgccaatgtcggtaggcaacaggaagctgttcttgctactctcatgccggaaaaacctggaagctttaagcaattttgtgagctggttggaccaatgaacataagcgagttcaaatatagatgtagctcggaaaaggaggctgttgtactatacagtgtcggagttcacacagctggagagctcaaagcactacagaagagaatggaatcttctcaactcaaaactgtcaatctcactaccagtgacttagtgaaagatcacctgcgttacttgatgggaggaagatctactgttggagacgaggttctatgccgattcacctttcccgagagacctggtgctctaatgaacttcttggactctttcagtccacggtggaacatcacccttttccattaccgtggacagggtgagacgggcgcgaatgtgctggtcgggatccaagtccccgagcaagaaatggaggaatttaaaaaccgagctaaagctcttggatacgactacttcttagtaagtgatgacgactattttaagcttctgatgcactga

SEQ ID NO: 53680 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGARVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLRYLMGGRSTVGDEVLCRFTFPERPGALMNFLDSFSPRWNITLFHYRGQGETGANVLVGIQVPEQEMEEFKNRAKALGYDYFLVSDDDYFKLLMH

SEQ ID NO: 53681 - DNA, 1080 bp, Mus musculus
  CDS (1)..(1080)
atggagggggccttggcagaacgcgtcggggcggagcctttccacagggtcacgcccctgctggagagctgggcgctgtctcaggtggcaggcatgccggtcttcctcaaatatgagaatgtgcagatagctggctcctttaagattcggggcatcggacatttctgccagcagatggccaagaggggatgcagacatctggtgtgctcctcagggggcaatgcgggcattgcggctgcatactcggctcgtaagctgggcatccccgtcaccatcgtgctcccagagggcacctccgtgcaggtggtgaggcggctcgagggggaaggggccgaggtccagctgactgggaaagtctgggatgaagccaatgtaaaagcacaagaactggccacaagggatggctgggtgaacgtctccccgtttgaccatccccttatatgggaaggccatgccagcctagtgcgggagctgaaggagtcactagggacccctccaggtgccgtggtgctggccgtggggggcggagggctcctggcaggtgtgactgctggcctgctggaggtgggctggcagcatgtgcccatcgttgccatggagacccgcggggcgcacagtttcaattcggccttgcaggcaggcaggccggtcaccctgccagacatcaccagtgtagccaagagcctcggagccaagacggtggctgcacggaccttggagtgtgcaaaggagtgtgaggtcctctctgaggtggtagaagaccgggaggctgtcagcgctgtgcagaggttcctggacgatgagcgcatgctggtggaacctgcctgcggtgccgccctggccgccatctactcgggcatcctgtggaggcttcaggctgagggccgcctgagttctgccctagcttccgttgtggtcatcgtgtgcggtggcaacaacattagtagccaacagcttcaggagctgaaaaccagctgggctgcattgaaaatctcaggaactcccccaaagttcctggacacctggtgggtcatcaagggacctcggttccagtggtcctgccctcttccttccaggtag

SEQ ID NO: 53682 - protein, 359 aa, Mus musculus
MEGALAERVGAEPFHRVTPLLESWALSQVAGMPVFLKYENVQIAGSFKIRGIGHFCQQMAKRGCRHLVCSSGGNAGIAAAYSARKLGIPVTIVLPEGTSVQVVRRLEGEGAEVQLTGKVWDEANVKAQELATRDGWVNVSPFDHPLIWEGHASLVRELKESLGTPPGAVVLAVGGGGLLAGVTAGLLEVGWQHVPIVAMETRGAHSFNSALQAGRPVTLPDITSVAKSLGAKTVAARTLECAKECEVLSEVVEDREAVSAVQRFLDDERMLVEPACGAALAAIYSGILWRLQAEGRLSSALASVVVIVCGGNNISSQQLQELKTSWAALKISGTPPKFLDTWWVIKGPRFQWSCPLPSR

SEQ ID NO: 53683 - DNA, 1809 bp, Oryza sativa
  CDS (1)..(1809)
atggcggccgccgccaccgccgcggccgcggccacctccaccttcaccgccgccgtgccgcgcgcgcgcgggcgcaggcatccaacgcgcgtggcggcggcggcggcggcgacggcgtcgtcaccggaggcggcgatggcggcggcggcgccgccgttgccgatgatgcgggtggcgcccgagacgctgcagcggcagagcgggtacctcgtgcggggccgcggggaggaggggattggggagggggaggcggaggcggtgggaggggacgcggcgggagggctcggcgcgatggagtacctgaccagcgtgctctcgtccaaggtgtacgacgtcgccatcgagtcgccgctccagctcgccaccaagctctccgagcgcctcggcgtcaacttgtggatcaagcgcgaggacctgcagcccgtattctcattcaagttgagaggagcatacaatatgatggcaaagctctcgcgtgaacagttggagaggggtgtcatctgctcctctgctgggaaccatgcccagggagtggccctttccgctcaaagactcggttgcgatgctgttattgtcatgcctgtgacaacgcctgaaatcaagtggcgatcggtggagagattgggtgcaacagttgtactcaaaggggactcatatgatgaagctcaatcatatgcaaaacaaagatgcgagcaggaaggccgcacattcatacctccttttgaccatcctgatgttataagtggacaaggaacgattggcatggaaattgttcggcagttgcaaggcccacttcatgccatatttgtacctgtaggaggaggtggattaattgctgggatcgctgcctatgtaaaaagggttcgcccagaggtgaaaataattggagtggagccatcagatgcaaatgcaatggcattgtccttgtgtcatggtcaaagggtcatgctggagcaagttggtgggtttgctgatggtgtggctgtcaaagttgtaggggaggaaacatttcgcttgtgccgggaacttgtagatggtattgttcttgtcagtcgagatgctatttgtgcttcaataaaggatatgtttgaggagaaaagaagcatacttgaacctgctggtgcccttgcgctggcaggagctgaagcttactgcaaatactatggcttgaaaggggaaaatgttgttgcaataactagtggagcaaatatgaactttgatcggctcagattagtaactgagctggctgatgttggtcgaaaacgagaagcagttcttgccacatttttgccagaggagcagggaagcttcaaaaagtttgcagagctggttggccggatgaatattactgaattcaaatacagatacgattgcaatgcaaaagatgcccttgtcctttacagtgttggcatctacactgacgatgaacttaaagcaatggtggaacgtatggaatcttcaaaattgagaactgttgatcttactgacaatgatttggcaaaggatcatctaagatactttattggtggcaggtcagaagtaacagatgaacttgtttaccggttcattttcccagaaaggcctggtgcacttatgaaatttttggatgcattcagcccccgctggaatatcagccttttccattaccgtgcacagggtgaaaccggagcgaatgttttggttggcatacaagtgccgccggaggagtttgacgaattcaagagccgtgctgacaatcttgggtacgagtacatgtcggagcagaacaacgagatataccggctcctcttgcgcgatccgaagatctaa

SEQ ID NO: 53684 - protein, 602 aa, Oryza sativa
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 53685 - DNA, 942 bp, Mus musculus
  CDS (1)..(942)
atggctgcccaggagtccctgcatgtgaagaccccacttcgtgacagcatggcgttgtccaaattggccggcaccagcgtgttcctaaaaatggacagctcccagccctcaggctccttcaagatccgaggcattgggcatctctgcaagatgaaagcaaaacaaggctgtagacattttgtctgttcttcagctggcaacgcgggcatggcgaccgcctacgctgccaggaggctgggcatcccagccactatcgttgtgcccaacaccacacctgccctcaccattgagcggctcaagaatgaaggcgccacagttgaagtggtgggagagatgctggatgaggccatccaagtggccaaggctctggaaaagaacaacccgggttgggtgtacatttccccctttgatgaccctctcatctgggaaggccacacttcccttgtgaaagagctgaaggagacgctgagcgccaagcccggggctatcgtgctgtctgtgggcggtggaggcctgctgtgcggagtggtccaggggctgcgggaggtgggctgggaggatgtgcccatcatcgccatggagacctttggcgcccacagcttccatgctgccatcaaggaaggaaagctggtcaccctgcccaagatcaccagtgtcgccaaggccttgggcgtgaacactgtcggggcgcagaccctgaagctgttttacgaacaccccattttctccgaggtcatctcagaccaggaggctgtgtctgctcttgagaagttcgtggacgatgagaagattctggtggagcccgcgtgcggcgcggcgctggctgctgtgtacagccgcgtggtgtgcaggctgcaggatgaaggccggctgcaaaccccactggcctcgctggttgtcatcgtgtgtggcggcagcaacacaagcctggcgcagctctag

SEQ ID NO: 53686 - protein, 313 aa, Mus musculus
MAAQESLHVKTPLRDSMALSKLAGTSVFLKMDSSQPSGSFKIRGIGHLCKMKAKQGCRHFVCSSAGNAGMATAYAARRLGIPATIVVPNTTPALTIERLKNEGATVEVVGEMLDEAIQVAKALEKNNPGWVYISPFDDPLIWEGHTSLVKELKETLSAKPGAIVLSVGGGGLLCGVVQGLREVGWEDVPIIAMETFGAHSFHAAIKEGKLVTLPKITSVAKALGVNTVGAQTLKLFYEHPIFSEVISDQEAVSALEKFVDDEKILVEPACGAALAAVYSRVVCRLQDEGRLQTPLASLVVIVCGGSNTSLAQL

SEQ ID NO: 53687 - DNA, 1806 bp, Nicotiana attenuata
  CDS (1)..(1806)
atggaagttctttgtcaagccccagctggaaactcaaattttgcctgtaaccccaaatttacagcaattagaaccagagcaatttctagcaatgacacatttaaagtaatttccagtactggcaacaacaagaaaatgaagggcgcgatacgtacttcgattccaaaaccatcagcattgccattgaaggtctcacaattatctccatcagctgattcaatgcctgttccagcgtctttgcaggacgtcgaggcggggaagttgatagagaataatccatcagggggcgatacagaggaattgtttcagtatcttgttgaaatattggcttctagagtgtatgatgtagcaattgattcccccttgcaaaatgcagctaagctttccaagaagcttggagttaacttttggatcaaaagagaggatatgcagtccgtgttctcgttcaagcttagaggagcttataacatgatgaccaaactctcaaaggagcagttagaaagaggggttataactgcttcagctggaaatcatgcacaaggtgttgcattaggtgctcagagacttaaatgtactgctacgattgtcatgcctgttaccacaccagagatcaagattgaagcagttaagaacttggatggtaaagtagttctacatggtgacacatttgataaagctcaggaacatgctttaaagttggctgaagatgaaggtctcacattcatcccgcctttcgatcacccagatgtgatcataggccaaggtacaattggaacggagattaatcgtcaacttaaagatatacatgcagtatttgtgcctgtaggaggaggaggtttaatagctggtgttgctgcatatttcaaaagggttgctcctcatacaaagattattggagttgagccatttggtgcaagttcaatgacacaatctttgtaccatggagaaagagtaaagttggaacaagttgataattttgcagatggcgtagctgttgcactagttggtgaagaaactttccgtctttgcaaagatttaatagacggaatggtcttagtcagtaacgatgctattagtgctgcagtaaaggatgtgtacgacgaaggacggaacatattagagacatcaggtgcacttgccatagctggagctgaagcttactgcaaatactataacataaagggcgaaaacgttgtagcaattgctagtggagccaatatggacttcagcaaactaaaattagtcgtcgatttagcagatattggtggacagagggaagctctgctggctacttttatgccagaagaaccaggaagcttcaaaaaattctgcgaacttgtgggacctatgaatattactgaatttaagtacagatataattctggaagaaaacaagctctggtactctacagtgttggtgttaatacaaaatcggatcttgagtcaatgttggagaggatgaaatcatcacagctgaatactgtcaatctcacaaataataatttggtcaaagaacatctaaggcatttgatgggaggcagatcagaaccaagtaatgagattttctgtcaattcatatttcctgagaagcctggagctttaaggaagtttttagatgctttcagccctcgttggaatataagtttgttccattatcgtgaacagggagaacttgatgcaagtgtgttagttggattccaagttccaaaaggtgagatagaagagttccgagttcaagctaacaatcttggttattcatatgaaatcgagagtctcaacgaggcttctcaacttataatggagtga

SEQ ID NO: 53688 - protein, 601 aa, Nicotiana attenuata
MEVLCQAPAGNSNFACNPKFTAIRTRAISSNDTFKVISSTGNNKKMKGAIRTSIPKPSALPLKVSQLSPSADSMPVPASLQDVEAGKLIENNPSGGDTEELFQYLVEILASRVYDVAIDSPLQNAAKLSKKLGVNFWIKREDMQSVFSFKLRGAYNMMTKLSKEQLERGVITASAGNHAQGVALGAQRLKCTATIVMPVTTPEIKIEAVKNLDGKVVLHGDTFDKAQEHALKLAEDEGLTFIPPFDHPDVIIGQGTIGTEINRQLKDIHAVFVPVGGGGLIAGVAAYFKRVAPHTKIIGVEPFGASSMTQSLYHGERVKLEQVDNFADGVAVALVGEETFRLCKDLIDGMVLVSNDAISAAVKDVYDEGRNILETSGALAIAGAEAYCKYYNIKGENVVAIASGANMDFSKLKLVVDLADIGGQREALLATFMPEEPGSFKKFCELVGPMNITEFKYRYNSGRKQALVLYSVGVNTKSDLESMLERMKSSQLNTVNLTNNNLVKEHLRHLMGGRSEPSNEIFCQFIFPEKPGALRKFLDAFSPRWNISLFHYREQGELDASVLVGFQVPKGEIEEFRVQANNLGYSYEIESLNEASQLIME

SEQ ID NO: 53689 - DNA, 1542 bp, Gamma
  CDS (1)..(1542): m means a or c
ttgagactaaaaattaaaaaaacaggttcttttaagaattcccagaagtacctaaagcttattcctaatgcatctgtttatgacgtagcattaaaatcacctataacatttgctctaaatatttcttcaaagctggggaataaagttttcctaaaaagagaggatctgcaacctatattttcttttaaaaacagaggagcgtataacaagattgtaaatttatccgatgccgaaaagaagaggggggttattgctgcatcagcaggaaatcatgctcaaggggtagccagtgcatgtaagaaattaaaaattaattgcttgatagttatgccaataacaactccagaaataaaaataaaagatgtaaaaagatttggagccaaaatactccaacatggggacaacgtagatgcagcattaaaagaggcactgtttattgcaaagaaaaaaaaattgtcttttgttcatccttttgacgaccctctaacaattgctggccaagggactataggacaagaaattcttgaagataaaaataattttgatgttgtctttgttccggtgggaggaggaggtattctagctggtgtatctgcctggatagcacagaataataagaaaataaaaattgttggtgttgaggttgaggattccgcttgtcttgctgaggccgtaaaagctaataaaagagttattttaaaagaagtgggcctctttgctgatggggtggcagtatcaagggttggaaaaaataattttgatgttattaaagagtgcgtagatgaagtcattacagttagcgttgatgaggtctgcaccgctgtaaaagatatctttgaagatacaagggttctatcagaacctgctggggcattagcacttgcagggttaaaagcctacgcaaggaaagttaaaaataaaaaacttattgctataagttctggcgctaatgtaaatttccaaagacttaattttattgttgagcgatcagagattggtgaaaatagagaaaaaatattaagtatcaaaatcccagagatacctggaagttttcttaagctttcaaggatgtttggcagctctcaagttacagagtttaactacaggaaatctagcttaagcgatgcatatgttttagttggtgttagaactaaaactgaaaaatcatttgaaatcttaaagtccaaattaaaaaaagcaggcttcacctttagcgactttactcgaaatgaaatatccaatgatcatctgaggcatatggttggtggcagaaatagtgactcaggctctcataacaatgaaagaatatttaggggagagtttcctgagaagccgggcgcgctgttaaattttctagagaaatttggaaataaatggmatatttccttatttcattacaggaacctaggttcagcttttggaaagatattaattggcatcgagagtaaggataaagacaagctaataaatcatttaaataagtcaggnactatttttacagaagaaacctctaacaaggcatacaaagattttttaaaatga

SEQ ID NO: 53690 - protein, 513 aa, Gamma
  misc_feature (460)..(460): Xaa can be Asn or His
MRLKIKKTGSFKNSQKYLKLIPNASVYDVALKSPITFALNISSKLGNKVFLKREDLQPIFSFKNRGAYNKIVNLSDAEKKRGVIAASAGNHAQGVASACKKLKINCLIVMPITTPEIKIKDVKRFGAKILQHGDNVDAALKEALFIAKKKKLSFVHPFDDPLTIAGQGTIGQEILEDKNNFDVVFVPVGGGGILAGVSAWIAQNNKKIKIVGVEVEDSACLAEAVKANKRVILKEVGLFADGVAVSRVGKNNFDVIKECVDEVITVSVDEVCTAVKDIFEDTRVLSEPAGALALAGLKAYARKVKNKKLIAISSGANVNFQRLNFIVERSEIGENREKILSIKIPEIPGSFLKLSRMFGSSQVTEFNYRKSSLSDAYVLVGVRTKTEKSFEILKSKLKKAGFTFSDFTRNEISNDHLRHMVGGRNSDSGSHNNERIFRGEFPEKPGALLNFLEKFGNKWXISLFHYRNLGSAFGKILIGIESKDKDKLINHLNKSGTIFTEETSNKAYKDFLK

SEQ ID NO: 53691 - DNA, 1113 bp, Bacillus halodurans
  CDS (1)..(1113)
atgcaagtggttcgctcgttcaaaatccgcggcgcgttccatcaaatttccagcattccgaaagaggaattaaacaacggggtcgtctgtgccagtgcaggaaatcacgcacaaggtgttgcgtattcctgtcacacgttgcaaattccggggaaaatttttatgccgacgacgacgccacggcaaaaagtagaccaagtcaaattcttcggtaaggaatatgtggaggtcatattaacaggggaaacgttcgatgattcttttaacgaagcgaaagagtacggaataaagcataaaatgacctttatccatccattcgatcaagaaaagattgttgcaggtcaaggaaccgttgggatggaaatcatgaacgatattgacgacaacattgattacttgttctgttcgattggtggaggcggccttattagtggtgttggaacatacattaaaagcattagcccgcggacgaaagtgatcggatgtgaaccggctggagcgccagccatgaaggaatcacttaagcaagggaaggttatcgagcttgaaaaaatcgacaaatttgtcgacggcgcagccgtaaaaaaggtcggagaaattccttttgaaatttgccaaaaaattctggaagatattgttctagtacctgagggaaaaatatgtacaaccatccttaacctctacaatcaagatgcgatcgtagcggagcctgcaggggcgatgccgattgctgcactcgacttttttaaagacgagatcaaaggaaagacagtcgtctgtgtgttaagtggtggaaacaacgatattggccggatgcaggaaatgagggaacgctcattgatctatgaaggattacagcattactttatcatccaatttccgcaacgagctggggcattgaaagaattcattcttgatgttctcggtccagatgatgacatcactcggtttgaatatacaaagaaaaacaataaatcaaatggccccgtattaatagggattgagctgaaatgtgatgaggactatcatcgtttaatggatcgtctcaacaaaaaaggttttgaatatcgtgaaattaataaaaatgagagtttgtttaacctgttaatttga

SEQ ID NO: 53692 - protein, 370 aa, Bacillus halodurans
MQVVRSFKIRGAFHQISSIPKEELNNGVVCASAGNHAQGVAYSCHTLQIPGKIFMPTTTPRQKVDQVKFFGKEYVEVILTGETFDDSFNEAKEYGIKHKMTFIHPFDQEKIVAGQGTVGMEIMNDIDDNIDYLFCSIGGGGLISGVGTYIKSISPRTKVIGCEPAGAPAMKESLKQGKVIELEKIDKFVDGAAVKKVGEIPFEICQKILEDIVLVPEGKICTTILNLYNQDAIVAEPAGAMPIAALDFFKDEIKGKTVVCVLSGGNNDIGRMQEMRERSLIYEGLQHYFIIQFPQRAGALKEFILDVLGPDDDITRFEYTKKNNKSNGPVLIGIELKCDEDYHRLMDRLNKKGFEYREINKNESLFNLLI

SEQ ID NO: 53693 - DNA, 1263 bp, Bacillus cereus
  CDS (1)..(1263)
atggtgcaaaaggtaaaggagagagtgaaaattgaagatatcttaatggctcataattgcatgaaagatatcgttattaaaacaccgttacaacgtgatacagttttatctgagaaatatgattgtgacgtttatgtaaaacgagaagatttacaattgattcgctctttcaaaattcgtggtgcgtacaatttaattcaaagcttaccgaaagaacaattacaaaacggtgttgtttgcgcaagcgctggtaatcacgcacaaggggtagcttttacgtgtaatttattgaagattccgtcaaaaatctttatgccaacaacgacgccgaaacaaaaagtatcgcaagtacaatttttcggtggtgatttcgcagagattgtattagttggtgatacattcgatagctcttttcaagaagcacagcgttattgtgaagaaaatagaatgacgtttgttcatccatttgatgatccgtatgtggttgctggtcaaggaacagtggcagttgaaattatgcatgatatggagaaaccagtggattatatctttacagcaattggcggcggtggattagcatcaggtgttggtacatatgtgaaaggtgttagtcctgctacaaaggttattggggtagagccaatgggagcagcatctatgaaagaggcttttcttcaaaacgataatgtcgcattggagaaaatagatagttttgttgatggagcagcagttaaaaaggtaggaaagttaacatttgaaacgtgtaaagatgtaattgatgacatcgttttagtaccagaaggaaaggtttgtacgacgattttagaactgtataagaaaaatgcgattgtagcagagcctgctggtgcactttctattgccgcacttgatctatacaaggatgaaattcaaggtaaaacagttgtatgcacattaagcggtggaaataacgatattgatagaatgcaagagatgaaagaacgttctctcatttacgaaggattaaaacattatttcatcattgaattcccgcagcgttcaggtgcgctaagagaatttcttgataaaggattaggaccagaagatgatattacgcgctttgagtatattaagaaacataataaggaaaatggtccagcgttagtcggagtagagttaaaacataaagaagattacgcgcagttaattacccgttttaaagaaaataacattcaatttatggagcttaataaaaatcctgttttgtttgatttacttatttaa

SEQ ID NO: 53694 - protein, 420 aa, Bacillus cereus
MVQKVKERVKIEDILMAHNCMKDIVIKTPLQRDTVLSEKYDCDVYVKREDLQLIRSFKIRGAYNLIQSLPKEQLQNGVVCASAGNHAQGVAFTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATKVIGVEPMGAASMKEAFLQNDNVALEKIDSFVDGAAVKKVGKLTFETCKDVIDDIVLVPEGKVCTTILELYKKNAIVAEPAGALSIAALDLYKDEIQGKTVVCTLSGGNNDIDRMQEMKERSLIYEGLKHYFIIEFPQRSGALREFLDKGLGPEDDITRFEYIKKHNKENGPALVGVELKHKEDYAQLITRFKENNIQFMELNKNPVLFDLLI

SEQ ID NO: 53695 - DNA, 987 bp, Homo sapiens
  CDS (1)..(987)
atgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtagtgcccggcaccacacctgctctcaccattgagcgcctcaagaatgaaggtgccacatgcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggagtgtggctggggggacgtgcctgtcatcgccatggagacttttggtgcccacagcttccacgctgccaccaccgcaggcaaacttgtctccctgcccaagatcaccagtgttgccaaggccctgggcgtgaagactgtggggtctcaggccctgaagctgtttcaggaacaccccattttctctgaagttatctcggaccaggaggctgtggccgccattgagaagttcgtggatgatgagaagatcctggtggagcccgcctggggcgcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtga

SEQ ID NO: 53696 - protein, 328 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPGTTPALTIERLKNEGATCKVVGELLDEAFELAKALAKNNPGWVYIPPFDDPLIWEGHASIVKELKETLWEKPGAIALSVGGGGLLCGVVQGLQECGWGDVPVIAMETFGAHSFHAATTAGKLVSLPKITSVAKALGVKTVGSQALKLFQEHPIFSEVISDQEAVAAIEKFVDDEKILVEPAWGAALAAVYSHVIQKLQLEGNLRTPLPSLVVIVCGGSNISLAQLRALKEQLGMTNRLPK

SEQ ID NO: 53697 - DNA, 984 bp, Mus musculus
  CDS (1)..(984)
atggctgcccaggagtccctgcatgtgaagaccccacttcgtgacagcatggcgttgtccaaattggccggcaccagcgtgttcctaaaaatggacagctcccagccctcaggctccttcaagatccgaggcattgggcatctctgcaagatgaaagcaaaacaaggctgtagacattttgtctgttcttcagctggcaacgcgggcatggcgaccgcctacgctgccaggaggctgggcatcccagccactatcgttgtgcccaacaccacacctgccctcaccattgagcggctcaagaatgaaggcgccacagttgaagtggtgggagagatgctggatgaggccatccaagtggccaaggctctggaaaagaacaacccgggttgggtgtacatttccccctttgatgaccctctcatctgggaaggccacacttcccttgtgaaagagctgaaggagacgctgagcgccaagcccggggctatcgtgctgtctgtgggcggtggaggcctgctgtgcggagtggtccaggggctgcgggaggtgggctgggaggatgtgcccatcatcgccatggagacctttggcgcccacagcttccatgctgccatcaaggaaggaaagctggtcaccctgcccaagatcaccagtgtcgccaaggccttgggcgtgaacactgtcggggcgcagaccctgaagctgttttacgaacaccccattttctccgaggtcatctcagaccaggaggctgtgtctgctcttgagaagttcgtggacgatgagaagattctggtggagcccgcgtgcggcgcggcgctggctgctgtgtacagccgcgtggtgtgcaggctgcaggatgaaggccggctgcaaaccccactggcctcgctggttgtcatcgtgtgtggcggcagcaacataagcctggcgcagctgcaggcactcaaggtgcagctgggcctgaacgggctgcccgagtga

SEQ ID NO: 53698 - protein, 327 aa, Mus musculus
MAAQESLHVKTPLRDSMALSKLAGTSVFLKMDSSQPSGSFKIRGIGHLCKMKAKQGCRHFVCSSAGNAGMATAYAARRLGIPATIVVPNTTPALTIERLKNEGATVEVVGEMLDEAIQVAKALEKNNPGWVYISPFDDPLIWEGHTSLVKELKETLSAKPGAIVLSVGGGGLLCGVVQGLREVGWEDVPIIAMETFGAHSFHAAIKEGKLVTLPKITSVAKALGVNTVGAQTLKLFYEHPIFSEVISDQEAVSALEKFVDDEKILVEPACGAALAAVYSRVVCRLQDEGRLQTPLASLVVIVCGGSNISLAQLQALKVQLGLNGLPE

SEQ ID NO: 53699 - DNA, 1023 bp, Homo sapiens
  CDS (1)..(1023)
atgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaa

SEQ ID NO: 53700 - protein, 340 aa, Homo sapiens
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 53701 - DNA, 1020 bp, Mus musculus
  CDS (1)..(1020)
atgtgtgctcagtactgcatctcctttgctgatgttgaaaaagctcatatcaacattcaagactctatccacctcaccccagtgctaacaagctccattttgaatcaaatagcagggcgcaatcttttcttcaaatgtgagctcttccagaaaactgggtcttttaagattcgaggtgcccttaatgccatcagaggcttaattcctgacacgccagaagagaagcccaaagccgtagttactcacagcagcggaaaccatggccaagctctcacctatgctgctaaactggaaggaattcctgcttacattgtggttccccaaacagctcccaactgcaagaaactggcaatccaagcctatggagcatcgatagtatactgtgacccaagtgacgagtccagagaaaaggtcactcaaagaattatgcaagaaacagaaggcatcttggtccatcccaaccaggagcctgcagtgatagctggacaaggaacaattgccctggaagtgctgaaccaggttcccttggtagatgcactggtggtaccagtaggaggaggaggaatggttgctggaatagccattacaattaaggccctgaaacctagtgtgaaggtatacgctgctgagccctcgaatgcagatgactgctaccagtctaaactgaaaggagaactgacccccaatcttcatcctccagaaaccatagcagatggtgtcaaatccagcattggcttgaatacctggcctattataagagaccttgtggatgatgtcttcactgtcaccgaagatgaaatcaagtatgcaacccagctggtgtgggggagaatgaaactgctcattgagccgactgctggcgtggcactggctgcagtgctgtctcagcatttccaaacagtctctccagaagtaaagaacgtctgcattgtactcagtggggggaatgtagacctaacctccctgaactgggtggggcaggctgaacggccagctccttaccagacggtttctgtttaa

SEQ ID NO: 53702 - protein, 339 aa, Mus musculus
MCAQYCISFADVEKAHINIQDSIHLTPVLTSSILNQIAGRNLFFKCELFQKTGSFKIRGALNAIRGLIPDTPEEKPKAVVTHSSGNHGQALTYAAKLEGIPAYIVVPQTAPNCKKLAIQAYGASIVYCDPSDESREKVTQRIMQETEGILVHPNQEPAVIAGQGTIALEVLNQVPLVDALVVPVGGGGMVAGIAITIKALKPSVKVYAAEPSNADDCYQSKLKGELTPNLHPPETIADGVKSSIGLNTWPIIRDLVDDVFTVTEDEIKYATQLVWGRMKLLIEPTAGVALAAVLSQHFQTVSPEVKNVCIVLSGGNVDLTSLNWVGQAERPAPYQTVSV

SEQ ID NO: 53703 - DNA, 1083 bp, Saccharomyces cerevisiae
  CDS (1)..(1083)
atgtcgatagtctacaataaaacaccattattacgtcaattcttccccggaaaggcttctgcacaatttttcttgaaatatgaatgccttcaaccaagtggctccttcaaaagtagaggaatcggtaatctcatcatgaaaagtgccattcgaattcaaaaggacggtaaaagatctcctcaggttttcgctagttctggcggtaatgccggttttgctgctgcaacagcatgtcaaagactgtctctaccatgtacagtcgtggttcctacagcgacaaagaagagaatggtagataaaatcaggaacaccggtgcccaggttatcgtgagtggtgcctactggaaagaagcagatacttttttaaaaacaaatgtcatgaataaaatagactctcaggtcattgagcccatttatgttcatcccttcgataatccggatatttgggaaggacattcatctatgatagatgaaatagtacaagatttgaaatcgcaacatatttccgtgaataaggttaaaggcatagtatgcagcgttggtggaggtggtttatacaatggtattattcaaggtttggaaaggtatggtttagctgataggatccctattgtgggggtggaaacgaatggatgtcatgttttcaatacttctttgaaaataggccaaccagttcaattcaagaagataacaagtattgctacttctctaggaacggccgtgatctctaatcaaactttcgaatacgctcgcaaatacaacaccagatccgttgtaatagaggacaaagatgttattgaaacctgtcttaaatatacacatcaattcaatatggtgattgaaccggcatgtggcgccgcattgcatttgggttacaacactaagatcctagaaaatgcactgggctcaaaattagctgcggatgacattgtgataattattgcttgtggcggctcctctaatactataaaggacttggaagaagcgttggatagcatgagaaaaaaagacactcctgtaatagaagtcgctgacaatttcatatttccagaaaaaaatattgtgaatttaaaaagtgcttga

SEQ ID NO: 53704 - protein, 360 aa, Saccharomyces cerevisiae
MSIVYNKTPLLRQFFPGKASAQFFLKYECLQPSGSFKSRGIGNLIMKSAIRIQKDGKRSPQVFASSGGNAGFAAATACQRLSLPCTVVVPTATKKRMVDKIRNTGAQVIVSGAYWKEADTFLKTNVMNKIDSQVIEPIYVHPFDNPDIWEGHSSMIDEIVQDLKSQHISVNKVKGIVCSVGGGGLYNGIIQGLERYGLADRIPIVGVETNGCHVFNTSLKIGQPVQFKKITSIATSLGTAVISNQTFEYARKYNTRSVVIEDKDVIETCLKYTHQFNMVIEPACGAALHLGYNTKILENALGSKLAADDIVIIIACGGSSNTIKDLEEALDSMRKKDTPVIEVADNFIFPEKNIVNLKSA

SEQ ID NO: 53705 - DNA, 1269 bp, Bacillus subtilis
  CDS (1)..(1269)
atgaaaccgttgcttaaagaaaactctctcatccaagtgaaacacattttgaaggctcaccaaaacgtaaaggacgttgtcattcacacacctttgcagaggaatgacagactttctgagagatatgaatgcaatatctatttaaaacgcgaagacttgcaagttgtcagatcttttaagctcagaggggcttatcataaaatgaaacagctttccagcgagcagacagagaacggagttgtgtgtgcaagtgccggaaaccacgctcaaggtgtggcattttcgtgtaaacatcttggcattcacgggaaaatttttatgccgtctactacaccgagacaaaaagtatctcaagttgaactattcggaaaaggatttatcgatattattttgacaggcgatacgtttgacgacgtgtataaaagcgctgctgaatgctgtgaggcggaatctcggacgtttatccatccgttcgatgatccggatgtgatggccggacagggaacgctcgcagtcgagattttaaacgacattgatacagaaccgcattttctttttgcaagtgtcggaggcggcggccttctctctggggtaggtacatatttgaaaaacgtgtctcctgatacaaaggtaattgctgttgagccggcgggagcggcatcctactttgaatcaaacaaagctgggcatgtcgtcacacttgataaaattgataagtttgtagatggggcggctgttaaaaaaattggcgaggaaaccttccggacgctggaaactgtcgttgatgacattctccttgtgcctgaaggaaaagtatgtacatccattcttgaattatataacgaatgtgcggttgttgctgaaccggctggagctctttctgtcgcagcgcttgatttgtacaaggatcaaattaaagggaaaaacgtggtgtgtgtggtaagcgggggcaataacgatatcggaagaatgcaggaaatgaaggagcgttccttgatttttgaaggccttcagcattattttatcgtcaattttccacaaagagcgggggcgctccgcgaatttcttgacgaagtcctcgggccgaatgatgacattacaaggtttgaatatacgaagaaaaataataaaagcaatggacctgctcttgtcggcatcgagctgcagaacaaagccgattatgggccgctgattgaacggatgaacaaaaaaccgtttcattatgtagaggtgaacaaggatgaggacttgttccatttgctaatctaa

SEQ ID NO: 53706 - protein, 422 aa, Bacillus subtilis
MKPLLKENSLIQVKHILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDVYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 53707 - DNA, 1773 bp, Cicer arietinum
  CDS (1)..(1773)
atgctctcgacctccacgaccaattcttccattctgcccttccggtctagggcaagtagttctacttttatcgcgcgccccccagccaacttcaactccatctttacgacttcggtgagggtcttcccaatcagtatgtcacgatattgcgtttttccacatacttgggagcgagatcataacgttcctggagttcctggagttttacgaaaagtggttccagcagcacctattaagaacaaaccaacttgtgcagattcagatgagttacctgagtacttaagagacgtactacgctcacctgtttacgacgtagttgtcgagtcacctgtcgagctaactgagagattatcagatcgcttaggtgttaacttttacgttaaaagagaggatcgccaacgcgttttttcatttaaattacgcggtccatacaatatgatgtcatcattatcacatgaggaaattgataaaggtgttatcaccgcatcagcaggaaaccatgcacaaggagtcccatttccatttccaggaagacgcctaaaatgtgtcgcaaaaattgtcatgccaactactactccaaacattaaacttgatggtgtccgcgcactaggagcagatgttgtattatggggtcatacttttgatgaggcaaaaacccatgctgtcgagttatgtgagaaggatggattaagaactattcctccatttgaggatccagcagtaattaaaggacaaggtactattggaagtgagattaacagacaaattaaacgcattgacgcagtttttgtacctgttggtggaggtggtttaattgctggcgttgcagcatttttcaaacaaattgctccacaaactaaaattattgtagttgagccatatgatgcagcatcaatggcattatcagttcatgcagagcacagagcaaaattatcaaatgtcgatacttttgcagacggtgcaactgtcgccgtaattggtgagtatacttttgcaagatgccaagacgttgttgatgcaatggttctagttgcaaacgatggaattggtgcagcaataaaggatgtttttgatgagggtcgaaacatagttgagacttcaggtgcagcgggcattgcaggaatgtattgtgagatgtacagaataaagaatgacaacatggtgggaattgtaagcggagctaacatgaacttcagaaaactccataaggtttcagaattagcagtgttgggttcaggacacgaggcattattgggtacttatatgccaggtcaaaaaggatgttttaaaactatggcaggtttagttcatggatcactctcatttactgagattacttacagatttacttcacatcgcagatcgatactggtactaatgcttaagctcgagccatggcggtatattgagaaaatgattgaaatgatgaaatatagtggtgttactgttttaaacatttcacataacgagttagcagttattcatggtaaacatttagtcggaggatcagcaaaagtctcagatgaggtctttgtagagtttataattccagagaaagcagatctaaaaaaatttctagaggtattatcacctcattggaaccttactttatacaggtaccgcaaccaaggagacttaaaagcaacgattttaatggtcatagctagtttcctgtgtgaaattgttatccgtaaaaaccaaattgatgatttaggatacccatatgaaattgatcaatacaacgacgcatttaacttagcggtaacagagtaa

SEQ ID NO: 53708 - protein, 590 aa, Cicer arietinum
MLSTSTTNSSILPFRSRASSSTFIARPPANFNSIFTTSVRVFPISMSRYCVFPHTWERDHNVPGVPGVLRKVVPAAPIKNKPTCADSDELPEYLRDVLRSPVYDVVVESPVELTERLSDRLGVNFYVKREDRQRVFSFKLRGPYNMMSSLSHEEIDKGVITASAGNHAQGVPFPFPGRRLKCVAKIVMPTTTPNIKLDGVRALGADVVLWGHTFDEAKTHAVELCEKDGLRTIPPFEDPAVIKGQGTIGSEINRQIKRIDAVFVPVGGGGLIAGVAAFFKQIAPQTKIIVVEPYDAASMALSVHAEHRAKLSNVDTFADGATVAVIGEYTFARCQDVVDAMVLVANDGIGAAIKDVFDEGRNIVETSGAAGIAGMYCEMYRIKNDNMVGIVSGANMNFRKLHKVSELAVLGSGHEALLGTYMPGQKGCFKTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTLYRYRNQGDLKATILMVIASFLCEIVIRKNQIDDLGYPYEIDQYNDAFNLAVTE

SEQ ID NO: 53709 - DNA, 1311 bp, Corynebacterium glutamicum
  CDS (1)..(1311)
atgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcacctggttctgtcgtggtgtgcatcatctctggtggcaacaacgatgtgctgcgttatgcggaaatcgctgagcgctccttggtgcaccgcggtttgaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacctaa

SEQ ID NO: 53710 - protein, 436 aa, Corynebacterium glutamicum
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 53711 - DNA, 1545 bp, Escherichia coli
  CDS (1)..(1545)
atggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttag

SEQ ID NO: 53712 - protein, 514 aa, Escherichia coli [sequence omitted]

SEQ ID NO: 53713 - DNA, 1251 bp, Lactococcus lactis
  CDS (1)..(1251)
atgataagtgccaaagaggttgaagatgcctatgatttgttaaaagcagttgtcactaaaacacctttacaattagacccctacctttccaataaatatcaagcaaatatttacttaaaagaagaaaatttacagaaagttcgttcttttaaattacgaggagcttattattctatcagtaaattatctgatgagcaacgctctaaaggagtggtttgtgcctccgcaggtaatcacgcacaaggagttgcttttgctgcaaatcaattaaatatttctgcgacaattttcatgcccgttactacacctaaccaaaaaatttcacaagttaaattttttggcgaaagtcatgtaacaattcgtttaattggtgatacttttgatgaatcagccagagcagcaaaagctttttctcaagataatgacaaaccatttatagacccttttgatgatgaaaatgtaattgctggtcaagggacagtggctttagaaatttttgcgcaagctaaaaaacaaggaataagtttagataagatttttgtacagattggtggaggtggtttaattgcaggaattacggcctacagtaaggagcgctatccccaaactgaaattattggagttgaagcaaaaggggcaacaagtatgaaagctgcctactctgctggtcagcccgtcaccttggaacacattgataaatttgctgacggaattgcggttgcgactgttggtcagaaaacttaccaacttattaatgacaaagtgaaacaattgcttgcggttgatgaaggtttaatttctcaaaccatactcgaattgtattcaaaattaggaattgtcgccgaaccagcaggtgcaacatctgttgccgcacttgaacttattaaagatgaaatcaagggtaaaaatattgtctgtatcatcagcggcggaaataatgatattagtcgaatgcaagaaattgaagaaagagctttggtttatgaaggtctaaaacattattttgtcattaactttcctcaaagaccaggagccttaagaacttttgtcagtgatattttagggccaaatgatgatattacccgatttgagtacatcaaaagggctgataaaggtaaagggccttgtcttgttgggattttactttcagatgctagtgattatgattcattgattgatcggattgaaagatttgataatcgttatgttaacttacatggaaatgatagtttatacgaacttttggtctaa

SEQ ID NO: 53714 - protein, 416 aa, Lactococcus lactis
MISAKEVEDAYDLLKAVVTKTPLQLDPYLSNKYQANIYLKEENLQKVRSFKLRGAYYSISKLSDEQRSKGVVCASAGNHAQGVAFAANQLNISATIFMPVTTPNQKISQVKFFGESHVTIRLIGDTFDESARAAKAFSQDNDKPFIDPFDDENVIAGQGTVALEIFAQAKKQGISLDKIFVQIGGGGLIAGITAYSKERYPQTEIIGVEAKGATSMKAAYSAGQPVTLEHIDKFADGIAVATVGQKTYQLINDKVKQLLAVDEGLISQTILELYSKLGIVAEPAGATSVAALELIKDEIKGKNIVCIISGGNNDISRMQEIEERALVYEGLKHYFVINFPQRPGALRTFVSDILGPNDDITRFEYIKRADKGKGPCLVGILLSDASDYDSLIDRIERFDNRYVNLHGNDSLYELLV

SEQ ID NO: 53715 - DNA, 1788 bp, Lycopersicon esculentum
  CDS (1)..(1788)
atggaattcctttgtttagccccaacacgtagtttttccaccaatcccaaattaacaaaaagtattcctagcgatcatactagtaccacgagtcgtattttcacataccaaaacatgcgtggctcaacgatgagaccattagcgttgccgttaaaaatgtcaccaattgtttctgtgccggatattacagctccggtggaaaatgttccggctatcttgccaaaagtcgttcccggagagttgatagtgaataaaccaacggggggcgatagcgatgaattgtttcaatatttagttgatattttggcatcgccagtgtatgatgtagcgatcgaatcgccattagagctagcagagaagctctcggataggctcggagttaatttttatatcaaaagagaagataaacagagggtgttttcattcaagcttagaggagcttacaacatgatgagtaacctctcaagggaggaattagataaaggggttataacagcatcagctggaaatcatgcacaaggtgtagcattagctggtcaaagacttaactgtgtagctaaaattgtcatgcctacaaccaccccacaaatcaagattgatgcggttagagccctgggaggtgatgtagttctttatggtaaaacatttgatgaagctcaaacacacgcgctggaattgagtgaaaaagacgggctcaaatacatcccaccattcgatgatccaggagtcatcaaaggccaaggtacaattggaacagagataaaccgtcaactgaaggacattcacgctgtgtttatacctgttggtggtgggggtttgatagctggtgttgctacctttttcaaacaaattgccccaaatacaaaaattattggagttgagccatatggtgcagcttcaatgacattgtcattgcatgaaggacatagagtgaaattatcaaatgttgatacttttgctgacggtgtagctgttgcactagttggtgaatacacttttgcaaaatgccaagagttaattgatggaatggtacttgttgcaaatgatggtattagtgctgcaataaaggatgtgtatgatgaaggaaggaacatattagagacatcaggtgcagtggccatagctggagctgcagcctattgtgaattttataaaataaaaaatgaaaatattgtagcaattgcaagtggagctaatatggatttcagcaaactacacaaagttacagagttagcagggttaggttcaggcaaagaggctttattggctacttttatggtagaacaacaaggaagcttcaagacatttgttggacttgtgggctctttgaattttactgaattgacatacagattcacttctgaaaggaaaaatgctctaattttgtacagggttaatgttgataaagaatcagatcttgaaaaaatgattgaggatatgaaatcatcaaatatgactactcttaatctctcacataatgaattggttgtagaccatctaaaacatttggttggtggctcagcaaatatcagtgatgaaattttcggtgaatttattgtacctgagaaggctgaaactttaaaaacattcttagacgctttctcccctcgttggaatataactttatgccgttaccgtaatcagggagatataaatgcaagtttgttgatgggattccaagttcctcaagctgagatggatgagttcaaaaatcaagctgataagcttggttatccatatgaacttgataattataatgaggcttttaaccttgtagtaagtgagtga

SEQ ID NO: 53716 - protein, 595 aa, Lycopersicon esculentum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 53717 - DNA, 1290 bp, Mycobacterium bovis
  CDS (1)..(1290)
gtgtccgccgaactgagccagagcccgagcagctcgccgctgttttcactatctggggcagacatcgaccgtgccgccaagcggatcgcaccggtagtcacgcccaccccgttgcaacctagcgatcggttgtcggcgatcactggcgccacggtctacctcaagcgcgaagacttgcagacggtgcgctcttataagctacgcggagcgtacaacctgttggtgcagttgtccgatgaggaactggccgcgggcgtggtgtgttcttctgcgggcaaccacgcgcagggcttcgcgtatgcgtgtcgctgtctgggtgtgcacggccgggtctacgtacctgccaaaacccccaagcagaagcgtgaccggatccgctaccacggcggggagttcatcgacctgatcgtgggtgggtcgacctatgatctggctgcggcggcggcccttgaggacgtggaacgcaccggggccacgctggtaccgccgtttgacgacctgcgcaccatcgccggccagggcacgatagccgtcgaagtgcttggccagctcgaggacgagccggacctggtggtggtcccggtgggtggcggcggctgcatcgcggggatcaccacctacctggccgagcggacgaccaacaccgcggtgctgggcgtcgagccggctggtgcggccgccatgatggccgcgctcgcggcgggcgagccggtgacgctggaccatgtcgaccagttcgtcgacggcgccgcggtgaaccgggcgggcacgctgacctatgccgcgctagccgccgccggcgacatggtttcgctcaccaccgtcgacgagggtgcggtgtgcacggcgatgctcgatctgtatcagaacgagggcatcatcgccgaaccggccggtgccctgtcggtcgccggtctgttggaagccgacatcgagcccgggtccaccgtggtgtgcctgatttcgggcggcaacaacgacgtgtcccgttacggggaggtgttggagcgctcgctggtccacctgggcctcaagcactatttcctggtcgacttcccgcaggagcccggtgcgctgcgccggtttctcgacgacgtgctcggacccaacgacgacatcaccttgttcgagtacgtcaagcgcaacaaccgggagaccggtgaggcgctggtgggtatcgagctgggatcggccgcggatctagacggtctgctggcccggatgcgggcgaccgacattcacgtcgaggcgttggaaccggggtcgccggcttaccgctatctgctgtag

SEQ ID NO: 53718 - protein, 429 aa, Mycobacterium bovis
MSAELSQSPSSSPLFSLSGADIDRAAKRIAPVVTPTPLQPSDRLSAITGATVYLKREDLQTVRSYKLRGAYNLLVQLSDEELAAGVVCSSAGNHAQGFAYACRCLGVHGRVYVPAKTPKQKRDRIRYHGGEFIDLIVGGSTYDLAAAAALEDVERTGATLVPPFDDLRTIAGQGTIAVEVLGQLEDEPDLVVVPVGGGGCIAGITTYLAERTTNTAVLGVEPAGAAAMMAALAAGEPVTLDHVDQFVDGAAVNRAGTLTYAALAAAGDMVSLTTVDEGAVCTAMLDLYQNEGIIAEPAGALSVAGLLEADIEPGSTVVCLISGGNNDVSRYGEVLERSLVHLGLKHYFLVDFPQEPGALRRFLDDVLGPNDDITLFEYVKRNNRETGEALVGIELGSAADLDGLLARMRATDIHVEALEPGSPAYRYLL

SEQ ID NO: 53719 - DNA, 1284 bp, Mycobacterium leprae
  CDS (1)..(1284)
atgtccgccgaacctagtagaaaccccaggaccccaccggtgtccgcggttgacattgacggtgcggcgaagcggatcgcgccggtggtcacgcctaccccgttgcaacttagcgatcggttgtcggcgatcactggtgcagcggtgtacctcaagcgtgaagacctgcagacggtgcgctcttacaaactgcgcggcgcctacaacctgttggtgcagctgaccgacgaggagatcgccgccggcgttgtgtgctcttcggcgggtaaccatgcacagggtgtcgcgtatgcatgtcggtcactgggtgtgcacggccgtgtctatgtacctgccaagacacccaaacaaaagtgggatcggatccgctaccatggcggggcattcatcgagctgatcgtcgggagatcgacctacgatctcgccgctgccgcggcggtcgacgacattgaacgcaccggcgcgacgttggtacctccttatgacgacgtccgcgtcatcgctggtcagggcaccattgccgtcgagttgctggagcaactcaacaccgagcctgacctagtggtggtcccggtgggcggcggtggctgcatcgccggcatgaccacttacttggccgaacgaacggcgaacactgctgtgcttggtgtcgagccggctggtgccgcggctatgatggccgcgctggccgcgggtgagccggtgacactggactacgtcgatcagttcgtggatggcgctgcggtgaaccgggtgggaacgttgccttatgccgcgttgactgccgcaggtgacatggtgtccatcaccaccgtcgacgagggggcggtgtgcactgcgatgctcgacctttaccagaacgagggcattatagctgagccggcgggcgcactgtcagtagctgggctgctggaaactgacattgaacccgggtccaccgtggtttgcctgatctcgggcggcaacaacgacgtattgcgctacggtgaggtgttggagcgttcgctgatccacctaggtctcaaacactatttcctggtagacttcccccagaagcctggtgccttgcgccgttttcttgacgaagtgcttggacccaacgacgacatcaccttgttcgagtacgtcaagcgcaacaaccgagagaccggcgaggcgctggtaggtatccagctggggtctgctgtcgacttagacgtcctgctggcccggatgcaggggaccgaaatgcacgtcgaaaccctacaaccaggttcgccggcctaccgctacctgttgctttag

SEQ ID NO: 53720 - protein, 427 aa, Mycobacterium leprae
MSAEPSRNPRTPPVSAVDIDGAAKRIAPVVTPTPLQLSDRLSAITGAAVYLKREDLQTVRSYKLRGAYNLLVQLTDEEIAAGVVCSSAGNHAQGVAYACRSLGVHGRVYVPAKTPKQKWDRIRYHGGAFIELIVGRSTYDLAAAAAVDDIERTGATLVPPYDDVRVIAGQGTIAVELLEQLNTEPDLVVVPVGGGGCIAGMTTYLAERTANTAVLGVEPAGAAAMMAALAAGEPVTLDYVDQFVDGAAVNRVGTLPYAALTAAGDMVSITTVDEGAVCTAMLDLYQNEGIIAEPAGALSVAGLLETDIEPGSTVVCLISGGNNDVLRYGEVLERSLIHLGLKHYFLVDFPQKPGALRRFLDEVLGPNDDITLFEYVKRNNRETGEALVGIQLGSAVDLDVLLARMQGTEMHVETLQPGSPAYRYLLL

SEQ ID NO: 53721 - DNA, 1542 bp, Pasteurella multocida
  CDS (1)..(1542)
atggtcaataacctccattcagctcacccaacaggtgcagaatacctcaaagccgtgttgagttctaaagtctatgacgtggcgcaagtgactccgcttcaagacatggcaaaactgtctgaacgtttaggtaataaagtgtttatcaaacgtgaagatcgccaacccgtacacagtttcaaactgcgtggtgcgtatgccatgattgctggcttaagtgccgaacaaaaagcctcgggcgtgattgccgcctcagcgggaaaccatgcacaaggcgtggcgctgtctgccaaacatcttggcttgcgtgccttaatcgtgatgccacaaaacaccccaagtatcaaagtcgatgccgtgcgtggatttggtggtgaagtgctattacatggcgccaatttcgatgaagccaaagccaaagcgattgaattggcggaaagcaaaaatatgacattcattccgccttttgatcaccccgcggtgattgcaggacaaggctcgattgccatggaattgttacaacaaaacagccaaattgatcgtatttttgtccctgttggtggcggtggcttagccgcaggcattgctgtattaattaaacaattaatgcccgaaatcaaagtaattggggttgagtcgaaagattccgcctgcttgtatcgtgctctcaaagcaggtaagcccattgatttagatcgcgttggcttatttgctgacggggtcgcagtgaaacgtattggcgatgagactttccgcgtttgtcagcaatatattgatgatgtagtgttagtagatggtgatgaaatctgcgctgcggtcaaagatatttttgagaatgtgcgcgctattgctgaaccgtcgggggcattatcgcttgctggtttaaaaaaatacgtgaaagagcacaatattcaaggtgaaaccttggtgaatgtattatctggtgccaatttaaatttccataccttacgttatgtgtcagagcgttgtgaaattggtgaacagcacgaagcccttttagccgtgaccattcctgaacaaccagggagtttcttaaaattctgccatattttaggtcatgtccctgttactgaatttaaataccgttatgccgacgacaaacaagcttgtattttcgtgggggtacgcattacagggcaagaagaaaaacaaacgatcatcaatcaattacaacaaaatggttatgatttaattgatttgtctaatgatgatatcgccaaaacgcatgtacgctatatgattggcggacgttcaaacagtcccttaaaagagcgtttatacagttttgaattcccagaacaaaaaggcgccttattaaaattcctcgaaactttggggcaaacacattggaatatttccgtgttccattatcgtgcgcacggggcagattacggtaacgtgcttgctggcttccaattaaatgatgaagatctcgacgcctttaatcagcatttggaaaaactgggttatgtctatcaagatgtcacagaaagccctgcttatcgttatttcttagtgtaa

SEQ ID NO: 53722 - protein, 513 aa, Pasteurella multocida
MVNNLHSAHPTGAEYLKAVLSSKVYDVAQVTPLQDMAKLSERLGNKVFIKREDRQPVHSFKLRGAYAMIAGLSAEQKASGVIAASAGNHAQGVALSAKHLGLRALIVMPQNTPSIKVDAVRGFGGEVLLHGANFDEAKAKAIELAESKNMTFIPPFDHPAVIAGQGSIAMELLQQNSQIDRIFVPVGGGGLAAGIAVLIKQLMPEIKVIGVESKDSACLYRALKAGKPIDLDRVGLFADGVAVKRIGDETFRVCQQYIDDVVLVDGDEICAAVKDIFENVRAIAEPSGALSLAGLKKYVKEHNIQGETLVNVLSGANLNFHTLRYVSERCEIGEQHEALLAVTIPEQPGSFLKFCHILGHVPVTEFKYRYADDKQACIFVGVRITGQEEKQTIINQLQQNGYDLIDLSNDDIAKTHVRYMIGGRSNSPLKERLYSFEFPEQKGALLKFLETLGQTHWNISVFHYRAHGADYGNVLAGFQLNDEDLDAFNQHLEKLGYVYQDVTESPAYRYFLV

SEQ ID NO: 53723 - DNA, 1545 bp, Salmonella typhimurium
  CDS (1)..(1545)
atggcggaatctcaacctctgtcagtcgcgccggaaggggcggagtatctgcgcgcggtgctacgcgcgccagtatacgaagcggcgcaggtgacaccgctgcaaaaaatggaaaagctctcgtcacgtctggacaacgttattctcgtcaaacgcgaagaccggcagccggtacatagctttaagctgcgcggcgcttacgcgatgatggccggattgaccgaagaacaaaaagcccacggcgtgattaccgcgtcggcggggaaccatgcacagggcgtggcgttttcctccgcgcggcttggcgtgaagtcgctgatcgtcatgccaaaagcaacggcggatattaaagtcgatgcggtacgcggttttggcggcgaagtgctgttgcacggcgctaattttgatgaagcgaaagcgaaagctattgaactggcgcagcagcagggttttacttgggtgccgccgtttgatcacccaatggtgatcgccgggcagggcacgctggcgctggaactgcttcagcaggattcgcatctcgatcgtgtctttgtgccggttggcggcggcggcctggcggcgggcgtagcggtactgatcaaacaattgatgccgcaaatcaaagtgattgccgtcgaagcggaggattccgcctgcctgaaagcggcgttggaagccggtcatccagtggatctcccgcgcgttgggttgtttgctgaaggcgtagcggtaaaacgcatcggcgacgaaaccttccgcctgtgccaggaatatctcgacgacattattacagtcgatagcgacgctatctgcgcggcgatgaaagatctgtttgaagatgtgcgtgcggtggcggagccgtccggcgcgctggcgctggcggggatgaagaaatatatcgcccagcacaatattcgcggcgaacgcctggcgcacgtcctttccggcgccaacgtcaacttccacggcttgcgctatgtgtctgaacgctgcgagctgggggaacagcgcgaagcgttactggcggtgaccattccggaagaaaaggggagctttctcaaattctgccagttgcttggcgggcgtatggtcaccgaatttaactaccgttttgccgacgcgaaaaatgcctgtatttttgtcggcgtacgcgtcagtcaggggctggaggagcgaaaagagattatcacccaactgtgcgacggcggttatagcgtagtggatctctccgacgatgaaatggcgaagctgcatgtgcgctatatggtcggcggacgcccctccaagccattacaggagcgtttgtatagtttcgaatttccggagtcgcccggcgcgttgctcaaattcctgcatacgcttggcacgcactggaatatttcgctattccattaccgtagccacggtaccgattatggccgcgtgctggcggcgttcgagttaggcgatcatgagccggatttcgaaacccggctgcatgagctgggctatgaatgccatgatgagagcaataacccggcgttccggttctttctggcgggttaa

SEQ ID NO: 53724 - protein, 514 aa, Salmonella typhimurium
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKNACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 53725 - DNA, 990 bp, Salmonella typhimurium
  CDS (1)..(990)
atgcacattacatacgatctcccggttgcaattgaagatatcctcgaagcgaaaaaaagactggcggggaagatatataaaacgggaatgcctcgctctaactattttagtgaacgttgcaaaggcgaaatatttctcaagtttgaaaatatgcagcgtacgggttcatttaaaattcgtggcgcttttaacaaacttagctcgttaacggaggcggaaaaacgtaaaggcgtcgtggcctgttccgcaggtaatcatgcacagggcgtttctctttcttgcgcaatgctgggtattgacggcaaagtcgtgatgccgaagggcgcgccaaagtcaaaagtggcggccacctgtgattattcggcggaagtggtgctccacggtgacaacttcaatgacaccatcgctaaggtgagtgaaattgtcgaaaccgaaggccgcatttttattccgccttacgacgatccaaaagtcattgccggacagggcactattggtctggaaattatggaagatctgtacgatgtcgataatgtcatcgtgcctattggcggcggcggtttaattgcaggtattgccattgcgattaaatcgattaacccgaccattaaagttatcggcgtacaggccgaaaatgttcacggtatggcggcgtcttattacactggcgaaataaccacgcaccgaacgaccggcaccctggcggatggttgtgatgtctcccgcccgggtaatttaacctatgaaatcgttcgtgaattagtcgatgacattgtcctggttagcgaagatgaaattcgtaacagcatgatcgctttaattcagcgcaataaggttattactgaaggcgctggcgctctggcttgcgccgcactattaagtgggaaattagatagccatattcagaacagaaaaacggtcagtattatttctggcggcaatatcgatctttctcgggtatcacaaattacgggtttagttgacgcttaa

SEQ ID NO: 53726 - protein, 329 aa, Salmonella typhimurium
MHITYDLPVAIEDILEAKKRLAGKIYKTGMPRSNYFSERCKGEIFLKFENMQRTGSFKIRGAFNKLSSLTEAEKRKGVVACSAGNHAQGVSLSCAMLGIDGKVVMPKGAPKSKVAATCDYSAEVVLHGDNFNDTIAKVSEIVETEGRIFIPPYDDPKVIAGQGTIGLEIMEDLYDVDNVIVPIGGGGLIAGIAIAIKSINPTIKVIGVQAENVHGMAASYYTGEITTHRTTGTLADGCDVSRPGNLTYEIVRELVDDIVLVSEDEIRNSMIALIQRNKVITEGAGALACAALLSGKLDSHIQNRKTVSIISGGNIDLSRVSQITGLVDA

SEQ ID NO: 53727 - DNA, 1653 bp, Arxula adeninivorans
  CDS (1)..(1653)
atgtctaatatatcgactccgcgcatctcggggctgactgaatatacttctcagcctgataaatcccattacgactctatcgaatcccatttcttgcttcctgatggaaccccagactatttaaagctcattctcacttcaaaagtgtacgatgtttgcaacgagacccccgtaactcctgcggtcaatttgtcgtcaaagctgggcgccaacatctttctcaaaagagaggatctccagccggtattttcgttcaagcttcgaggagcttacaacatgatggctcatttgcctcaggagactcgatggaagggtgtcattgcatgctctgctggtaaccatgctcagggagtagcatactcggccaaacatctcaacattcctgccacaattgtcatgcccgtggtgacccctgctatcaagtacaagaacgtggaccgactgggagcaaaggtagtgctccatggtaacgattttgatgccgcaaaggccgagtgcaatcgattgtcggaaaagcacggattgactaatattcctctttttgacaacccctatgtgattgcgggacagggcacaattggagtggagcttctgcgccagattgacgtggaatcgctcaaggctatttttgtgtgcattggtggaggaggacttattgctggagtgggggcctacattaagcgtattgctcctcaggtaaaaatcattggtgtggaaacttatgacgccaatgccatgcgccagtcgctgcagaagggtgaacgaatcactctgtcagaggtaggattgtttgccgacggtgctgcagttaaaattcttggagaggagactttccggttgtgccaacaagtggtagatgaaattgtattggtgtctactgacgagatttgtgctgctattaaggatgtgtttactgagactcgatccatcgtcgagcccgctggtgcgctgtcggtggcaggactcgtcaagtacgttgaatctcaccctgaaattgatcactctgcctccggatacactgccatcttgtcaggagcgaatatggattttgaccgactgcgatttgtttctgaacgagcaaagctcggagagggatccgaggtgttcattgtagccaccatccccgagaagcctggttcgtttggaaagctcattgatctggtccaccctcgagccgttactgagtttagctacagatactccaatggagaactagaaaagagcgacggaaaggcccatgtgtacatttcattttcagttgataatgctaaagctgaagtgccccgcatcctcgatgatttcaagggagctgggttcgatgctattgatatctcccacaatgagtttccaaaaagtcacccaagatacttggtaggagcaaaccagccagttaccaatgagagagtgttccgatttgagttccccgaaagaccaggagctttggtgaaattccttcacggagtcaaatccaagtggaacattactctgttccactaccgaaaccagggatcggacattgcaaaggtcttggctggtatctctgtaccttctcacgagagcgatcaattccagcaattcttggacaatcttgagtacccatatgccgaggagactgacaatgtggtgtacaagcttttttcgcagggagactag

SEQ ID NO: 53728 - protein, 550 aa, Arxula adeninivorans
MSNISTPRISGLTEYTSQPDKSHYDSIESHFLLPDGTPDYLKLILTSKVYDVCNETPVTPAVNLSSKLGANIFLKREDLQPVFSFKLRGAYNMMAHLPQETRWKGVIACSAGNHAQGVAYSAKHLNIPATIVMPVVTPAIKYKNVDRLGAKVVLHGNDFDAAKAECNRLSEKHGLTNIPLFDNPYVIAGQGTIGVELLRQIDVESLKAIFVCIGGGGLIAGVGAYIKRIAPQVKIIGVETYDANAMRQSLQKGERITLSEVGLFADGAAVKILGEETFRLCQQVVDEIVLVSTDEICAAIKDVFTETRSIVEPAGALSVAGLVKYVESHPEIDHSASGYTAILSGANMDFDRLRFVSERAKLGEGSEVFIVATIPEKPGSFGKLIDLVHPRAVTEFSYRYSNGELEKSDGKAHVYISFSVDNAKAEVPRILDDFKGAGFDAIDISHNEFPKSHPRYLVGANQPVTNERVFRFEFPERPGALVKFLHGVKSKWNITLFHYRNQGSDIAKVLAGISVPSHESDQFQQFLDNLEYPYAEETDNVVYKLFSQGD

SEQ ID NO: 53729 - DNA, 1731 bp, Saccharomyces cerevisiae
  CDS (1)..(1731)
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 53730 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKIIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 53731 - DNA, 1149 bp, Synechocystis sp
  CDS (1)..(1149)
atgatttcttgtcattctttcaccatgaccccatccgccccaaattcgacagtgttgcccagtgctacccccgtctgtccccagagttcggcctgtcgttggcgtggattgattgaaacctatcggccctatttaccggtatccgaccagactccagtggtcacccttttagaaggcaatactcccctgattcccgctccggcgatcgccaaacgcattggcaaggacgtaagggtttttgttaaatatgacggcctaaaccccaccggtagtttcaaggaccggggcatgaccatggccatttccaaagccaaggaagcaggggccaaagcggtaatttgtgccagcacaggtaatacttcagcggcggcggcggcctacgctcggcgggccggtttgcgggcttttgtgatcattcccgatggttatgtcgctttgggaaaattaggccaagctttaatttacggtgcggaagtgattgccattgatggtaactttgacgatgcgttgaccaccgtgcggcagttatcggaacattaccccgtaaccttggtaaattccgttaatccctaccgtttggaaggacaaaagaccgccgcgtttgaaattgttgatgtcctcggccaggcccccgattggctctgtatccccgtgggcaatgcgggcaatatcaccgcctactggatgggtttttgtcagtataaagaattgggcaaaggcgatcgcctaccgaggatgatgggtttccaagccgctggttccgctccttttatccaagggcaacccattagccatcccgaaaccctagccactgctattcgtattggcaatcctgccaactgggataaggcctgggccgcttctagggaaagtaatggggaatttcaccccgtcaccgatgccgaaattttggaagcctatcgtatcctagctgccgaagaaggggttttttgtgagcccgccagtgccgcttccgtagctggtttattgaagcaaaaagatcaagttcccgctggagccaccgtggtttgtgtgctgaccggcaacggcttgaaagatccagattgtgctgtgcaaaatagtggcaatcaagtgaaagcgggtttaaaaccagatttggaaattgttgctaaagcgatgggtttttag

SEQ ID NO: 53732 - protein, 382 aa, Synechocystis sp
MISCHSFTMTPSAPNSTVLPSATPVCPQSSACRWRGLIETYRPYLPVSDQTPVVTLLEGNTPLIPAPAIAKRIGKDVRVFVKYDGLNPTGSFKDRGMTMAISKAKEAGAKAVICASTGNTSAAAAAYARRAGLRAFVIIPDGYVALGKLGQALIYGAEVIAIDGNFDDALTTVRQLSEHYPVTLVNSVNPYRLEGQKTAAFEIVDVLGQAPDWLCIPVGNAGNITAYWMGFCQYKELGKGDRLPRMMGFQAAGSAPFIQGQPISHPETLATAIRIGNPANWDKAWAASRESNGEFHPVTDAEILEAYRILAAEEGVFCEPASAASVAGLLKQKDQVPAGATVVCVLTGNGLKDPDCAVQNSGNQVKAGLKPDLEIVAKAMGF

SEQ ID NO: 53733 - DNA, 999 bp, Rhizobium sp
  CDS (1)..(999)
gtgaatgaattgtcgaacttaagtctagaatcgatcgagcgagcgcgtgagcggatcgaagagcacgtcttccgtacccctctgacgacatcaaggtcgctaaccgaacttaccggaactcaggtcagcctcaagctcgagcactatcagcgcactggtagctttaagctgcggggtgcgacaaacgcaattcttcaactcagcccgtcggatcgggcacgtggggttattgcggcatctacgggcaatcacggacgggctctttcctacgccgcaaaagcggtcggctctcgcgccaccatctgcatgtcggatcttgttccagaaaacaaggtttccgagatccggaagcttggcgcgacagttcggatagtgggatcgtcacaagacgatgcgcaagtcgaagtcgagcggctcgtcgcggaggaaggcctcagcatgatcccgcctttcgatcacccgcatatcatcgccggccagcgaaccgtcggtcttgagatcgttgaggcgatgccggacgtcgcgatggtactgcttccactgtcgggtggcggcttggctgcaggcgttgcagcagcggtgaaggcactgcggcctcatgcgaggatcatcggtgtcactatggatcgaggcgccgcgatgaaggccagcatcgaagctgggcatccggtacaagtgaaggagtatcggagcttggctgattctttaggtggaggaatcggcatggccaacgcttggacctttcaaatgtgcagagcccttctggacgatgttgtcctcgttaatgaaggcgaaatagccgcgggaattagacatgcttatgagcatgagcgtcagatactcgagggcgccggcgctgtcggtatcgcagcgcttctctccggcaaggtggctgctcgcggaggttcagtaggagtcgttttgtcaggtcaaaacatcgacatgggcctgcatcgggaggtcattaacggagttgtcagagcgaccgaggaggattga

SEQ ID NO: 53734 - protein, 332 aa, Rhizobium sp
MNELSNLSLESIERARERIEEHVFRTPLTTSRSLTELTGTQVSLKLEHYQRTGSFKLRGATNAILQLSPSDRARGVIAASTGNHGRALSYAAKAVGSRATICMSDLVPENKVSEIRKLGATVRIVGSSQDDAQVEVERLVAEEGLSMIPPFDHPHIIAGQRTVGLEIVEAMPDVAMVLLPLSGGGLAAGVAAAVKALRPHARIIGVTMDRGAAMKASIEAGHPVQVKEYRSLADSLGGGIGMANAWTFQMCRALLDDVVLVNEGEIAAGIRHAYEHERQILEGAGAVGIAALLSGKVAARGGSVGVVLSGQNIDMGLHREVINGVVRATEED

SEQ ID NO: 53735 - DNA, 972 bp, Schizosaccharomyces pombe
  CDS (1)..(972)
atgagcgataacctggtgcttcctacctatgatgatgttgcttcagctagtgagcgaattaagaaattcgccaacaaaaccccagtactcacgtcgagcacagtaaataaagagtttgtggcagaagtgttttttaaatgtgaaaatttccaaaaaatgggtgctttcaaatttcgcggtgcccttaatgctctttctcaactcaatgaagctcaacgtaaagctggtgttttgacgttttcttctggtaatcatgctcaggccattgcactgtcggcaaagatcttgggaattccagcaaaaatcattatgccactcgatgcacccgaagccaaggtcgctgccacgaaaggctatggtggtcaagtaatcatgtatgatagatacaaagatgatagagaaaagatggccaaagaaatttctgaaagagaaggtcttaccattatccctccttacgatcacccccatgtacttgctggtcaaggaaccgcagctaaggaactgtttgaagaggttggccctcttgatgcactttttgtttgtctcggaggcggtggcttgctttctggatcagcacttgctgctcgccattttgctccaaactgcgaagtttatggagttgaacctgaagctggaaacgatgggcaacagtcctttaggaaaggatctatcgtacatattgatacaccaaaaactatagccgatggtgctcaaactcaacatttgggtaactacacgttttccattataaaagaaaaggtcgatgatatattgactgtgtccgacgaggaactaattgactgtcttaagttttatgccgcacgtatgaaaattgtagtcgaacccactggatgtcttagctttgcggcagcgcgcgctatgaaggaaaagctaaagaataaacgaattggtatcattataagtggaggaaacgtagacattgagcgttatgcccatttcttatcacagtaa

SEQ ID NO: 53736 - protein, 323 aa, Schizosaccharomyces pombe
MSDNLVLPTYDDVASASERIKKFANKTPVLTSSTVNKEFVAEVFFKCENFQKMGAFKFRGALNALSQLNEAQRKAGVLTFSSGNHAQAIALSAKILGIPAKIIMPLDAPEAKVAATKGYGGQVIMYDRYKDDREKMAKEISEREGLTIIPPYDHPHVLAGQGTAAKELFEEVGPLDALFVCLGGGGLLSGSALAARHFAPNCEVYGVEPEAGNDGQQSFRKGSIVHIDTPKTIADGAQTQHLGNYTFSIIKEKVDDILTVSDEELIDCLKFYAARMKIVVEPTGCLSFAAARAMKEKLKNKRIGIIISGGNVDIERYAHFLSQ

SEQ ID NO: 53737 - DNA, 981 bp, Saccharomyces cerevisiae
  CDS (1)..(981)
atgattgttcccacttatggagacgttttggatgccagcaacagaattaaagaatatgtaaataaaacaccggttctcacttcacgaatgcttaatgatcgacttggagcacaaatatactttaaaggtgagaatttccaacgagtgggagcgttcaagtttcgtggagcaatgaatgctgtttcaaaattaagtgatgaaaaaagaagtaagggagtaattgccttctcatcaggaaaccatgcacaggctattgctcttagtgcaaaactattaaatgtacctgcaacaattgttatgcccgaggatgcgcccgcccttaaagttgctgctacagccggttacggagcacatatcataaggtataacaggtatactgaagatcgcgagcagattgggcgtcaactagcagccgaacatggttttgcattgattccgccctacgatcatcctgatgttattgcagggcaaggtacgtcggcaaaagagctattagaagaggttggacaacttgatgcattatttgttcctttgggcggtggtgggctcctttcaggatctgcacttgccgctagaagcctttctccaggctgcaaaatttttggggttgaacctgaagctggtaacgatggacaacaatccttcagatcgggttccattgttcatatcaatacgccaaaaactatcgcagatggcgctcaaacacaacacctcggtgagtacacatttgccattattcgcgaaaatgtcgatgatattttaacggttagcgaccaagagctagtaaaatgcatgcactttcttgcggaacgcatgaaggtggttgttgagcccacagcttgtttgggatttgcaggtgcacttctaaaaaaggaagagctagttgggaagaaagtaggcataatactaagtggaggtaatgtagacatgaagagatatgctactttaatctctgggaaggaagatggcccaacgatttag

SEQ ID NO: 53738 - protein, 326 aa, Saccharomyces cerevisiae
MIVPTYGDVLDASNRIKEYVNKTPVLTSRMLNDRLGAQIYFKGENFQRVGAFKFRGAMNAVSKLSDEKRSKGVIAFSSGNHAQAIALSAKLLNVPATIVMPEDAPALKVAATAGYGAHIIRYNRYTEDREQIGRQLAAEHGFALIPPYDHPDVIAGQGTSAKELLEEVGQLDALFVPLGGGGLLSGSALAARSLSPGCKIFGVEPEAGNDGQQSFRSGSIVHINTPKTIADGAQTQHLGEYTFAIIRENVDDILTVSDQELVKCMHFLAERMKVVVEPTACLGFAGALLKKEELVGKKVGIILSGGNVDMKRYATLISGKEDGPTI

SEQ ID NO: 53739 - DNA, 24 bp, Primer
atgcatattacatacgatctgccg

SEQ ID NO: 53740 - DNA, 23 bp, Primer
ttaagcgtcaacgaaaccggtga

SEQ ID NO: 53741 - protein, 516 aa, consensus
  MISC_FEATURE (1)..(516): consensus for the disclosure of xaa see table XV
TPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXEXXQXXXXXXXXXXXXXXXXXXXFKXRGXXXXXXXXXXXXXXXXXXXXXXXXXXXXXXXXXXXXXXXXXXXXXXXXXXXXSXGNHXXXXXXAXXXXXXXXXXXXXXPXXXXXXKXXXXXXXGXXXXXXXXXXXXXXXXXXXXXXXXXXXXXXXXXXXXXXXXXXXXXXXXXXGQXTXXXEXXXXXXXXXXXXXXXXXXXXXXXXXXXXXXXXXXXXXXXXXXXXXXXXXXXXXXXXXXXXXXGGGGLXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXEXXXXXXXAXXXXXXXXXXXXXXXXXXXXXXXXXXXXXXXXXXXXXXXXXXXGXN

SEQ ID NO: 53742 - protein, 224 aa, consensus
  MISC_FEATURE (1)..(224): consensus for the disclosure of xaa see table XV
XXXKXXXXXXXXXXXXRXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXX

SEQ ID NO: 53743 - DNA, 1350 bp, Escherichia coli K12; identical to SEQ ID NO: 4558
  CDS (1)..(1350)

SEQ ID NO: 53744 - protein, 449 aa, Escherichia coli K12; identical to SEQ ID NO: 4559

SEQ ID NO: 53745 - DNA, 7367 bp, Gallus gallus (chicken); identical to SEQ ID NO: 4560
  CDS (154)..(7128)

SEQ ID NO: 53746 - protein, 2324 aa, Gallus gallus (chicken); identical to SEQ ID NO: 4561

SEQ ID NO: 53747 - DNA, 7038 bp, Rattus norvegicus (Norway rat); identical to SEQ ID NO: 4562
  CDS (1)..(7038)

SEQ ID NO: 53748 - protein, 2345 aa, Rattus norvegicus (Norway rat); identical to SEQ ID NO: 4563

SEQ ID NO: 53749 - DNA, 6270 bp, Cyclotella cryptica; identical to SEQ ID NO: 4564
  CDS (1)..(6270)

SEQ ID NO: 53750 - protein, 2089 aa, Cyclotella cryptica; identical to SEQ ID NO: 4565

SEQ ID NO: 53751 - DNA, 7360 bp, Triticum aestivum (common wheat); identical to SEQ ID NO: 4566
  CDS (159)..(6932)

SEQ ID NO: 53752 - protein, 2257 aa, Triticum aestivum (common wheat); identical to SEQ ID NO: 4567

SEQ ID NO: 53753 - DNA, 1476 bp, Methanobacterium thermoautotrophicum; identical to SEQ ID NO: 4568
  CDS (1)..(1476)

SEQ ID NO: 53754 - protein, 491 aa, Methanobacterium thermoautotrophicum; identical to SEQ ID NO: 4569

SEQ ID NO: 53755 - DNA, 1353 bp, Bacillus subtilis; identical to SEQ ID NO: 4570
  CDS (1)..(1353)

SEQ ID NO: 53756 - protein, 450 aa, Bacillus subtilis; identical to SEQ ID NO: 4571

SEQ ID NO: 53757 - DNA, 1419 bp, Aquifex aeolicus; identical to SEQ ID NO: 4572
  CDS (1)..(1419)

SEQ ID NO: 53758 - protein, 472 aa, Aquifex aeolicus; identical to SEQ ID NO: 4573

SEQ ID NO: 53759 - DNA, 1377 bp, Pseudomonas aeruginosa; identical to SEQ ID NO: 4574
  CDS (1)..(1377)

SEQ ID NO: 53760 - protein, 458 aa, Pseudomonas aeruginosa; identical to SEQ ID NO: 4575

SEQ ID NO: 53761 - DNA, 3453 bp, Bacillus halodurans; identical to SEQ ID NO: 4576
  CDS (1)..(3453)

SEQ ID NO: 53762 - protein, 1150 aa, Bacillus halodurans; identical to SEQ ID NO: 4577

SEQ ID NO: 53763 - DNA, 1347 bp, Agrobacterium tumefaciens; identical to SEQ ID NO: 4578
  CDS (1)..(1347)

SEQ ID NO: 53764 - protein, 448 aa, Agrobacterium tumefaciens; identical to SEQ ID NO: 4579

SEQ ID NO: 53765 - DNA, 1731 bp, Agrobacterium tumefaciens; identical to SEQ ID NO: 4580
  CDS (1)..(1731)

SEQ ID NO: 53766 - protein, 576 aa, Agrobacterium tumefaciens; identical to SEQ ID NO: 4581

SEQ ID NO: 53767 - DNA, 1350 bp, Yersinia pestis; identical to SEQ ID NO: 4582
  CDS (1)..(1350)

SEQ ID NO: 53768 - protein, 449 aa, Yersinia pestis; identical to SEQ ID NO: 4583

SEQ ID NO: 53769 - DNA, 1365 bp, Listeria monocytogenes; identical to SEQ ID NO: 4584
  CDS (1)..(1365)

SEQ ID NO: 53770 - protein, 454 aa, Listeria monocytogenes; identical to SEQ ID NO: 4585

SEQ ID NO: 53771 - DNA, 3525 bp, Agrobacterium tumefaciens; identical to SEQ ID NO: 4586
  CDS (1)..(3525)

SEQ ID NO: 53772 - protein, 1174 aa, Agrobacterium tumefaciens; identical to SEQ ID NO: 4587

SEQ ID NO: 53773 - DNA, 1992 bp, Agrobacterium tumefaciens; identical to SEQ ID NO: 4588
  CDS (1)..(1992)

SEQ ID NO: 53774 - protein, 663 aa, Agrobacterium tumefaciens; identical to SEQ ID NO: 4589

SEQ ID NO: 53775 - DNA, 2037 bp, Brucella melitensis; identical to SEQ ID NO: 4590
  CDS (1)..(2037)

SEQ ID NO: 53776 - protein, 678 aa, Brucella melitensis; identical to SEQ ID NO: 4591

SEQ ID NO: 53777 - DNA, 1344 bp, Nostoc sp. PCC 7120; identical to SEQ ID NO: 4592
  CDS (1)..(1344)

SEQ ID NO: 53778 - protein, 447 aa, Nostoc sp. PCC 7120; identical to SEQ ID NO: 4593

SEQ ID NO: 53779 - DNA, 1350 bp, Salmonella enterica subsp. enterica serovar Typhi; identical to SEQ ID NO: 4594
  CDS (1)..(1350)

SEQ ID NO: 53780 - protein, 449 aa, Salmonella enterica subsp. enterica serovar Typhi; identical to SEQ ID NO: 4595

SEQ ID NO: 53781 - DNA, 1350 bp, Pseudomonas aeruginosa; identical to SEQ ID NO: 4596
  CDS (1)..(1350)

SEQ ID NO: 53782 - protein, 449 aa, Pseudomonas aeruginosa; identical to SEQ ID NO: 4597

SEQ ID NO: 53783 - DNA, 1965 bp, Mycobacterium tuberculosis; identical to SEQ ID NO: 4598
  CDS (1)..(1965)

SEQ ID NO: 53784 - protein, 654 aa, Mycobacterium tuberculosis; identical to SEQ ID NO: 4599

SEQ ID NO: 53785 - DNA, 1338 bp, Deinococcus radiodurans; identical to SEQ ID NO: 4600
  CDS (1)..(1338)

SEQ ID NO: 53786 - protein, 445 aa, Deinococcus radiodurans; identical to SEQ ID NO: 4601

SEQ ID NO: 53787 - DNA, 1446 bp, Campylobacter jejuni; identical to SEQ ID NO: 4602
  CDS (1)..(1446)

SEQ ID NO: 53788 - protein, 481 aa, Campylobacter jejuni; identical to SEQ ID NO: 4603

SEQ ID NO: 53789 - DNA, 3288 bp, Pseudomonas aeruginosa; identical to SEQ ID NO: 4604
  CDS (1)..(3288)

SEQ ID NO: 53790 - protein, 1095 aa, Pseudomonas aeruginosa; identical to SEQ ID NO: 4605

SEQ ID NO: 53791 - DNA, 1368 bp, Lactococcus lactis subsp. lactis; identical to SEQ ID NO: 4606
  CDS (1)..(1368)

SEQ ID NO: 53792 - protein, 455 aa, Lactococcus lactis subsp. lactis; identical to SEQ ID NO: 4607

SEQ ID NO: 53793 - DNA, 2010 bp, Caulobacter crescentus; identical to SEQ ID NO: 4608
  CDS (1)..(2010)

SEQ ID NO: 53794 - protein, 669 aa, Caulobacter crescentus; identical to SEQ ID NO: 4609

SEQ ID NO: 53795 - DNA, 1344 bp, Clostridium acetobutylicum; identical to SEQ ID NO: 4610
  CDS (1)..(1344)

SEQ ID NO: 53796 - protein, 447 aa, Clostridium acetobutylicum; identical to SEQ ID NO: 4611

SEQ ID NO: 53797 - DNA, 1335 bp, Aquifex aeolicus; identical to SEQ ID NO: 4612
  CDS (1)..(1335)

SEQ ID NO: 53798 - protein, 444 aa, Aquifex aeolicus; identical to SEQ ID NO: 4613

SEQ ID NO: 53799 - DNA, 2004 bp, Mycobacterium tuberculosis; identical to SEQ ID NO: 4614
  CDS (1)..(2004)

SEQ ID NO: 53800 - protein, 667 aa, Mycobacterium tuberculosis; identical to SEQ ID NO: 4615

SEQ ID NO: 53801 - DNA, 1998 bp, Rickettsia prowazekii; identical to SEQ ID NO: 4616
  CDS (1)..(1998)

SEQ ID NO: 53802 - protein, 665 aa, Rickettsia prowazekii; identical to SEQ ID NO: 4617

SEQ ID NO: 53803 - DNA, 3276 bp, Deinococcus radiodurans; identical to SEQ ID NO: 4618
  CDS (1)..(3276)

SEQ ID NO: 53804 - protein, 1091 aa, Deinococcus radiodurans; identical to SEQ ID NO: 4619

SEQ ID NO: 53805 - DNA, 1368 bp, Streptococcus pneumoniae; identical to SEQ ID NO: 4620
  CDS (1)..(1368)

SEQ ID NO: 53806 - protein, 455 aa, Streptococcus pneumoniae; identical to SEQ ID NO: 4621

SEQ ID NO: 53807 - DNA, 1506 bp, Methanococcus jannaschii; identical to SEQ ID NO: 4622
  CDS (1)..(1506)

SEQ ID NO: 53808 - protein, 501 aa, Methanococcus jannaschii; identical to SEQ ID NO: 4623

SEQ ID NO: 53809 - DNA, 1521 bp, Archaeoglobus fulgidus; identical to SEQ ID NO: 4624
  CDS (1)..(1521)

SEQ ID NO: 53810 - protein, 506 aa, Archaeoglobus fulgidus; identical to SEQ ID NO: 4625

SEQ ID NO: 53811 - DNA, 3384 bp, Mycobacterium tuberculosis; identical to SEQ ID NO: 4626
  CDS (1)..(3384)

SEQ ID NO: 53812 - protein, 1127 aa, Mycobacterium tuberculosis; identical to SEQ ID NO: 4627

SEQ ID NO: 53813 - DNA, 1374 bp, Chlamydia muridarum, Chlamydia trachomatis MoPn; identical to SEQ ID NO: 4628
  CDS (1)..(1374)

SEQ ID NO: 53814 - protein, 457 aa, Chlamydia muridarum, Chlamydia trachomatis MoPn; identical to SEQ ID NO: 4629

SEQ ID NO: 53815 - DNA, 1359 bp, Bacillus halodurans; identical to SEQ ID NO: 4630
  CDS (1)..(1359)

SEQ ID NO: 53816 - protein, 452 aa, Bacillus halodurans; identical to SEQ ID NO: 4631

SEQ ID NO: 53817 - DNA, 6774 bp, Arabidopsis thaliana (mouse-ear cress); identical to SEQ ID NO: 4632
  CDS (1)..(6774)

SEQ ID NO: 53818 - protein, 2257 aa, Arabidopsis thaliana (mouse-ear cress); identical to SEQ ID NO: 4633

SEQ ID NO: 53819 - DNA, 3237 bp, Caulobacter crescentus; identical to SEQ ID NO: 4634
  CDS (1)..(3237)

SEQ ID NO: 53820 - protein, 1078 aa, Caulobacter crescentus; identical to SEQ ID NO: 4635

SEQ ID NO: 53821 - DNA, 3435 bp, Clostridium acetobutylicum; identical to SEQ ID NO: 4636
  CDS (1)..(3435)

SEQ ID NO: 53822 - protein, 1144 aa, Clostridium acetobutylicum; identical to SEQ ID NO: 4637

SEQ ID NO: 53823 - DNA, 1335 bp, Bacillus subtilis; identical to SEQ ID NO: 4638
  CDS (1)..(1335)

SEQ ID NO: 53824 - protein, 444 aa, Bacillus subtilis; identical to SEQ ID NO: 4639

SEQ ID NO: 53825 - DNA, 1365 bp, Chlamydophila pneumoniae, Chlamydia pneumoniae; identical to SEQ ID NO: 4640
  CDS (1)..(1365)

SEQ ID NO: 53826 - protein, 454 aa, Chlamydophila pneumoniae, Chlamydia pneumoniae; identical to SEQ ID NO: 4641

SEQ ID NO: 53827 - DNA, 1410 bp, Xylella fastidiosa; identical to SEQ ID NO: 4642
  CDS (1)..(1410)

SEQ ID NO: 53828 - protein, 469 aa, Xylella fastidiosa; identical to SEQ ID NO: 4643

SEQ ID NO: 53829 - DNA, 7080 bp, Arabidopsis thaliana (mouse-ear cress); identical to SEQ ID NO: 4644
  CDS (1)..(7080)

SEQ ID NO: 53830 - protein, 2359 aa, Arabidopsis thaliana (mouse-ear cress); identical to SEQ ID NO: 4645

SEQ ID NO: 53831 - DNA, 3414 bp, Lactococcus lactis subsp. lactis; identical to SEQ ID NO: 4646
  CDS (1)..(3414)

SEQ ID NO: 53832 - protein, 1137 aa, Lactococcus lactis subsp. lactis; identical to SEQ ID NO: 4647

SEQ ID NO: 53833 - DNA, 1533 bp, Sulfolobus solfataricus; identical to SEQ ID NO: 4648
  CDS (1)..(1533)

SEQ ID NO: 53834 - protein, 510 aa, Sulfolobus solfataricus; identical to SEQ ID NO: 4649

SEQ ID NO: 53835 - DNA, 1347 bp, Haemophilus influenzae; identical to SEQ ID NO: 4650
  CDS (1)..(1347)

SEQ ID NO: 53836 - protein, 448 aa, Haemophilus influenzae; identical to SEQ ID NO: 4651

SEQ ID NO: 53837 - DNA, 3462 bp, Bacillus subtilis; identical to SEQ ID NO: 4652
  CDS (16)..(3462)

SEQ ID NO: 53838 - protein, 1148 aa, Bacillus subtilis; identical to SEQ ID NO: 4653

SEQ ID NO: 53839 - DNA, 1803 bp, Mycobacterium tuberculosis; identical to SEQ ID NO: 4654
  CDS (1)..(1803)

SEQ ID NO: 53840 - protein, 600 aa, Mycobacterium tuberculosis; identical to SEQ ID NO: 4655

SEQ ID NO: 53841 - DNA, 1344 bp, Vibrio cholerae; identical to SEQ ID NO: 4656
  CDS (1)..(1344)

SEQ ID NO: 53842 - protein, 447 aa, Vibrio cholerae; identical to SEQ ID NO: 4657

SEQ ID NO: 53843 - DNA, 1356 bp, Staphylococcus aureus; identical to SEQ ID NO: 4658
  CDS (1)..(1356)

SEQ ID NO: 53844 - protein, 451 aa, Staphylococcus aureus; identical to SEQ ID NO: 4659

SEQ ID NO: 53845 - DNA, 2004 bp, Agrobacterium tumefaciens; identical to SEQ ID NO: 4660
  CDS (1)..(2004)

SEQ ID NO: 53846 - protein, 667 aa, Agrobacterium tumefaciens; identical to SEQ ID NO: 4661

SEQ ID NO: 53847 - DNA, 1434 bp, Aquifex aeolicus; identical to SEQ ID NO: 4662
  CDS (1)..(1434)

SEQ ID NO: 53848 - protein, 477 aa, Aquifex aeolicus; identical to SEQ ID NO: 4663

SEQ ID NO: 53849 - DNA, 1368 bp, Helicobacter pylori; identical to SEQ ID NO: 4664
  CDS (1)..(1368)

SEQ ID NO: 53850 - protein, 455 aa, Helicobacter pylori; identical to SEQ ID NO: 4665

SEQ ID NO: 53851 - DNA, 1332 bp, Campylobacter jejuni; identical to SEQ ID NO: 4666
  CDS (1)..(1332)

SEQ ID NO: 53852 - protein, 443 aa, Campylobacter jejuni; identical to SEQ ID NO: 4667

SEQ ID NO: 53853 - DNA, 1833 bp, Halobacterium sp. NRC-1; identical to SEQ ID NO: 4668
  CDS (1)..(1833)

SEQ ID NO: 53854 - protein, 610 aa, Halobacterium sp. NRC-1; identical to SEQ ID NO: 4669

SEQ ID NO: 53855 - DNA, 1797 bp, Mycobacterium leprae; identical to SEQ ID NO: 4670
  CDS (1)..(1797)

SEQ ID NO: 53856 - protein, 598 aa, Mycobacterium leprae; identical to SEQ ID NO: 4671

SEQ ID NO: 53857 - DNA, 1347 bp, Caulobacter crescentus; identical to SEQ ID NO: 4672
  CDS (1)..(1347)

SEQ ID NO: 53858 - protein, 448 aa, Caulobacter crescentus; identical to SEQ ID NO: 4673

SEQ ID NO: 53859 - DNA, 1965 bp, Caulobacter crescentus; identical to SEQ ID NO: 4674
  CDS (1)..(1965)

SEQ ID NO: 53860 - protein, 654 aa, Caulobacter crescentus; identical to SEQ ID NO: 4675

SEQ ID NO: 53861 - DNA, 1989 bp, Sinorhizobium meliloti; identical to SEQ ID NO: 4676
  CDS (1)..(1989)

SEQ ID NO: 53862 - protein, 662 aa, Sinorhizobium meliloti; identical to SEQ ID NO: 4677

SEQ ID NO: 53863 - DNA, 1374 bp, Chlamydia trachomatis; identical to SEQ ID NO: 4678
  CDS (1)..(1374)

SEQ ID NO: 53864 - protein, 457 aa, Chlamydia trachomatis; identical to SEQ ID NO: 4679

SEQ ID NO: 53865 - DNA, 1362 bp, Neisseria meningitidis; identical to SEQ ID NO: 4680
  CDS (1)..(1362)

SEQ ID NO: 53866 - protein, 453 aa, Neisseria meningitidis; identical to SEQ ID NO: 4681

SEQ ID NO: 53867 - DNA, 3624 bp, Caulobacter crescentus; identical to SEQ ID NO: 4682
  CDS (1)..(3624)

SEQ ID NO: 53868 - protein, 1207 aa, Caulobacter crescentus; identical to SEQ ID NO: 4683

SEQ ID NO: 53869 - DNA, 2013 bp, Sinorhizobium meliloti; identical to SEQ ID NO: 4684
  CDS (1)..(2013)

SEQ ID NO: 53870 - protein, 670 aa, Sinorhizobium meliloti; identical to SEQ ID NO: 4685

SEQ ID NO: 53871 - DNA, 7041 bp, Homo sapiens (man); identical to SEQ ID NO: 4686
  CDS (1)..(7041)

SEQ ID NO: 53872 - protein, 2346 aa, Homo sapiens (man); identical to SEQ ID NO: 4687

SEQ ID NO: 53873 - DNA, 4201 bp, Saccharomyces cerevisiae; identical to SEQ ID NO: 4688
  CDS (430)..(3966)

SEQ ID NO: 53874 - protein, 1178 aa, Saccharomyces cerevisiae; identical to SEQ ID NO: 4689

SEQ ID NO: 53875 - DNA, 7020 bp, Homo sapiens (man); identical to SEQ ID NO: 4690
  CDS (1)..(7020)

SEQ ID NO: 53876 - protein, 2339 aa, Homo sapiens (man) [sequence omitted]

SEQ ID NO: 53877 - DNA, 6042 bp, Saccharomyces cerevisiae; identical to SEQ ID NO: 4692
  CDS (373)..(5880)

SEQ ID NO: 53878 - protein, 1835 aa, Saccharomyces cerevisiae; identical to SEQ ID NO: 4693

SEQ ID NO: 53879 - DNA, 4315 bp, Saccharomyces cerevisiae; identical to SEQ ID NO: 4694
  CDS (676)..(4218)

SEQ ID NO: 53880 - protein, 1180 aa, Saccharomyces cerevisiae; identical to SEQ ID NO: 4695

SEQ ID NO: 53881 - DNA, 6558 bp, Ustilago maydis (corn smut); identical to SEQ ID NO: 4696
  CDS (1)..(6558)

SEQ ID NO: 53882 - protein, 2185 aa, Ustilago maydis (corn smut); identical to SEQ ID NO: 4697

SEQ ID NO: 53883 - DNA, 8521 bp, Saccharomyces cerevisiae; identical to SEQ ID NO: 4698
  CDS (1539)..(8240)

SEQ ID NO: 53884 - protein, 2233 aa, Saccharomyces cerevisiae; identical to SEQ ID NO: 4699

SEQ ID NO: 53885 - DNA, 1794 bp, Saccharopolyspora erythraea; identical to SEQ ID NO: 4700
  CDS (1)..(1794)

SEQ ID NO: 53886 - protein, 597 aa, Saccharopolyspora erythraea; identical to SEQ ID NO: 4701

SEQ ID NO: 53887 - DNA, 1347 bp, Synechocystis sp; identical to SEQ ID NO: 4702
  CDS (1)..(1347)

SEQ ID NO: 53888 - protein, 448 aa, Synechocystis sp; identical to SEQ ID NO: 4703

SEQ ID NO: 53889 - DNA, 1970 bp, Arabidopsis thaliana (mouse-ear cress); identical to SEQ ID NO: 4704
  CDS (140)..(1753)

SEQ ID NO: 53890 - protein, 537 aa, Arabidopsis thaliana (mouse-ear cress); identical to SEQ ID NO: 4705

SEQ ID NO: 53891 - DNA, 1921 bp, Nicotiana tabacum (common tobacco); identical to SEQ ID NO: 4706
  CDS (85)..(1695)

SEQ ID NO: 53892 - protein, 536 aa, Nicotiana tabacum (common tobacco); identical to SEQ ID NO: 4707

SEQ ID NO: 53893 - DNA, 1998 bp, Leishmania major; identical to SEQ ID NO: 4708
  CDS (1)..(1998)

SEQ ID NO: 53894 - protein, 665 aa, Leishmania major; identical to SEQ ID NO: 4709

SEQ ID NO: 53895 - DNA, 6993 bp, Triticum aestivum (common wheat); identical to SEQ ID NO: 4710
  CDS (39)..(6974)

SEQ ID NO: 53896 - protein, 2311 aa, Triticum aestivum (common wheat); identical to SEQ ID NO: 4711

SEQ ID NO: 53897 - DNA, 6786 bp, Glycine max (soybean); identical to SEQ ID NO: 4712
  CDS (1)..(6786)

SEQ ID NO: 53898 - protein, 2261 aa, Glycine max (soybean); identical to SEQ ID NO: 4713

SEQ ID NO: 53899 - DNA, 2030 bp, Glycine max (soybean); identical to SEQ ID NO: 4714
  CDS (90)..(1709)

SEQ ID NO: 53900 - protein, 539 aa, Glycine max (soybean); identical to SEQ ID NO: 4715

SEQ ID NO: 53901 - DNA, 6915 bp, Brassica napus (rape); identical to SEQ ID NO: 4716
  CDS (1)..(6915)

SEQ ID NO: 53902 - protein, 2304 aa, Brassica napus (rape); identical to SEQ ID NO: 4717

SEQ ID NO: 53903 - DNA, 7175 bp, Medicago sativa (alfalfa); identical to SEQ ID NO: 4718
  CDS (70)..(6843)

SEQ ID NO: 53904 - protein, 2257 aa, Medicago sativa (alfalfa); identical to SEQ ID NO: 4719

SEQ ID NO: 53905 - DNA, 2175 bp, Caenorhabditis elegans; identical to SEQ ID NO: 4720
  CDS (1)..(2175)

SEQ ID NO: 53906 - protein, 724 aa, Caenorhabditis elegans; identical to SEQ ID NO: 4721

SEQ ID NO: 53907 - DNA, 3864 bp, Caenorhabditis elegans; identical to SEQ ID NO: 4722
  CDS (36)..(3563)

SEQ ID NO: 53908 - protein, 1175 aa, Caenorhabditis elegans; identical to SEQ ID NO: 4723

SEQ ID NO: 53909 - DNA, 4974 bp, Caenorhabditis elegans; identical to SEQ ID NO: 4724
  CDS (1)..(4974)

SEQ ID NO: 53910 - protein, 1657 aa, Caenorhabditis elegans; identical to SEQ ID NO: 4725

SEQ ID NO: 53911 - DNA, 6867 bp, Emericella nidulans, Aspergillus nidulans; identical to SEQ ID NO: 4726
  CDS (1)..(6867)

SEQ ID NO: 53912 - protein, 2288 aa, Emericella nidulans, Aspergillus nidulans; identical to SEQ ID NO: 4727

SEQ ID NO: 53913 - DNA, 6165 bp, Caenorhabditis elegans; identical to SEQ ID NO: 4728
  CDS (1)..(6165)

SEQ ID NO: 53914 - protein, 2054 aa, Caenorhabditis elegans; identical to SEQ ID NO: 4729

SEQ ID NO: 53915 - DNA, 6843 bp, Schizosaccharomyces pombe; identical to SEQ ID NO: 4730
  CDS (1)..(6843)

SEQ ID NO: 53916 - protein, 2280 aa, Schizosaccharomyces pombe; identical to SEQ ID NO: 4731

SEQ ID NO: 53917 - DNA, 1773 bp, Streptomyces coelicolor; identical to SEQ ID NO: 4732
  CDS (1)..(1773)

SEQ ID NO: 53918 - protein, 590 aa, Streptomyces coelicolor; identical to SEQ ID NO: 4733

SEQ ID NO: 53919 - DNA, 1773 bp, Streptomyces coelicolor; identical to SEQ ID NO: 4734
  CDS (1)..(1773)

SEQ ID NO: 53920 - protein, 590 aa, Streptomyces coelicolor; identical to SEQ ID NO: 4735

SEQ ID NO: 53921 - DNA, 3933 bp, Aedes aegypti (yellow fever mosquito); identical to SEQ ID NO: 4736
  CDS (69)..(3656)

SEQ ID NO: 53922 - protein, 1195 aa, Aedes aegypti (yellow fever mosquito); identical to SEQ ID NO: 4737

SEQ ID NO: 53923 - DNA, 1542 bp, Sulfolobus metallicus; identical to SEQ ID NO: 4738
  CDS (1)..(1542)

SEQ ID NO: 53924 - protein, 513 aa, Sulfolobus metallicus; identical to SEQ ID NO: 4739

SEQ ID NO: 53925 - DNA, 1335 bp, Bacillus subtilis; identical to SEQ ID NO: 4740
  CDS (1)..(1335)

SEQ ID NO: 53926 - protein, 444 aa, Bacillus subtilis; identical to SEQ ID NO: 4741

SEQ ID NO: 53927 - DNA, 6822 bp, Brassica napus; identical to SEQ ID NO: 4742
  CDS (1)..(6822)

SEQ ID NO: 53928 - protein, 2273 aa, Brassica napus; identical to SEQ ID NO: 4743

SEQ ID NO: 53929 - DNA, 1599 bp, Corynebacterium glutamicum; identical to SEQ ID NO: 4744
  CDS (1)..(1599)

SEQ ID NO: 53930 - protein, 532 aa, Corynebacterium glutamicum; identical to SEQ ID NO: 4745

SEQ ID NO: 53931 - DNA, 3728 bp, Corynebacterium glutamicum; identical to SEQ ID NO: 4746
  CDS (165)..(3587)

SEQ ID NO: 53932 - protein, 1140 aa, Corynebacterium glutamicum; identical to SEQ ID NO: 4747

SEQ ID NO: 53933 - DNA, 7371 bp, Rattus norvegicus; identical to SEQ ID NO: 4748
  CDS (1)..(7371)

SEQ ID NO: 53934 - protein, 2456 aa, Rattus norvegicus; identical to SEQ ID NO: 4749

SEQ ID NO: 53935 - DNA, 3916 bp, Aspergillus terreus; identical to SEQ ID NO: 4750
  CDS (139)..(3720)

SEQ ID NO: 53936 - protein, 1193 aa, Aspergillus terreus; identical to SEQ ID NO: 4751

SEQ ID NO: 53937 - DNA, 3195 bp, Corynebacterium glutamicum; identical to SEQ ID NO: 4752
  CDS (872)..(2647)

SEQ ID NO: 53938 - protein, 591 aa, Corynebacterium glutamicum; identical to SEQ ID NO: 4753

SEQ ID NO: 53939 - DNA, 3558 bp, Schizosaccharomyces pombe; identical to SEQ ID NO: 4754
  CDS (1)..(3558)

SEQ ID NO: 53940 - protein, 1185 aa, Schizosaccharomyces pombe; identical to SEQ ID NO: 4755

SEQ ID NO: 53941 - DNA, 1620 bp, Arabidopsis thaliana; identical to SEQ ID NO: 4756
  CDS (1)..(1620): n means a or g or c or t/u

SEQ ID NO: 53942 - protein, 539 aa, Arabidopsis thaliana; identical to SEQ ID NO: 4757
  misc_feature (351)..(351): Xaa can be Asp or Glu

SEQ ID NO: 53943 - DNA, 3727 bp, Bacillus stearothermophilus; identical to SEQ ID NO: 4758
  CDS (92)..(3535)

SEQ ID NO: 53944 - protein, 1147 aa, Bacillus stearothermophilus; identical to SEQ ID NO: 4759

SEQ ID NO: 53945 - DNA, 6765 bp, Arabidopsis thaliana; identical to SEQ ID NO: 4760
  CDS (1)..(6765)

SEQ ID NO: 53946 - protein, 2254 aa, Arabidopsis thaliana; identical to SEQ ID NO: 4761

SEQ ID NO: 53947 - DNA, 6783 bp, Triticum aestivum; identical to SEQ ID NO: 4762
  CDS (1)..(6783): y means t/u or c

SEQ ID NO: 53948 - protein, 2260 aa, Triticum aestivum; identical to SEQ ID NO: 4763
  misc_feature (1980)..(1980): Xaa can be Pro or Ser

SEQ ID NO: 53949 - DNA, 3375 bp, Mycobacterium tuberculosis; identical to SEQ ID NO: 4764
  CDS (1)..(3375)

SEQ ID NO: 53950 - protein, 1124 aa, Mycobacterium tuberculosis; identical to SEQ ID NO: 4765

SEQ ID NO: 53951 - DNA, 1362 bp, Synechococcus sp; identical to SEQ ID NO: 4766
  CDS (1)..(1362)

SEQ ID NO: 53952 - protein, 453 aa, Synechococcus sp; identical to SEQ ID NO: 4767

SEQ ID NO: 53953 - DNA, 3800 bp, Rhizobium etli; identical to SEQ ID NO: 4768
  CDS (150)..(3614)

SEQ ID NO: 53954 - protein, 1154 aa, Rhizobium etli; identical to SEQ ID NO: 4769

SEQ ID NO: 53955 - DNA, 1422 bp, Wolinella succinogenes; identical to SEQ ID NO: 4770
  CDS (1)..(1422)

SEQ ID NO: 53956 - protein, 473 aa, Wolinella succinogenes; identical to SEQ ID NO: 4771

SEQ ID NO: 53957 - DNA, 3603 bp, Wolinella succinogenes; identical to SEQ ID NO: 4772
  CDS (1)..(3603)

SEQ ID NO: 53958 - protein, 1200 aa, Wolinella succinogenes; identical to SEQ ID NO: 4773

SEQ ID NO: 53959 - DNA, 1347 bp, Wolinella succinogenes; identical to SEQ ID NO: 4774
  CDS (1)..(1347)

SEQ ID NO: 53960 - protein, 448 aa, Wolinella succinogenes; identical to SEQ ID NO: 4775

SEQ ID NO: 53961 - DNA, 1956 bp, Chromobacterium violaceum; identical to SEQ ID NO: 4776
  CDS (1)..(1956)

SEQ ID NO: 53962 - protein, 651 aa, Chromobacterium violaceum; identical to SEQ ID NO: 4777

SEQ ID NO: 53963 - DNA, 1779 bp, Photorhabdus luminescens; identical to SEQ ID NO: 4778
  CDS (1)..(1779)

SEQ ID NO: 53964 - protein, 592 aa, Photorhabdus luminescens; identical to SEQ ID NO: 4779

SEQ ID NO: 53965 - DNA, 1350 bp, Photorhabdus luminescens; identical to SEQ ID NO: 4780
  CDS (1)..(1350)

SEQ ID NO: 53966 - protein, 449 aa, Photorhabdus luminescens; identical to SEQ ID NO: 4781

SEQ ID NO: 53967 - DNA, 1350 bp, Gloeobacter violaceus; identical to SEQ ID NO: 4782
  CDS (1)..(1350)

SEQ ID NO: 53968 - protein, 449 aa, Gloeobacter violaceus; identical to SEQ ID NO: 4783

SEQ ID NO: 53969 - DNA, 3609 bp, Gloeobacter violaceus; identical to SEQ ID NO: 4784
  CDS (1)..(3609)

SEQ ID NO: 53970 - protein, 1202 aa, Gloeobacter violaceus; identical to SEQ ID NO: 4785

SEQ ID NO: 53971 - DNA, 1491 bp, Chromobacterium violaceum; identical to SEQ ID NO: 4786
  CDS (1)..(1491)

SEQ ID NO: 53972 - protein, 496 aa, Chromobacterium violaceum; identical to SEQ ID NO: 4787

SEQ ID NO: 53973 - DNA, 1965 bp, Chromobacterium violaceum; identical to SEQ ID NO: 4788
  CDS (1)..(1965)

SEQ ID NO: 53974 - protein, 654 aa, Chromobacterium violaceum; identical to SEQ ID NO: 4789

SEQ ID NO: 53975 - DNA, 1998 bp, Rickettsia sibirica; identical to SEQ ID NO: 4790
  CDS (1)..(1998)

SEQ ID NO: 53976 - protein, 665 aa, Rickettsia sibirica; identical to SEQ ID NO: 4791

SEQ ID NO: 53977 - DNA, 1164 bp, Anopheles gambiae str; identical to SEQ ID NO: 4792
  CDS (1)..(1164)

SEQ ID NO: 53978 - protein, 387 aa, Anopheles gambiae str; identical to SEQ ID NO: 4793

SEQ ID NO: 53979 - DNA, 8736 bp, Plasmodium yoelii yoelii; identical to SEQ ID NO: 4794
  CDS (1)..(8736): m means a or c

SEQ ID NO: 53980 - protein, 2911 aa, Plasmodium yoelii yoelii; identical to SEQ ID NO: 4795
  misc_feature (1554)..(1554): Xaa can be Asp or Glu

SEQ ID NO: 53981 - DNA, 6828 bp, Neurospora crassa; identical to SEQ ID NO: 4796
  CDS (1)..(6828)

SEQ ID NO: 53982 - protein, 2275 aa, Neurospora crassa; identical to SEQ ID NO: 4797

SEQ ID NO: 53983 - DNA, 2232 bp, Neurospora crassa; identical to SEQ ID NO: 4798
  CDS (1)..(2232)

SEQ ID NO: 53984 - protein, 743 aa, Neurospora crassa; identical to SEQ ID NO: 4799

SEQ ID NO: 53985 - DNA, 1347 bp, Synechococcus sp; identical to SEQ ID NO: 4800
  CDS (1)..(1347)

SEQ ID NO: 53986 - protein, 448 aa, Synechococcus sp; identical to SEQ ID NO: 4801

SEQ ID NO: 53987 - DNA, 3501 bp, Rhodopirellula baltica; identical to SEQ ID NO: 4802
  CDS (1)..(3501)

SEQ ID NO: 53988 - protein, 1166 aa, Rhodopirellula baltica; identical to SEQ ID NO: 4803

SEQ ID NO: 53989 - DNA, 1353 bp, Rhodopirellula baltica; identical to SEQ ID NO: 4804
  CDS (1)..(1353)

SEQ ID NO: 53990 - protein, 450 aa, Rhodopirellula baltica; identical to SEQ ID NO: 4805

SEQ ID NO: 53991 - DNA, 1350 bp, Prochlorococcus marinus subsp; identical to SEQ ID NO: 4806
  CDS (1)..(1350)

SEQ ID NO: 53992 - protein, 449 aa, Prochlorococcus marinus subsp; identical to SEQ ID NO: 4807

SEQ ID NO: 53993 - DNA, 1347 bp, Prochlorococcus marinus; identical to SEQ ID NO: 4808
  CDS (1)..(1347)

SEQ ID NO: 53994 - protein, 448 aa, Prochlorococcus marinus; identical to SEQ ID NO: 4809

SEQ ID NO: 53995 - DNA, 1350 bp, Prochlorococcus marinus; identical to SEQ ID NO: 4810
  CDS (1)..(1350)

SEQ ID NO: 53996 - protein, 449 aa, Prochlorococcus marinus; identical to SEQ ID NO: 4811

SEQ ID NO: 53997 - DNA, 1425 bp, Helicobacter hepaticus; identical to SEQ ID NO: 4812
  CDS (1)..(1425)

SEQ ID NO: 53998 - protein, 474 aa, Helicobacter hepaticus; identical to SEQ ID NO: 4813

SEQ ID NO: 53999 - DNA, 1353 bp, Candidatus Blochmannia floridanus; identical to SEQ ID NO: 4814
  CDS (1)..(1353)

SEQ ID NO: 54000 - protein, 450 aa, Candidatus Blochmannia floridanus; identical to SEQ ID NO: 4815

SEQ ID NO: 54001 - DNA, 2022 bp, Bordetella parapertussis; identical to SEQ ID NO: 4816
  CDS (1)..(2022)

SEQ ID NO: 54002 - protein, 673 aa, Bordetella parapertussis; identical to SEQ ID NO: 4817

SEQ ID NO: 54003 - DNA, 1371 bp, Bordetella parapertussis; identical to SEQ ID NO: 4818
  CDS (1)..(1371)

SEQ ID NO: 54004 - protein, 456 aa, Bordetella parapertussis; identical to SEQ ID NO: 4819

SEQ ID NO: 54005 - DNA, 1365 bp, Bordetella bronchiseptica; identical to SEQ ID NO: 4820
  CDS (1)..(1365)

SEQ ID NO: 54006 - protein, 454 aa, Bordetella bronchiseptica; identical to SEQ ID NO: 4821

SEQ ID NO: 54007 - DNA, 1347 bp, Bordetella bronchiseptica; identical to SEQ ID NO: 4822
  CDS (1)..(1347)

SEQ ID NO: 54008 - protein, 448 aa, Bordetella bronchiseptica; identical to SEQ ID NO: 4823

SEQ ID NO: 54009 - DNA, 1365 bp, Bordetella bronchiseptica; identical to SEQ ID NO: 4824
  CDS (1)..(1365)

SEQ ID NO: 54010 - protein, 454 aa, Bordetella bronchiseptica; identical to SEQ ID NO: 4825

SEQ ID NO: 54011 - DNA, 3504 bp, Bordetella bronchiseptica; identical to SEQ ID NO: 4826
  CDS (1)..(3504)

SEQ ID NO: 54012 - protein, 1167 aa, Bordetella bronchiseptica; identical to SEQ ID NO: 4827

SEQ ID NO: 54013 - DNA, 7327 bp, Zea mays; identical to SEQ ID NO: 4828
  CDS (8)..(6985)

SEQ ID NO: 54014 - protein, 2325 aa, Zea mays; identical to SEQ ID NO: 4829

SEQ ID NO: 54015 - DNA, 7324 bp, Zea mays; identical to SEQ ID NO: 4830
  CDS (8)..(6982)

SEQ ID NO: 54016 - protein, 2324 aa, Zea mays; identical to SEQ ID NO: 4831

SEQ ID NO: 54017 - DNA, 3537 bp, Sus scrofa; identical to SEQ ID NO: 4832
  CDS (1)..(3537)

SEQ ID NO: 54018 - protein, 1178 aa, Sus scrofa; identical to SEQ ID NO: 4833

SEQ ID NO: 54019 - DNA, 7041 bp, Homo sapiens; identical to SEQ ID NO: 4834
  CDS (1)..(7041)

SEQ ID NO: 54020 - protein, 2346 aa, Homo sapiens [sequence omitted]

SEQ ID NO: 54021 - DNA, 2467 bp, Mus musculus; identical to SEQ ID NO: 4836
  CDS (6)..(2180)

SEQ ID NO: 54022 - protein, 724 aa, Mus musculus; identical to SEQ ID NO: 4837

SEQ ID NO: 54023 - DNA, 1323 bp, Bacillus cereus; identical to SEQ ID NO: 4838
  CDS (1)..(1323)

SEQ ID NO: 54024 - protein, 440 aa, Bacillus cereus; identical to SEQ ID NO: 4839

SEQ ID NO: 54025 - DNA, 3447 bp, Bacillus cereus; identical to SEQ ID NO: 4840
  CDS (1)..(3447)

SEQ ID NO: 54026 - protein, 1148 aa, Bacillus cereus; identical to SEQ ID NO: 4841

SEQ ID NO: 54027 - DNA, 1353 bp, Bacillus anthracis; identical to SEQ ID NO: 4842
  CDS (1)..(1353)

SEQ ID NO: 54028 - protein, 450 aa, Bacillus anthracis; identical to SEQ ID NO: 4843

SEQ ID NO: 54029 - DNA, 3447 bp, Bacillus anthracis; identical to SEQ ID NO: 4844
  CDS (1)..(3447)

SEQ ID NO: 54030 - protein, 1148 aa, Bacillus anthracis; identical to SEQ ID NO: 4845

SEQ ID NO: 54031 - DNA, 3636 bp, Nitrosomonas europaea; identical to SEQ ID NO: 4846
  CDS (1)..(3636)

SEQ ID NO: 54032 - protein, 1211 aa, Nitrosomonas europaea; identical to SEQ ID NO: 4847

SEQ ID NO: 54033 - DNA, 1356 bp, Chlamydophila caviae; identical to SEQ ID NO: 4848
  CDS (1)..(1356)

SEQ ID NO: 54034 - protein, 451 aa, Chlamydophila caviae; identical to SEQ ID NO: 4849

SEQ ID NO: 54035 - DNA, 3516 bp, Streptomyces avermitilis; identical to SEQ ID NO: 4850
  CDS (1)..(3516)

SEQ ID NO: 54036 - protein, 1171 aa, Streptomyces avermitilis; identical to SEQ ID NO: 4851

SEQ ID NO: 54037 - DNA, 2103 bp, Streptomyces avermitilis; identical to SEQ ID NO: 4852
  CDS (1)..(2103)

SEQ ID NO: 54038 - protein, 700 aa, Streptomyces avermitilis; identical to SEQ ID NO: 4853

SEQ ID NO: 54039 - DNA, 1851 bp, Streptomyces avermitilis; identical to SEQ ID NO: 4854
  CDS (1)..(1851)

SEQ ID NO: 54040 - protein, 616 aa, Streptomyces avermitilis; identical to SEQ ID NO: 4855

SEQ ID NO: 54041 - DNA, 1773 bp, Streptomyces avermitilis; identical to SEQ ID NO: 4856
  CDS (1)..(1773)

SEQ ID NO: 54042 - protein, 590 aa, Streptomyces avermitilis; identical to SEQ ID NO: 4857

SEQ ID NO: 54043 - DNA, 1359 bp, Nitrosomonas europaea; identical to SEQ ID NO: 4858
  CDS (1)..(1359)

SEQ ID NO: 54044 - protein, 452 aa, Nitrosomonas europaea; identical to SEQ ID NO: 4859

SEQ ID NO: 54045 - DNA, 1371 bp, Enterococcus faecalis; identical to SEQ ID NO: 4860
  CDS (1)..(1371)

SEQ ID NO: 54046 - protein, 456 aa, Enterococcus faecalis; identical to SEQ ID NO: 4861

SEQ ID NO: 54047 - DNA, 3492 bp, Enterococcus faecalis; identical to SEQ ID NO: 4862
  CDS (64)..(3492)

SEQ ID NO: 54048 - protein, 1142 aa, Enterococcus faecalis; identical to SEQ ID NO: 4863

SEQ ID NO: 54049 - DNA, 1347 bp, Coxiella burnetii; identical to SEQ ID NO: 4864
  CDS (1)..(1347)

SEQ ID NO: 54050 - protein, 448 aa, Coxiella burnetii; identical to SEQ ID NO: 4865

SEQ ID NO: 54051 - DNA, 1986 bp, Coxiella burnetii; identical to SEQ ID NO: 4866
  CDS (1)..(1986)

SEQ ID NO: 54052 - protein, 661 aa, Coxiella burnetii; identical to SEQ ID NO: 4867

SEQ ID NO: 54053 - DNA, 3396 bp, Tropheryma whipplei; identical to SEQ ID NO: 4868
  CDS (1)..(3396)

SEQ ID NO: 54054 - protein, 1131 aa, Tropheryma whipplei; identical to SEQ ID NO: 4869

SEQ ID NO: 54055 - DNA, 1776 bp, Tropheryma whipplei; identical to SEQ ID NO: 4870
  CDS (1)..(1776)

SEQ ID NO: 54056 - protein, 591 aa, Tropheryma whipplei; identical to SEQ ID NO: 4871

SEQ ID NO: 54057 - DNA, 2004 bp, Methylobacterium extorquens; identical to SEQ ID NO: 4872
  CDS (1)..(2004)

SEQ ID NO: 54058 - protein, 667 aa, Methylobacterium extorquens; identical to SEQ ID NO: 4873

SEQ ID NO: 54059 - DNA, 7446 bp, Setaria italica; identical to SEQ ID NO: 4874
  CDS (59)..(7024)

SEQ ID NO: 54060 - protein, 2321 aa, Setaria italica; identical to SEQ ID NO: 4875

SEQ ID NO: 54061 - DNA, 3994 bp, Bos taurus; identical to SEQ ID NO: 4876
  CDS (69)..(3605)

SEQ ID NO: 54062 - protein, 1178 aa, Bos taurus; identical to SEQ ID NO: 4877

SEQ ID NO: 54063 - DNA, 1530 bp, Acidianus brierleyi; identical to SEQ ID NO: 4878
  CDS (1)..(1530)

SEQ ID NO: 54064 - protein, 509 aa, Acidianus brierleyi; identical to SEQ ID NO: 4879

SEQ ID NO: 54065 - DNA, 1368 bp, Xylella fastidiosa; identical to SEQ ID NO: 4880
  CDS (1)..(1368)

SEQ ID NO: 54066 - protein, 455 aa, Xylella fastidiosa; identical to SEQ ID NO: 4881

SEQ ID NO: 54067 - DNA, 2115 bp, Vibrio parahaemolyticus; identical to SEQ ID NO: 4882
  CDS (1)..(2115)

SEQ ID NO: 54068 - protein, 704 aa, Vibrio parahaemolyticus; identical to SEQ ID NO: 4883

SEQ ID NO: 54069 - DNA, 1344 bp, Vibrio parahaemolyticus; identical to SEQ ID NO: 4884
  CDS (1)..(1344)

SEQ ID NO: 54070 - protein, 447 aa, Vibrio parahaemolyticus; identical to SEQ ID NO: 4885

SEQ ID NO: 54071 - DNA, 1416 bp, Pseudomonas syringae; identical to SEQ ID NO: 4886
  CDS (1)..(1416)

SEQ ID NO: 54072 - protein, 471 aa, Pseudomonas syringae; identical to SEQ ID NO: 4887

SEQ ID NO: 54073 - DNA, 1740 bp, Pseudomonas syringae; identical to SEQ ID NO: 4888
  CDS (1)..(1740)

SEQ ID NO: 54074 - protein, 579 aa, Pseudomonas syringae; identical to SEQ ID NO: 4889

SEQ ID NO: 54075 - DNA, 1344 bp, Pseudomonas syringae; identical to SEQ ID NO: 4890
  CDS (1)..(1344)

SEQ ID NO: 54076 - protein, 447 aa, Pseudomonas syringae; identical to SEQ ID NO: 4891

SEQ ID NO: 54077 - DNA, 3681 bp, Pseudomonas syringae; identical to SEQ ID NO: 4892
  CDS (1)..(3681)

SEQ ID NO: 54078 - protein, 1226 aa, Pseudomonas syringae; identical to SEQ ID NO: 4893

SEQ ID NO: 54079 - DNA, 1353 bp, Pseudomonas syringae; identical to SEQ ID NO: 4894
  CDS (1)..(1353)

SEQ ID NO: 54080 - protein, 450 aa, Pseudomonas syringae; identical to SEQ ID NO: 4895

SEQ ID NO: 54081 - DNA, 1950 bp, Pseudomonas syringae; identical to SEQ ID NO: 4896
  CDS (1)..(1950)

SEQ ID NO: 54082 - protein, 649 aa, Pseudomonas syringae; identical to SEQ ID NO: 4897

SEQ ID NO: 54083 - DNA, 1416 bp, Pseudomonas putida; identical to SEQ ID NO: 4898
  CDS (1)..(1416)

SEQ ID NO: 54084 - protein, 471 aa, Pseudomonas putida; identical to SEQ ID NO: 4899

SEQ ID NO: 54085 - DNA, 1953 bp, Pseudomonas putida; identical to SEQ ID NO: 4900
  CDS (1)..(1953)

SEQ ID NO: 54086 - protein, 650 aa, Pseudomonas putida; identical to SEQ ID NO: 4901

SEQ ID NO: 54087 - DNA, 1356 bp, Pseudomonas putida; identical to SEQ ID NO: 4902
  CDS (1)..(1356)

SEQ ID NO: 54088 - protein, 451 aa, Pseudomonas putida; identical to SEQ ID NO: 4903

SEQ ID NO: 54089 - DNA, 3435 bp, Lactobacillus plantarum; identical to SEQ ID NO: 4904
  CDS (1)..(3435)

SEQ ID NO: 54090 - protein, 1144 aa, Lactobacillus plantarum; identical to SEQ ID NO: 4905

SEQ ID NO: 54091 - DNA, 1389 bp, Lactobacillus plantarum; identical to SEQ ID NO: 4906
  CDS (1)..(1389)

SEQ ID NO: 54092 - protein, 462 aa, Lactobacillus plantarum; identical to SEQ ID NO: 4907

SEQ ID NO: 54093 - DNA, 1341 bp, Clostridium tetani; identical to SEQ ID NO: 4908
  CDS (1)..(1341)

SEQ ID NO: 54094 - protein, 446 aa, Clostridium tetani; identical to SEQ ID NO: 4909

SEQ ID NO: 54095 - DNA, 3318 bp, Bradyrhizobium japonicum; identical to SEQ ID NO: 4910
  CDS (1)..(3318)

SEQ ID NO: 54096 - protein, 1105 aa, Bradyrhizobium japonicum; identical to SEQ ID NO: 4911

SEQ ID NO: 54097 - DNA, 2016 bp, Bradyrhizobium japonicum; identical to SEQ ID NO: 4912
  CDS (1)..(2016)

SEQ ID NO: 54098 - protein, 671 aa, Bradyrhizobium japonicum; identical to SEQ ID NO: 4913

SEQ ID NO: 54099 - DNA, 2064 bp, Bradyrhizobium japonicum; identical to SEQ ID NO: 4914
  CDS (1)..(2064)

SEQ ID NO: 54100 - protein, 687 aa, Bradyrhizobium japonicum; identical to SEQ ID NO: 4915

SEQ ID NO: 54101 - DNA, 1359 bp, Bradyrhizobium japonicum; identical to SEQ ID NO: 4916
  CDS (1)..(1359)

SEQ ID NO: 54102 - protein, 452 aa, Bradyrhizobium japonicum; identical to SEQ ID NO: 4917

SEQ ID NO: 54103 - DNA, 1356 bp, Bradyrhizobium japonicum; identical to SEQ ID NO: 4918
  CDS (1)..(1356)

SEQ ID NO: 54104 - protein, 451 aa, Bradyrhizobium japonicum; identical to SEQ ID NO: 4919

SEQ ID NO: 54105 - DNA, 1977 bp, Bradyrhizobium japonicum; identical to SEQ ID NO: 4920
  CDS (1)..(1977)

SEQ ID NO: 54106 - protein, 658 aa, Bradyrhizobium japonicum; identical to SEQ ID NO: 4921

SEQ ID NO: 54107 - DNA, 1512 bp, Bacteroides thetaiotaomicron; identical to SEQ ID NO: 4922
  CDS (1)..(1512)

SEQ ID NO: 54108 - protein, 503 aa, Bacteroides thetaiotaomicron; identical to SEQ ID NO: 4923

SEQ ID NO: 54109 - DNA, 1512 bp, Bacteroides thetaiotaomicron; identical to SEQ ID NO: 4924
  CDS (1)..(1512)

SEQ ID NO: 54110 - protein, 503 aa, Bacteroides thetaiotaomicron; identical to SEQ ID NO: 4925

SEQ ID NO: 54111 - DNA, 2748 bp, Pagrus major; identical to SEQ ID NO: 4926
  CDS (188)..(2341): n means a or g or c or t/u

SEQ ID NO: 54112 - protein, 717 aa, Pagrus major; identical to SEQ ID NO: 4927

SEQ ID NO: 54113 - DNA, 4010 bp, Pagrus major; identical to SEQ ID NO: 4928
  CDS (389)..(3928): n means a or g or c or t/u

SEQ ID NO: 54114 - protein, 1179 aa, Pagrus major; identical to SEQ ID NO: 4929

SEQ ID NO: 54115 - DNA, 1359 bp, Staphylococcus epidermidis; identical to SEQ ID NO: 4930
  CDS (1)..(1359)

SEQ ID NO: 54116 - protein, 452 aa, Staphylococcus epidermidis; identical to SEQ ID NO: 4931

SEQ ID NO: 54117 - DNA, 1359 bp, Staphylococcus epidermidis; identical to SEQ ID NO: 4932
  CDS (1)..(1359)

SEQ ID NO: 54118 - protein, 452 aa, Staphylococcus epidermidis; identical to SEQ ID NO: 4933

SEQ ID NO: 54119 - DNA, 3465 bp, Staphylococcus epidermidis; identical to SEQ ID NO: 4934
  CDS (4)..(3465)

SEQ ID NO: 54120 - protein, 1153 aa, Staphylococcus epidermidis; identical to SEQ ID NO: 4935

SEQ ID NO: 54121 - DNA, 1338 bp, Wigglesworthia glossinidia brevipalpis; identical to SEQ ID NO: 4936
  CDS (1)..(1338)

SEQ ID NO: 54122 - protein, 445 aa, Wigglesworthia glossinidia brevipalpis; identical to SEQ ID NO: 4937

SEQ ID NO: 54123 - DNA, 1362 bp, Synechococcus elongatus; identical to SEQ ID NO: 4938
  CDS (1)..(1362)

SEQ ID NO: 54124 - protein, 453 aa, Synechococcus elongatus; identical to SEQ ID NO: 4939

SEQ ID NO: 54125 - DNA, 1371 bp, Streptococcus mutans; identical to SEQ ID NO: 4940
  CDS (1)..(1371)

SEQ ID NO: 54126 - protein, 456 aa, Streptococcus mutans; identical to SEQ ID NO: 4941

SEQ ID NO: 54127 - DNA, 1371 bp, Streptococcus agalactiae; identical to SEQ ID NO: 4942
  CDS (1)..(1371)

SEQ ID NO: 54128 - protein, 456 aa, Streptococcus agalactiae; identical to SEQ ID NO: 4943

SEQ ID NO: 54129 - DNA, 2085 bp, Shewanella oneidensis; identical to SEQ ID NO: 4944
  CDS (1)..(2085)

SEQ ID NO: 54130 - protein, 694 aa, Shewanella oneidensis; identical to SEQ ID NO: 4945

SEQ ID NO: 54131 - DNA, 4554 bp, Shewanella oneidensis; identical to SEQ ID NO: 4946
  CDS (1)..(4554)

SEQ ID NO: 54132 - protein, 1517 aa, Shewanella oneidensis; identical to SEQ ID NO: 4947

SEQ ID NO: 54133 - DNA, 1368 bp, Oceanobacillus iheyensis; identical to SEQ ID NO: 4948
  CDS (1)..(1368)

SEQ ID NO: 54134 - protein, 455 aa, Oceanobacillus iheyensis; identical to SEQ ID NO: 4949

SEQ ID NO: 54135 - DNA, 1341 bp, Oceanobacillus iheyensis; identical to SEQ ID NO: 4950
  CDS (1)..(1341)

SEQ ID NO: 54136 - protein, 446 aa, Oceanobacillus iheyensis; identical to SEQ ID NO: 4951

SEQ ID NO: 54137 - DNA, 3444 bp, Oceanobacillus iheyensis; identical to SEQ ID NO: 4952
  CDS (1)..(3444)

SEQ ID NO: 54138 - protein, 1147 aa, Oceanobacillus iheyensis; identical to SEQ ID NO: 4953

SEQ ID NO: 54139 - DNA, 1464 bp, Leptospira interrogans; identical to SEQ ID NO: 4954
  CDS (1)..(1464)

SEQ ID NO: 54140 - protein, 487 aa, Leptospira interrogans; identical to SEQ ID NO: 4955

SEQ ID NO: 54141 - DNA, 2381 bp, Corynebacterium efficiens; identical to SEQ ID NO: 4956
  CDS (982)..(2352)

SEQ ID NO: 54142 - protein, 456 aa, Corynebacterium efficiens; identical to SEQ ID NO: 4957

SEQ ID NO: 54143 - DNA, 3609 bp, Corynebacterium efficiens; identical to SEQ ID NO: 4958
  CDS (1)..(3609)

SEQ ID NO: 54144 - protein, 1202 aa, Corynebacterium efficiens; identical to SEQ ID NO: 4959

SEQ ID NO: 54145 - DNA, 3507 bp, Corynebacterium efficiens; identical to SEQ ID NO: 4960
  CDS (1)..(3507)

SEQ ID NO: 54146 - protein, 1168 aa, Corynebacterium efficiens; identical to SEQ ID NO: 4961

SEQ ID NO: 54147 - DNA, 3477 bp, Brucella suis; identical to SEQ ID NO: 4962
  CDS (1)..(3477)

SEQ ID NO: 54148 - protein, 1158 aa, Brucella suis; identical to SEQ ID NO: 4963

SEQ ID NO: 54149 - DNA, 2004 bp, Brucella suis; identical to SEQ ID NO: 4964
  CDS (1)..(2004)

SEQ ID NO: 54150 - protein, 667 aa, Brucella suis; identical to SEQ ID NO: 4965

SEQ ID NO: 54151 - DNA, 1359 bp, Brucella suis; identical to SEQ ID NO: 4966
  CDS (1)..(1359)

SEQ ID NO: 54152 - protein, 452 aa, Brucella suis; identical to SEQ ID NO: 4967

SEQ ID NO: 54153 - DNA, 1965 bp, Bifidobacterium longum; identical to SEQ ID NO: 4968
  CDS (1)..(1965)

SEQ ID NO: 54154 - protein, 654 aa, Bifidobacterium longum; identical to SEQ ID NO: 4969

SEQ ID NO: 54155 - DNA, 10011 bp, Plasmodium falciparum; identical to SEQ ID NO: 4970
  CDS (1)..(10011)

SEQ ID NO: 54156 - protein, 3336 aa, Plasmodium falciparum; identical to SEQ ID NO: 4971

SEQ ID NO: 54157 - DNA, 1533 bp, Metallosphaera sedula; identical to SEQ ID NO: 4972
  CDS (1)..(1533)

SEQ ID NO: 54158 - protein, 510 aa, Metallosphaera sedula; identical to SEQ ID NO: 4973

SEQ ID NO: 54159 - DNA, 3559 bp, Gallus gallus; identical to SEQ ID NO: 4974
  CDS (1)..(3537): s means g or c

SEQ ID NO: 54160 - protein, 1178 aa, Gallus gallus; identical to SEQ ID NO: 4975
  misc_feature (566)..(566): Xaa can be Ala or Pro

SEQ ID NO: 54161 - DNA, 1365 bp, Streptococcus pyogenes; identical to SEQ ID NO: 4976
  CDS (1)..(1365)

SEQ ID NO: 54162 - protein, 454 aa, Streptococcus pyogenes; identical to SEQ ID NO: 4977

SEQ ID NO: 54163 - DNA, 1344 bp, Chlorobium tepidum; identical to SEQ ID NO: 4978
  CDS (1)..(1344)

SEQ ID NO: 54164 - protein, 447 aa, Chlorobium tepidum; identical to SEQ ID NO: 4979

SEQ ID NO: 54165 - DNA, 7589 bp, Alopecurus myosuroides; identical to SEQ ID NO: 4980
  CDS (157)..(7119)

SEQ ID NO: 54166 - protein, 2320 aa, Alopecurus myosuroides; identical to SEQ ID NO: 4981

SEQ ID NO: 54167 - DNA, 4439 bp, Drosophila melanogaster; identical to SEQ ID NO: 4982
  CDS (417)..(4010)

SEQ ID NO: 54168 - protein, 1197 aa, Drosophila melanogaster; identical to SEQ ID NO: 4983

SEQ ID NO: 54169 - DNA, 1362 bp, Staphylococcus aureus; identical to SEQ ID NO: 4984
  CDS (1)..(1362)

SEQ ID NO: 54170 - protein, 453 aa, Staphylococcus aureus; identical to SEQ ID NO: 4985

SEQ ID NO: 54171 - DNA, 3453 bp, Staphylococcus aureus; identical to SEQ ID NO: 4986
  CDS (1)..(3453)

SEQ ID NO: 54172 - protein, 1150 aa, Staphylococcus aureus; identical to SEQ ID NO: 4987

SEQ ID NO: 54173 - DNA, 2028 bp, Xanthomonas campestris; identical to SEQ ID NO: 4988
  CDS (1)..(2028)

SEQ ID NO: 54174 - protein, 675 aa, Xanthomonas campestris; identical to SEQ ID NO: 4989

SEQ ID NO: 54175 - DNA, 3648 bp, Xanthomonas axonopodis; identical to SEQ ID NO: 4990
  CDS (1)..(3648)

SEQ ID NO: 54176 - protein, 1215 aa, Xanthomonas axonopodis; identical to SEQ ID NO: 4991

SEQ ID NO: 54177 - DNA, 2028 bp, Xanthomonas axonopodis; identical to SEQ ID NO: 4992
  CDS (1)..(2028)

SEQ ID NO: 54178 - protein, 675 aa, Xanthomonas axonopodis; identical to SEQ ID NO: 4993

SEQ ID NO: 54179 - DNA, 1494 bp, Methanosarcina mazei; identical to SEQ ID NO: 4994
  CDS (1)..(1494)

SEQ ID NO: 54180 - protein, 497 aa, Methanosarcina mazei; identical to SEQ ID NO: 4995

SEQ ID NO: 54181 - DNA, 1897 bp, Amycolatopsis mediterranei; identical to SEQ ID NO: 4996
  CDS (101)..(1897)

SEQ ID NO: 54182 - protein, 598 aa, Amycolatopsis mediterranei; identical to SEQ ID NO: 4997

SEQ ID NO: 54183 - DNA, 2381 bp, Corynebacterium efficiens; identical to SEQ ID NO: 4998
  CDS (577)..(2352)

SEQ ID NO: 54184 - protein, 591 aa, Corynebacterium efficiens; identical to SEQ ID NO: 4999

SEQ ID NO: 54185 - DNA, 7223 bp, Oryza sativa; identical to SEQ ID NO: 5000
  CDS (1)..(6804)

SEQ ID NO: 54186 - protein, 2267 aa, Oryza sativa; identical to SEQ ID NO: 5001

SEQ ID NO: 54187 - DNA, 1482 bp, Methanosarcina acetivorans; identical to SEQ ID NO: 5002
  CDS (1)..(1482)

SEQ ID NO: 54188 - protein, 493 aa, Methanosarcina acetivorans; identical to SEQ ID NO: 5003

SEQ ID NO: 54189 - DNA, 2511 bp, Homo sapiens; identical to SEQ ID NO: 5004
  CDS (47)..(2233)

SEQ ID NO: 54190 - protein, 728 aa, Homo sapiens; identical to SEQ ID NO: 5005

SEQ ID NO: 54191 - DNA, 4190 bp, Pichia angusta; identical to SEQ ID NO: 5006
  CDS (275)..(3802)

SEQ ID NO: 54192 - protein, 1175 aa, Pichia angusta; identical to SEQ ID NO: 5007

SEQ ID NO: 54193 - DNA, 1353 bp, Clostridium perfringens; identical to SEQ ID NO: 5008
  CDS (1)..(1353)

SEQ ID NO: 54194 - protein, 450 aa, Clostridium perfringens; identical to SEQ ID NO: 5009

SEQ ID NO: 54195 - DNA, 1368 bp, Ralstonia solanacearum; identical to SEQ ID NO: 5010
  CDS (1)..(1368)

SEQ ID NO: 54196 - protein, 455 aa, Ralstonia solanacearum; identical to SEQ ID NO: 5011

SEQ ID NO: 54197 - DNA, 1371 bp, Ralstonia solanacearum; identical to SEQ ID NO: 5012
  CDS (1)..(1371)

SEQ ID NO: 54198 - protein, 456 aa, Ralstonia solanacearum; identical to SEQ ID NO: 5013

SEQ ID NO: 54199 - DNA, 2139 bp, Ralstonia solanacearum; identical to SEQ ID NO: 5014
  CDS (1)..(2139)

SEQ ID NO: 54200 - protein, 712 aa, Ralstonia solanacearum; identical to SEQ ID NO: 5015

SEQ ID NO: 54201 - DNA, 3459 bp, Rhizobium meliloti; identical to SEQ ID NO: 5016
  CDS (1)..(3459)

SEQ ID NO: 54202 - protein, 1152 aa, Rhizobium meliloti; identical to SEQ ID NO: 5017

SEQ ID NO: 54203 - DNA, 1350 bp, Rhizobium meliloti; identical to SEQ ID NO: 5018
  CDS (1)..(1350)

SEQ ID NO: 54204 - protein, 449 aa, Rhizobium meliloti; identical to SEQ ID NO: 5019

SEQ ID NO: 54205 - DNA, 1677 bp, Brassica napus; identical to SEQ ID NO: 5020
  CDS (34)..(1641)

SEQ ID NO: 54206 - protein, 535 aa, Brassica napus; identical to SEQ ID NO: 5021

SEQ ID NO: 54207 - DNA, 1542 bp, Sulfolobus tokodaii; identical to SEQ ID NO: 5022
  CDS (1)..(1542)

SEQ ID NO: 54208 - protein, 513 aa, Sulfolobus tokodaii; identical to SEQ ID NO: 5023

SEQ ID NO: 54209 - DNA, 2085 bp, Rhizobium loti; identical to SEQ ID NO: 5024
  CDS (1)..(2085)

SEQ ID NO: 54210 - protein, 694 aa, Rhizobium loti; identical to SEQ ID NO: 5025

SEQ ID NO: 54211 - DNA, 1962 bp, Rhizobium loti; identical to SEQ ID NO: 5026
  CDS (1)..(1962)

SEQ ID NO: 54212 - protein, 653 aa, Rhizobium loti; identical to SEQ ID NO: 5027

SEQ ID NO: 54213 - DNA, 3459 bp, Rhizobium loti; identical to SEQ ID NO: 5028
  CDS (1)..(3459)

SEQ ID NO: 54214 - protein, 1152 aa, Rhizobium loti; identical to SEQ ID NO: 5029

SEQ ID NO: 54215 - DNA, 2013 bp, Rhizobium loti; identical to SEQ ID NO: 5030
  CDS (1)..(2013)

SEQ ID NO: 54216 - protein, 670 aa, Rhizobium loti; identical to SEQ ID NO: 5031

SEQ ID NO: 54217 - DNA, 1347 bp, Pasteurella multocida; identical to SEQ ID NO: 5032
  CDS (1)..(1347)

SEQ ID NO: 54218 - protein, 448 aa, Pasteurella multocida; identical to SEQ ID NO: 5033

SEQ ID NO: 54219 - DNA, 4000 bp, Brachydanio rerio; identical to SEQ ID NO: 5034
  CDS (25)..(3567)

SEQ ID NO: 54220 - protein, 1180 aa, Brachydanio rerio; identical to SEQ ID NO: 5035

SEQ ID NO: 54221 - DNA, 1386 bp, Streptomyces sp; identical to SEQ ID NO: 5036
  CDS (1)..(1386)

SEQ ID NO: 54222 - protein, 461 aa, Streptomyces sp; identical to SEQ ID NO: 5037

SEQ ID NO: 54223 - DNA, 1344 bp, Gamma; identical to SEQ ID NO: 5038
  CDS (1)..(1344)

SEQ ID NO: 54224 - protein, 447 aa, Gamma; identical to SEQ ID NO: 5039

SEQ ID NO: 54225 - DNA, 4218 bp, Mycobacterium smegmatis; identical to SEQ ID NO: 5040
  CDS (600)..(3983)

SEQ ID NO: 54226 - protein, 1127 aa, Mycobacterium smegmatis; identical to SEQ ID NO: 5041

SEQ ID NO: 54227 - DNA, 1722 bp, Myxococcus xanthus; identical to SEQ ID NO: 5042
  CDS (1)..(1722)

SEQ ID NO: 54228 - protein, 573 aa, Myxococcus xanthus; identical to SEQ ID NO: 5043

SEQ ID NO: 54229 - DNA, 6966 bp, Brassica napus; identical to SEQ ID NO: 5044
  CDS (1)..(6966)

SEQ ID NO: 54230 - protein, 2321 aa, Brassica napus; identical to SEQ ID NO: 5045

SEQ ID NO: 54231 - DNA, 7128 bp, Arabidopsis thaliana; identical to SEQ ID NO: 5046
  CDS (1)..(7128)

SEQ ID NO: 54232 - protein, 2375 aa, Arabidopsis thaliana; identical to SEQ ID NO: 5047

SEQ ID NO: 54233 - DNA, 3579 bp, Aspergillus niger; identical to SEQ ID NO: 5048
  CDS (1)..(3579)

SEQ ID NO: 54234 - protein, 1192 aa, Aspergillus niger; identical to SEQ ID NO: 5049

SEQ ID NO: 54235 - DNA, 1482 bp, Methanosarcina barkeri; identical to SEQ ID NO: 5050
  CDS (1)..(1482)

SEQ ID NO: 54236 - protein, 493 aa, Methanosarcina barkeri; identical to SEQ ID NO: 5051

SEQ ID NO: 54237 - DNA, 1845 bp, Streptomyces coelicolor; identical to SEQ ID NO: 5052
  CDS (1)..(1845)

SEQ ID NO: 54238 - protein, 614 aa, Streptomyces coelicolor; identical to SEQ ID NO: 5053

SEQ ID NO: 54239 - DNA, 1941 bp, Streptomyces coelicolor; identical to SEQ ID NO: 5054
  CDS (1)..(1941)

SEQ ID NO: 54240 - protein, 646 aa, Streptomyces coelicolor; identical to SEQ ID NO: 5055

SEQ ID NO: 54241 - DNA, 1293 bp, Bacillus subtilis; identical to SEQ ID NO: 5056
  CDS (1)..(1293)

SEQ ID NO: 54242 - protein, 430 aa, Bacillus subtilis; identical to SEQ ID NO: 5057

SEQ ID NO: 54243 - DNA, 1323 bp, Lactobacillus plantarum; identical to SEQ ID NO: 5058
  CDS (1)..(1323)

SEQ ID NO: 54244 - protein, 440 aa, Lactobacillus plantarum; identical to SEQ ID NO: 5059

SEQ ID NO: 54245 - DNA, 1620 bp, Glycine max; identical to SEQ ID NO: 5060
  CDS (1)..(1620)

SEQ ID NO: 54246 - protein, 539 aa, Glycine max; identical to SEQ ID NO: 5061

SEQ ID NO: 54247 - DNA, 3622 bp, Lactococcus lactis; identical to SEQ ID NO: 5062
  CDS (105)..(3518)

SEQ ID NO: 54248 - protein, 1137 aa, Lactococcus lactis; identical to SEQ ID NO: 5063

SEQ ID NO: 54249 - DNA, 3375 bp, Streptomyces coelicolor; identical to SEQ ID NO: 5064
  CDS (1)..(3375)

SEQ ID NO: 54250 - protein, 1124 aa, Streptomyces coelicolor; identical to SEQ ID NO: 5065

SEQ ID NO: 54251 - DNA, 8001 bp, Drosophila melanogaster; identical to SEQ ID NO: 5066
  CDS (177)..(7625)

SEQ ID NO: 54252 - protein, 2482 aa, Drosophila melanogaster; identical to SEQ ID NO: 5067

SEQ ID NO: 54253 - DNA, 2397 bp, Drosophila melanogaster; identical to SEQ ID NO: 5068
  CDS (74)..(2170)

SEQ ID NO: 54254 - protein, 698 aa, Drosophila melanogaster; identical to SEQ ID NO: 5069

SEQ ID NO: 54255 - DNA, 4311 bp, Pseudomonas fluorescens; identical to SEQ ID NO: 5070
  CDS (125)..(3766)

SEQ ID NO: 54256 - protein, 1213 aa, Pseudomonas fluorescens; identical to SEQ ID NO: 5071

SEQ ID NO: 54257 - DNA, 1755 bp, Streptomyces venezuelae; identical to SEQ ID NO: 5072
  CDS (1)..(1755)

SEQ ID NO: 54258 - protein, 584 aa, Streptomyces venezuelae; identical to SEQ ID NO: 5073

SEQ ID NO: 54259 - DNA, 4391 bp, Drosophila melanogaster; identical to SEQ ID NO: 5074
  CDS (417)..(3962)

SEQ ID NO: 54260 - protein, 1181 aa, Drosophila melanogaster; identical to SEQ ID NO: 5075

SEQ ID NO: 54261 - DNA, 9422 bp, Ovis aries; identical to SEQ ID NO: 5076
  CDS (320)..(7360)

SEQ ID NO: 54262 - protein, 2346 aa, Ovis aries; identical to SEQ ID NO: 5077

SEQ ID NO: 54263 - DNA, 7452 bp, Homo sapiens; identical to SEQ ID NO: 5078
  CDS (1)..(7452)

SEQ ID NO: 54264 - protein, 2483 aa, Homo sapiens; identical to SEQ ID NO: 5079

SEQ ID NO: 54265 - DNA, 2546 bp, Homo sapiens; identical to SEQ ID NO: 5080
  CDS (133)..(2310)

SEQ ID NO: 54266 - protein, 725 aa, Homo sapiens; identical to SEQ ID NO: 5081

SEQ ID NO: 54267 - DNA, 3953 bp, Homo sapiens; identical to SEQ ID NO: 5082
  CDS (39)..(3575)

SEQ ID NO: 54268 - protein, 1178 aa, Homo sapiens; identical to SEQ ID NO: 5083

SEQ ID NO: 54269 - DNA, 4456 bp, Pichia pastoris; identical to SEQ ID NO: 5084
  CDS (700)..(4269)

SEQ ID NO: 54270 - protein, 1189 aa, Pichia pastoris; identical to SEQ ID NO: 5085

SEQ ID NO: 54271 - DNA, 3945 bp, Rattus norvegicus; identical to SEQ ID NO: 5086
  CDS (35)..(3571)

SEQ ID NO: 54272 - protein, 1178 aa, Rattus norvegicus; identical to SEQ ID NO: 5087

SEQ ID NO: 54273 - DNA, 3858 bp, Xenopus laevis; identical to SEQ ID NO: 5088
  CDS (33)..(3566)

SEQ ID NO: 54274 - protein, 1177 aa, Xenopus laevis; identical to SEQ ID NO: 5089

SEQ ID NO: 54275 - DNA, 3468 bp, Agrobacterium vitis; identical to SEQ ID NO: 5090
  CDS (1)..(3468)

SEQ ID NO: 54276 - protein, 1155 aa, Agrobacterium vitis; identical to SEQ ID NO: 5091

SEQ ID NO: 54277 - DNA, 1341 bp, Geobacter sulfurreducens; identical to SEQ ID NO: 5092
  CDS (1)..(1341)

SEQ ID NO: 54278 - protein, 446 aa, Geobacter sulfurreducens; identical to SEQ ID NO: 5093

SEQ ID NO: 54279 - DNA, 3447 bp, Geobacter sulfurreducens; identical to SEQ ID NO: 5094
  CDS (1)..(3447)

SEQ ID NO: 54280 - protein, 1148 aa, Geobacter sulfurreducens; identical to SEQ ID NO: 5095

SEQ ID NO: 54281 - DNA, 7496 bp, Homo sapiens; identical to SEQ ID NO: 5096
  CDS (120)..(7496)

SEQ ID NO: 54282 - protein, 2458 aa, Homo sapiens [sequence omitted]

SEQ ID NO: 54283 - DNA, 2172 bp, Emericella nidulans; identical to SEQ ID NO: 5098
  CDS (1)..(2172)

SEQ ID NO: 54284 - protein, 723 aa, Emericella nidulans; identical to SEQ ID NO: 5099

SEQ ID NO: 54285 - DNA, 3384 bp, Mycobacterium paratuberculosis; identical to SEQ ID NO: 5100
  CDS (1)..(3384)

SEQ ID NO: 54286 - protein, 1127 aa, Mycobacterium paratuberculosis; identical to SEQ ID NO: 5101

SEQ ID NO: 54287 - DNA, 1992 bp, Mycobacterium paratuberculosis; identical to SEQ ID NO: 5102
  CDS (1)..(1992)

SEQ ID NO: 54288 - protein, 663 aa, Mycobacterium paratuberculosis; identical to SEQ ID NO: 5103

SEQ ID NO: 54289 - DNA, 2016 bp, Mycobacterium paratuberculosis; identical to SEQ ID NO: 5104
  CDS (1)..(2016)

SEQ ID NO: 54290 - protein, 671 aa, Mycobacterium paratuberculosis; identical to SEQ ID NO: 5105

SEQ ID NO: 54291 - DNA, 3228 bp, Mycobacterium paratuberculosis; identical to SEQ ID NO: 5106
  CDS (1)..(3228)

SEQ ID NO: 54292 - protein, 1075 aa, Mycobacterium paratuberculosis; identical to SEQ ID NO: 5107

SEQ ID NO: 54293 - DNA, 1824 bp, Mycobacterium paratuberculosis; identical to SEQ ID NO: 5108
  CDS (1)..(1824)

SEQ ID NO: 54294 - protein, 607 aa, Mycobacterium paratuberculosis; identical to SEQ ID NO: 5109

SEQ ID NO: 54295 - DNA, 1320 bp, Treponema denticola; identical to SEQ ID NO: 5110
  CDS (1)..(1320)

SEQ ID NO: 54296 - protein, 439 aa, Treponema denticola; identical to SEQ ID NO: 5111

SEQ ID NO: 54297 - DNA, 2076 bp, Wolbachia pipientis wMel; identical to SEQ ID NO: 5112
  CDS (1)..(2076)

SEQ ID NO: 54298 - protein, 691 aa, Wolbachia pipientis wMel; identical to SEQ ID NO: 5113

SEQ ID NO: 54299 - DNA, 1338 bp, Bacillus cereus; identical to SEQ ID NO: 5114
  CDS (1)..(1338)

SEQ ID NO: 54300 - protein, 445 aa, Bacillus cereus; identical to SEQ ID NO: 5115

SEQ ID NO: 54301 - DNA, 6696 bp, Ashbya gossypii; identical to SEQ ID NO: 5116
  CDS (1)..(6696)

SEQ ID NO: 54302 - protein, 2231 aa, Ashbya gossypii; identical to SEQ ID NO: 5117

SEQ ID NO: 54303 - DNA, 3516 bp, Ashbya gossypii; identical to SEQ ID NO: 5118
  CDS (1)..(3516)

SEQ ID NO: 54304 - protein, 1171 aa, Ashbya gossypii; identical to SEQ ID NO: 5119

SEQ ID NO: 54305 - DNA, 5460 bp, Ashbya gossypii; identical to SEQ ID NO: 5120
  CDS (1)..(5460)

SEQ ID NO: 54306 - protein, 1819 aa, Ashbya gossypii; identical to SEQ ID NO: 5121

SEQ ID NO: 54307 - DNA, 1347 bp, uncultured marine gamma proteobacterium EBAC20E09; identical to SEQ ID NO: 5122
  CDS (1)..(1347)

SEQ ID NO: 54308 - protein, 448 aa, uncultured marine gamma proteobacterium EBAC20E09; identical to SEQ ID NO: 5123

SEQ ID NO: 54309 - DNA, 1338 bp, Thermus thermophilus; identical to SEQ ID NO: 5124
  CDS (1)..(1338)

SEQ ID NO: 54310 - protein, 445 aa, Thermus thermophilus; identical to SEQ ID NO: 5125

SEQ ID NO: 54311 - DNA, 3678 bp, Desulfovibrio vulgaris; identical to SEQ ID NO: 5126
  CDS (1)..(3678)

SEQ ID NO: 54312 - protein, 1225 aa, Desulfovibrio vulgaris; identical to SEQ ID NO: 5127

SEQ ID NO: 54313 - DNA, 1416 bp, Desulfovibrio vulgaris; identical to SEQ ID NO: 5128
  CDS (1)..(1416)

SEQ ID NO: 54314 - protein, 471 aa, Desulfovibrio vulgaris; identical to SEQ ID NO: 5129

SEQ ID NO: 54315 - DNA, 3441 bp, Listeria monocytogenes str; identical to SEQ ID NO: 5130
  CDS (1)..(3441)

SEQ ID NO: 54316 - protein, 1146 aa, Listeria monocytogenes str; identical to SEQ ID NO: 5131

SEQ ID NO: 54317 - DNA, 3516 bp, Oleomonas sagaranensis; identical to SEQ ID NO: 5132
  CDS (1)..(3516)

SEQ ID NO: 54318 - protein, 1171 aa, Oleomonas sagaranensis; identical to SEQ ID NO: 5133

SEQ ID NO: 54319 - DNA, 2016 bp, Caenorhabditis elegans; identical to SEQ ID NO: 5134
  CDS (1)..(2016)

SEQ ID NO: 54320 - protein, 671 aa, Caenorhabditis elegans; identical to SEQ ID NO: 5135

SEQ ID NO: 54321 - DNA, 1350 bp, Bacillus amyloliquefaciens; identical to SEQ ID NO: 5136
  CDS (1)..(1350)

SEQ ID NO: 54322 - protein, 449 aa, Bacillus amyloliquefaciens; identical to SEQ ID NO: 5137

SEQ ID NO: 54323 - DNA, 3549 bp, Rhodopseudomonas palustris; identical to SEQ ID NO: 5138
  CDS (1)..(3549)

SEQ ID NO: 54324 - protein, 1182 aa, Rhodopseudomonas palustris; identical to SEQ ID NO: 5139

SEQ ID NO: 54325 - DNA, 3312 bp, Rhodopseudomonas palustris; identical to SEQ ID NO: 5140
  CDS (1)..(3312)

SEQ ID NO: 54326 - protein, 1103 aa, Rhodopseudomonas palustris; identical to SEQ ID NO: 5141

SEQ ID NO: 54327 - DNA, 1983 bp, Rhodopseudomonas palustris; identical to SEQ ID NO: 5142
  CDS (1)..(1983)

SEQ ID NO: 54328 - protein, 660 aa, Rhodopseudomonas palustris; identical to SEQ ID NO: 5143

SEQ ID NO: 54329 - DNA, 1353 bp, Rhodopseudomonas palustris; identical to SEQ ID NO: 5144
  CDS (1)..(1353)

SEQ ID NO: 54330 - protein, 450 aa, Rhodopseudomonas palustris; identical to SEQ ID NO: 5145

SEQ ID NO: 54331 - DNA, 2016 bp, Rhodopseudomonas palustris; identical to SEQ ID NO: 5146
  CDS (1)..(2016)

SEQ ID NO: 54332 - protein, 671 aa, Rhodopseudomonas palustris; identical to SEQ ID NO: 5147

SEQ ID NO: 54333 - DNA, 2016 bp, Rhodopseudomonas palustris; identical to SEQ ID NO: 5148
  CDS (1)..(2016)

SEQ ID NO: 54334 - protein, 671 aa, Rhodopseudomonas palustris; identical to SEQ ID NO: 5149

SEQ ID NO: 54335 - DNA, 3426 bp, Corynebacterium diphtheriae; identical to SEQ ID NO: 5150
  CDS (1)..(3426)

SEQ ID NO: 54336 - protein, 1141 aa, Corynebacterium diphtheriae; identical to SEQ ID NO: 5151

SEQ ID NO: 54337 - DNA, 1785 bp, Corynebacterium diphtheriae; identical to SEQ ID NO: 5152
  CDS (1)..(1785)

SEQ ID NO: 54338 - protein, 594 aa, Corynebacterium diphtheriae; identical to SEQ ID NO: 5153

SEQ ID NO: 54339 - DNA, 1479 bp, Bdellovibrio bacteriovorus; identical to SEQ ID NO: 5154
  CDS (1)..(1479)

SEQ ID NO: 54340 - protein, 492 aa, Bdellovibrio bacteriovorus; identical to SEQ ID NO: 5155

SEQ ID NO: 54341 - DNA, 1503 bp, Bdellovibrio bacteriovorus; identical to SEQ ID NO: 5156
  CDS (1)..(1503)

SEQ ID NO: 54342 - protein, 500 aa, Bdellovibrio bacteriovorus; identical to SEQ ID NO: 5157

SEQ ID NO: 54343 - DNA, 1362 bp, Parachlamydia sp; identical to SEQ ID NO: 5158
  CDS (1)..(1362)

SEQ ID NO: 54344 - protein, 453 aa, Parachlamydia sp; identical to SEQ ID NO: 5159

SEQ ID NO: 54345 - DNA, 1506 bp, Methanococcus maripaludis; identical to SEQ ID NO: 5160
  CDS (1)..(1506)

SEQ ID NO: 54346 - protein, 501 aa, Methanococcus maripaludis; identical to SEQ ID NO: 5161

SEQ ID NO: 54347 - DNA, 1719 bp, Streptomyces antibioticus; identical to SEQ ID NO: 5162
  CDS (1)..(1719)

SEQ ID NO: 54348 - protein, 572 aa, Streptomyces antibioticus; identical to SEQ ID NO: 5163

SEQ ID NO: 54349 - DNA, 1344 bp, Photobacterium profundum; identical to SEQ ID NO: 5164
  CDS (1)..(1344)

SEQ ID NO: 54350 - protein, 447 aa, Photobacterium profundum; identical to SEQ ID NO: 5165

SEQ ID NO: 54351 - DNA, 24 bp, Primer
atgctggataaaattgttattgcc

SEQ ID NO: 54352 - DNA, 26 bp, Primer
ttatttttcctgaagaccgagttttt

SEQ ID NO: 54353 - protein, 690 aa, consensus
  MISC_FEATURE (1)..(690): consensus for the disclosure of xaa see table XV
LXANRGEIAXRXXRXXXXXXXXXVXXXXXXXXXXXAXXXXXDXXXXXXXXADXXXXXGXXXXXXXXXXXXXXYLXXXXXXXXAXXXXXXAXHPGYGFLSENXXFXXXXXXXXXGXXFXGPXXXXXXXXGXKXXXXXXXXXXXXPXXPXXXXXXXXXXXXXXXXXXXXXXXXXXXXXXXXXXXXXXXXXXXXXXGXPXXXXXXKAXXGGGGXGXXXXXXXXXXXXXXXXXXXEAXXXFXXXXXXXEXXXXXXXXRHXEXQXXXDXXXXXGXXXXLXXRDCSXQRRXQKXXEXXPXXXXXXXXXXXRXXXXXXXXXXXXXXXXXXXXYXXAGTXEFXXXXXXXXXXXXXXXXXXXXXFXEXNXRXQVEHXXTEXXXXXXDXXXXQXXXAXGXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXRXXXEXPXXXXXXXPXXGXXXXXXXXXXXXXXXXXXXXXXXXXXXRXXXXXXXXGXXXXXXXDXXXXKXXXXXXXXXXAXXXXXXALXXXXXXGXXXXTXXXXXXXXXXXXXF

SEQ ID NO: 54354 - protein, 53 aa, consensus; identical to SEQ ID NO: 5292
  MISC_FEATURE (1)..(53): consensus for the disclosure of xaa see table XV

SEQ ID NO: 54355 - protein, 75 aa, consensus; identical to SEQ ID NO: 5293
  MISC_FEATURE (1)..(75): consensus for the disclosure of xaa see table XV

SEQ ID NO: 54356 - protein, 100 aa, consensus; identical to SEQ ID NO: 5294
  MISC_FEATURE (1)..(100): consensus for the disclosure of xaa see table XV

SEQ ID NO: 54357 - protein, 46 aa, consensus; identical to SEQ ID NO: 5295
  MISC_FEATURE (1)..(46): consensus for the disclosure of xaa see table XV

SEQ ID NO: 54358 - DNA, 318 bp, Escherichia coli K12; identical to SEQ ID NO: 26631
  CDS (1)..(318)

SEQ ID NO: 54359 - protein, 105 aa, Escherichia coli K12; identical to SEQ ID NO: 26632

SEQ ID NO: 54360 - DNA, 318 bp, Salmonella typhimurium; identical to SEQ ID NO: 26633
  CDS (1)..(318)

SEQ ID NO: 54361 - protein, 105 aa, Salmonella typhimurium; identical to SEQ ID NO: 26634

SEQ ID NO: 54362 - DNA, 318 bp, Haemophilus influenzae; identical to SEQ ID NO: 26635
  CDS (1)..(318)

SEQ ID NO: 54363 - protein, 105 aa, Haemophilus influenzae; identical to SEQ ID NO: 26636

SEQ ID NO: 54364 - DNA, 318 bp, Yersinia pestis; identical to SEQ ID NO: 26637
  CDS (1)..(318)

SEQ ID NO: 54365 - protein, 105 aa, Yersinia pestis; identical to SEQ ID NO: 26638

SEQ ID NO: 54366 - DNA, 318 bp, Yersinia pseudotuberculosis IP 32953; identical to SEQ ID NO: 26639
  CDS (1)..(318)

SEQ ID NO: 54367 - protein, 105 aa, Yersinia pseudotuberculosis IP 32953; identical to SEQ ID NO: 26640

SEQ ID NO: 54368 - DNA, 318 bp, Erwinia carotovora; identical to SEQ ID NO: 26641
  CDS (1)..(318)

SEQ ID NO: 54369 - protein, 105 aa, Erwinia carotovora; identical to SEQ ID NO: 26642

SEQ ID NO: 54370 - DNA, 318 bp, Photobacterium profundum; identical to SEQ ID NO: 26643
  CDS (1)..(318)

SEQ ID NO: 54371 - protein, 105 aa, Photobacterium profundum; identical to SEQ ID NO: 26644

SEQ ID NO: 54372 - DNA, 318 bp, Haemophilus ducreyi; identical to SEQ ID NO: 26645
  CDS (1)..(318)

SEQ ID NO: 54373 - protein, 105 aa, Haemophilus ducreyi; identical to SEQ ID NO: 26646

SEQ ID NO: 54374 - DNA, 318 bp, Pasteurella multocida; identical to SEQ ID NO: 26647
  CDS (1)..(318)

SEQ ID NO: 54375 - protein, 105 aa, Pasteurella multocida; identical to SEQ ID NO: 26648

SEQ ID NO: 54376 - DNA, 318 bp, Photorhabdus luminescens; identical to SEQ ID NO: 26649
  CDS (1)..(318)

SEQ ID NO: 54377 - protein, 105 aa, Photorhabdus luminescens; identical to SEQ ID NO: 26650

SEQ ID NO: 54378 - DNA, 315 bp, Shewanella oneidensis; identical to SEQ ID NO: 26651
  CDS (1)..(315)

SEQ ID NO: 54379 - protein, 104 aa, Shewanella oneidensis; identical to SEQ ID NO: 26652

SEQ ID NO: 54380 - DNA, 321 bp, Vibrio parahaemolyticus; identical to SEQ ID NO: 26653
  CDS (1)..(321)

SEQ ID NO: 54381 - protein, 106 aa, Vibrio parahaemolyticus; identical to SEQ ID NO: 26654

SEQ ID NO: 54382 - DNA, 318 bp, Vibrio vulnificus; identical to SEQ ID NO: 26655
  CDS (1)..(318)

SEQ ID NO: 54383 - protein, 105 aa, Vibrio vulnificus; identical to SEQ ID NO: 26656

SEQ ID NO: 54384 - DNA, 20 bp, Primer
atggctgaatggagcggcga

SEQ ID NO: 54385 - DNA, 22 bp, Primer
ttagtattcccacgtctccggg

SEQ ID NO: 54386 - protein, 97 aa, consensus; identical to SEQ ID NO: 27310
  MISC_FEATURE (1)..(97): consensus for the disclosure of xaa see table XV

SEQ ID NO: 54387 - protein, 97 aa, consensus; identical to SEQ ID NO: 27309
  MISC_FEATURE (1)..(97): consensus for the disclosure of xaa see table XV

SEQ ID NO: 54388 - DNA, 429 bp, Escherichia coli; identical to SEQ ID NO: 37675
  CDS (1)..(429)

SEQ ID NO: 54389 - protein, 142 aa, Escherichia coli; identical to SEQ ID NO: 37676

SEQ ID NO: 54390 - DNA, 703 bp, Anopheles gambiae str. PEST; identical to SEQ ID NO: 37677
  CDS (57)..(647)

SEQ ID NO: 54391 - protein, 196 aa, Anopheles gambiae str. PEST; identical to SEQ ID NO: 37678

SEQ ID NO: 54392 - DNA, 498 bp, Thermococcus kodakaraensis; identical to SEQ ID NO: 37679
  CDS (1)..(498)

SEQ ID NO: 54393 - protein, 165 aa, Thermococcus kodakaraensis; identical to SEQ ID NO: 37680

SEQ ID NO: 54394 - DNA, 432 bp, Staphylococcus aureus subsp. aureus COL; identical to SEQ ID NO: 37681
  CDS (1)..(432)

SEQ ID NO: 54395 - protein, 143 aa, Staphylococcus aureus subsp. aureus COL; identical to SEQ ID NO: 37682

SEQ ID NO: 54396 - DNA, 591 bp, Danio rerio; identical to SEQ ID NO: 37683
  CDS (1)..(591)

SEQ ID NO: 54397 - protein, 196 aa, Danio rerio; identical to SEQ ID NO: 37684

SEQ ID NO: 54398 - DNA, 612 bp, Rattus norvegicus; identical to SEQ ID NO: 37685
  CDS (1)..(612)

SEQ ID NO: 54399 - protein, 203 aa, Rattus norvegicus; identical to SEQ ID NO: 37686

SEQ ID NO: 54400 - DNA, 519 bp, Dictyostelium discoideum; identical to SEQ ID NO: 37687
  CDS (1)..(519)

SEQ ID NO: 54401 - protein, 172 aa, Dictyostelium discoideum; identical to SEQ ID NO: 37688

SEQ ID NO: 54402 - DNA, 432 bp, Malawimonas jakobiformis; identical to SEQ ID NO: 37689
  CDS (1)..(432)

SEQ ID NO: 54403 - protein, 143 aa, Malawimonas jakobiformis; identical to SEQ ID NO: 37690

SEQ ID NO: 54404 - DNA, 414 bp, Mycoplasma genitalium G-37; identical to SEQ ID NO: 37691
  CDS (1)..(414)

SEQ ID NO: 54405 - protein, 137 aa, Mycoplasma genitalium G-37; identical to SEQ ID NO: 37692

SEQ ID NO: 54406 - DNA, 468 bp, Arabidopsis thaliana; identical to SEQ ID NO: 37693
  CDS (1)..(468)

SEQ ID NO: 54407 - protein, 155 aa, Arabidopsis thaliana; identical to SEQ ID NO: 37694

SEQ ID NO: 54408 - DNA, 426 bp, Thermotoga maritima MSB8; identical to SEQ ID NO: 37695
  CDS (1)..(426)

SEQ ID NO: 54409 - protein, 141 aa, Thermotoga maritima MSB8; identical to SEQ ID NO: 37696

SEQ ID NO: 54410 - DNA, 492 bp, Halobacterium salinarum NRC-1; identical to SEQ ID NO: 37697
  CDS (1)..(492)

SEQ ID NO: 54411 - protein, 163 aa, Halobacterium salinarum NRC-1; identical to SEQ ID NO: 37698

SEQ ID NO: 54412 - DNA, 654 bp, Mycoplasma pulmonis UAB CTIP; identical to SEQ ID NO: 37699
  CDS (1)..(654)

SEQ ID NO: 54413 - protein, 217 aa, Mycoplasma pulmonis UAB CTIP; identical to SEQ ID NO: 37700

SEQ ID NO: 54414 - DNA, 522 bp, Sulfolobus solfataricus P2; identical to SEQ ID NO: 37701
  CDS (1)..(522)

SEQ ID NO: 54415 - protein, 173 aa, Sulfolobus solfataricus P2; identical to SEQ ID NO: 37702

SEQ ID NO: 54416 - DNA, 426 bp, Bacillus subtilis subsp. subtilis str. 168; identical to SEQ ID NO: 37703
  CDS (1)..(426)

SEQ ID NO: 54417 - protein, 141 aa, Bacillus subtilis subsp. subtilis str. 168; identical to SEQ ID NO: 37704

SEQ ID NO: 54418 - DNA, 459 bp, Thermoplasma acidophilum DSM 1728; identical to SEQ ID NO: 37705
  CDS (1)..(459)

SEQ ID NO: 54419 - protein, 152 aa, Thermoplasma acidophilum DSM 1728; identical to SEQ ID NO: 37706

SEQ ID NO: 54420 - DNA, 435 bp, Schizosaccharomyces pombe; identical to SEQ ID NO: 37707
  CDS (1)..(435)

SEQ ID NO: 54421 - protein, 144 aa, Schizosaccharomyces pombe; identical to SEQ ID NO: 37708

SEQ ID NO: 54422 - DNA, 528 bp, Plasmodium falciparum 3D7; identical to SEQ ID NO: 37709
  CDS (1)..(528)

SEQ ID NO: 54423 - protein, 175 aa, Plasmodium falciparum 3D7; identical to SEQ ID NO: 37710

SEQ ID NO: 54424 - DNA, 546 bp, Homo sapiens; identical to SEQ ID NO: 37711
  CDS (1)..(546)

SEQ ID NO: 54425 - protein, 181 aa, Homo sapiens; identical to SEQ ID NO: 37712

SEQ ID NO: 54426 - DNA, 543 bp, Corynebacterium efficiens YS-314; identical to SEQ ID NO: 37713
  CDS (1)..(543)

SEQ ID NO: 54427 - protein, 180 aa, Corynebacterium efficiens YS-314; identical to SEQ ID NO: 37714

SEQ ID NO: 54428 - DNA, 384 bp, Eimeria tenella; identical to SEQ ID NO: 37715
  CDS (1)..(384)

SEQ ID NO: 54429 - protein, 127 aa, Eimeria tenella; identical to SEQ ID NO: 37716

SEQ ID NO: 54430 - DNA, 468 bp, Oryza sativa (japonica cultivar-group); identical to SEQ ID NO: 37717
  CDS (1)..(468)

SEQ ID NO: 54431 - protein, 155 aa, Oryza sativa (japonica cultivar-group); identical to SEQ ID NO: 37718

SEQ ID NO: 54432 - DNA, 438 bp, Bdellovibrio bacteriovorus HD100; identical to SEQ ID NO: 37719
  CDS (1)..(438)

SEQ ID NO: 54433 - protein, 145 aa, Bdellovibrio bacteriovorus HD100; identical to SEQ ID NO: 37720

SEQ ID NO: 54434 - DNA, 450 bp, Eremothecium gossypii; identical to SEQ ID NO: 37721
  CDS (1)..(450)

SEQ ID NO: 54435 - protein, 149 aa, Eremothecium gossypii; identical to SEQ ID NO: 37722

SEQ ID NO: 54436 - DNA, 477 bp, Neurospora crassa; identical to SEQ ID NO: 37723
  CDS (1)..(477)

SEQ ID NO: 54437 - protein, 158 aa, Neurospora crassa; identical to SEQ ID NO: 37724

SEQ ID NO: 54438 - DNA, 1029 bp, Trypanosoma brucei; identical to SEQ ID NO: 37725
  CDS (1)..(1029)

SEQ ID NO: 54439 - protein, 342 aa, Trypanosoma brucei; identical to SEQ ID NO: 37726

SEQ ID NO: 54440 - DNA, 474 bp, Magnaporthe grisea 70-15; identical to SEQ ID NO: 37727
  CDS (1)..(474)

SEQ ID NO: 54441 - protein, 157 aa, Magnaporthe grisea 70-15; identical to SEQ ID NO: 37728

SEQ ID NO: 54442 - DNA, 471 bp, Gibberella zeae PH-1; identical to SEQ ID NO: 37729
  CDS (1)..(471)

SEQ ID NO: 54443 - protein, 156 aa, Gibberella zeae PH-1; identical to SEQ ID NO: 37730

SEQ ID NO: 54444 - DNA, 462 bp, Aspergillus nidulans FGSC A4; identical to SEQ ID NO: 37731
  CDS (1)..(462)

SEQ ID NO: 54445 - protein, 153 aa, Aspergillus nidulans FGSC A4; identical to SEQ ID NO: 37732

SEQ ID NO: 54446 - DNA, 450 bp, Candida glabrata CBS138; identical to SEQ ID NO: 37733
  CDS (1)..(450)

SEQ ID NO: 54447 - protein, 149 aa, Candida glabrata CBS138; identical to SEQ ID NO: 37734

SEQ ID NO: 54448 - DNA, 450 bp, Kluyveromyces lactis NRRL Y-1140; identical to SEQ ID NO: 37735
  CDS (1)..(450)

SEQ ID NO: 54449 - protein, 149 aa, Kluyveromyces lactis NRRL Y-1140; identical to SEQ ID NO: 37736

SEQ ID NO: 54450 - DNA, 432 bp, Debaryomyces hansenii CBS767; identical to SEQ ID NO: 37737
  CDS (1)..(432)

SEQ ID NO: 54451 - protein, 143 aa, Debaryomyces hansenii CBS767; identical to SEQ ID NO: 37738

SEQ ID NO: 54452 - DNA, 666 bp, Oryza sativa (japonica cultivar-group); identical to SEQ ID NO: 37739
  CDS (1)..(666)

SEQ ID NO: 54453 - protein, 221 aa, Oryza sativa (japonica cultivar-group); identical to SEQ ID NO: 37740

SEQ ID NO: 54454 - DNA, 459 bp, Yarrowia lipolytica CLIB99; identical to SEQ ID NO: 37741
  CDS (1)..(459)

SEQ ID NO: 54455 - protein, 152 aa, Yarrowia lipolytica CLIB99; identical to SEQ ID NO: 37742

SEQ ID NO: 54456 - DNA, 426 bp, Gracilaria tenuistipitata var. liui; identical to SEQ ID NO: 37743
  CDS (1)..(426)

SEQ ID NO: 54457 - protein, 141 aa, Gracilaria tenuistipitata var. liui; identical to SEQ ID NO: 37744

SEQ ID NO: 54458 - DNA, 405 bp, Bacillus cereus ZK; identical to SEQ ID NO: 37745
  CDS (1)..(405)

SEQ ID NO: 54459 - protein, 134 aa, Bacillus cereus ZK; identical to SEQ ID NO: 37746

SEQ ID NO: 54460 - DNA, 426 bp, Bacillus licheniformis ATCC 14580; identical to SEQ ID NO: 37747
  CDS (1)..(426)

SEQ ID NO: 54461 - protein, 141 aa, Bacillus licheniformis ATCC 14580; identical to SEQ ID NO: 37748

SEQ ID NO: 54462 - DNA, 435 bp, Legionella pneumophila subsp. pneumophila str. Philadelphia 1; identical to SEQ ID NO: 37749
  CDS (1)..(435)

SEQ ID NO: 54463 - protein, 144 aa, Legionella pneumophila subsp. pneumophila str. Philadelphia 1; identical to SEQ ID NO: 37750

SEQ ID NO: 54464 - DNA, 432 bp, Methylococcus capsulatus str. Bath; identical to SEQ ID NO: 37751
  CDS (1)..(432)

SEQ ID NO: 54465 - protein, 143 aa, Methylococcus capsulatus str. Bath; identical to SEQ ID NO: 37752

SEQ ID NO: 54466 - DNA, 450 bp, Mycoplasma hyopneumoniae 232; identical to SEQ ID NO: 37753
  CDS (1)..(450)

SEQ ID NO: 54467 - protein, 149 aa, Mycoplasma hyopneumoniae 232; identical to SEQ ID NO: 37754

SEQ ID NO: 54468 - DNA, 435 bp, Nocardia farcinica IFM 10152; identical to SEQ ID NO: 37755
  CDS (1)..(435)

SEQ ID NO: 54469 - protein, 144 aa, Nocardia farcinica IFM 10152; identical to SEQ ID NO: 37756

SEQ ID NO: 54470 - DNA, 489 bp, Haloarcula marismortui ATCC 43049; identical to SEQ ID NO: 37757
  CDS (1)..(489)

SEQ ID NO: 54471 - protein, 162 aa, Haloarcula marismortui ATCC 43049; identical to SEQ ID NO: 37758

SEQ ID NO: 54472 - DNA, 426 bp, Geobacillus kaustophilus HTA426; identical to SEQ ID NO: 37759
  CDS (1)..(426)

SEQ ID NO: 54473 - protein, 141 aa, Geobacillus kaustophilus HTA426; identical to SEQ ID NO: 37760

SEQ ID NO: 54474 - DNA, 444 bp, Anaplasma marginale str. St. Maries; identical to SEQ ID NO: 37761
  CDS (1)..(444)

SEQ ID NO: 54475 - protein, 147 aa, Anaplasma marginale str. St. Maries; identical to SEQ ID NO: 37762

SEQ ID NO: 54476 - DNA, 429 bp, Idiomarina loihiensis L2TR; identical to SEQ ID NO: 37763
  CDS (1)..(429)

SEQ ID NO: 54477 - protein, 142 aa, Idiomarina loihiensis L2TR; identical to SEQ ID NO: 37764

SEQ ID NO: 54478 - DNA, 432 bp, Azoarcus sp. EbN1; identical to SEQ ID NO: 37765
  CDS (1)..(432)

SEQ ID NO: 54479 - protein, 143 aa, Azoarcus sp. EbN1; identical to SEQ ID NO: 37766

SEQ ID NO: 54480 - DNA, 432 bp, Zymomonas mobilis subsp. mobilis ZM4; identical to SEQ ID NO: 37767
  CDS (1)..(432)

SEQ ID NO: 54481 - protein, 143 aa, Zymomonas mobilis subsp. mobilis ZM4; identical to SEQ ID NO: 37768

SEQ ID NO: 54482 - DNA, 426 bp, Silicibacter pomeroyi DSS-3; identical to SEQ ID NO: 37769
  CDS (1)..(426)

SEQ ID NO: 54483 - protein, 141 aa, Silicibacter pomeroyi DSS-3; identical to SEQ ID NO: 37770

SEQ ID NO: 54484 - DNA, 435 bp, Francisella tularensis subsp. tularensis Schu 4; identical to SEQ ID NO: 37771
  CDS (1)..(435)

SEQ ID NO: 54485 - protein, 144 aa, Francisella tularensis subsp. tularensis Schu 4; identical to SEQ ID NO: 37772

SEQ ID NO: 54486 - DNA, 426 bp, Synechococcus elongatus PCC 6301; identical to SEQ ID NO: 37773
  CDS (1)..(426)

SEQ ID NO: 54487 - protein, 141 aa, Synechococcus elongatus PCC 6301; identical to SEQ ID NO: 37774

SEQ ID NO: 54488 - DNA, 426 bp, Bacillus clausii KSM-K16; identical to SEQ ID NO: 37775
  CDS (1)..(426)

SEQ ID NO: 54489 - protein, 141 aa, Bacillus clausii KSM-K16; identical to SEQ ID NO: 37776

SEQ ID NO: 54490 - DNA, 444 bp, Ehrlichia ruminantium str. Welgevonden; identical to SEQ ID NO: 37777
  CDS (1)..(444)

SEQ ID NO: 54491 - protein, 147 aa, Ehrlichia ruminantium str. Welgevonden; identical to SEQ ID NO: 37778

SEQ ID NO: 54492 - DNA, 423 bp, Dehalococcoides ethenogenes 195; identical to SEQ ID NO: 37779
  CDS (1)..(423)

SEQ ID NO: 54493 - protein, 140 aa, Dehalococcoides ethenogenes 195; identical to SEQ ID NO: 37780

SEQ ID NO: 54494 - DNA, 453 bp, Rhodobacter sphaeroides 2.4.1; identical to SEQ ID NO: 37781
  CDS (1)..(453)

SEQ ID NO: 54495 - protein, 150 aa, Rhodobacter sphaeroides 2.4.1; identical to SEQ ID NO: 37782

SEQ ID NO: 54496 - DNA, 426 bp, Lactobacillus gasseri; identical to SEQ ID NO: 37783
  CDS (1)..(426)

SEQ ID NO: 54497 - protein, 141 aa, Lactobacillus gasseri; identical to SEQ ID NO: 37784

SEQ ID NO: 54498 - DNA, 432 bp, Azotobacter vinelandii; identical to SEQ ID NO: 37785
  CDS (1)..(432)

SEQ ID NO: 54499 - protein, 143 aa, Azotobacter vinelandii; identical to SEQ ID NO: 37786

SEQ ID NO: 54500 - DNA, 447 bp, Desulfovibrio desulfuricans G20; identical to SEQ ID NO: 37787
  CDS (1)..(447)

SEQ ID NO: 54501 - protein, 148 aa, Desulfovibrio desulfuricans G20; identical to SEQ ID NO: 37788

SEQ ID NO: 54502 - DNA, 426 bp, Fusobacterium nucleatum subsp. vincentii ATCC 49256; identical to SEQ ID NO: 37789
  CDS (1)..(426)

SEQ ID NO: 54503 - protein, 141 aa, Fusobacterium nucleatum subsp. vincentii ATCC 49256; identical to SEQ ID NO: 37790

SEQ ID NO: 54504 - DNA, 486 bp, Methanococcoides burtonii DSM 6242; identical to SEQ ID NO: 37791
  CDS (1)..(486)

SEQ ID NO: 54505 - protein, 161 aa, Methanococcoides burtonii DSM 6242; identical to SEQ ID NO: 37792

SEQ ID NO: 54506 - DNA, 432 bp, Dechloromonas aromatica RCB; identical to SEQ ID NO: 37793
  CDS (1)..(432)

SEQ ID NO: 54507 - protein, 143 aa, Dechloromonas aromatica RCB; identical to SEQ ID NO: 37794

SEQ ID NO: 54508 - DNA, 429 bp, Haemophilus influenzae R2866; identical to SEQ ID NO: 37795
  CDS (1)..(429)

SEQ ID NO: 54509 - protein, 142 aa, Haemophilus influenzae R2866; identical to SEQ ID NO: 37796

SEQ ID NO: 54510 - DNA, 426 bp, Synechococcus elongatus PCC 7942; identical to SEQ ID NO: 37797
  CDS (1)..(426)

SEQ ID NO: 54511 - protein, 141 aa, Synechococcus elongatus PCC 7942; identical to SEQ ID NO: 37798

SEQ ID NO: 54512 - DNA, 327 bp, Methylobacillus flagellatus KT; identical to SEQ ID NO: 37799
  CDS (1)..(327)

SEQ ID NO: 54513 - protein, 108 aa, Methylobacillus flagellatus KT; identical to SEQ ID NO: 37800

SEQ ID NO: 54514 - DNA, 429 bp, Mesorhizobium sp. BNC1; identical to SEQ ID NO: 37801
  CDS (1)..(429)

SEQ ID NO: 54515 - protein, 142 aa, Mesorhizobium sp. BNC1; identical to SEQ ID NO: 37802

SEQ ID NO: 54516 - DNA, 438 bp, Rubrobacter xylanophilus DSM 9941; identical to SEQ ID NO: 37803
  CDS (1)..(438)

SEQ ID NO: 54517 - protein, 145 aa, Rubrobacter xylanophilus DSM 9941; identical to SEQ ID NO: 37804

SEQ ID NO: 54518 - DNA, 432 bp, Psychrobacter sp. 273-4; identical to SEQ ID NO: 37805
  CDS (1)..(432)

SEQ ID NO: 54519 - protein, 143 aa, Psychrobacter sp. 273-4; identical to SEQ ID NO: 37806

SEQ ID NO: 54520 - DNA, 432 bp, Rubrivivax gelatinosus PM1; identical to SEQ ID NO: 37807
  CDS (1)..(432)

SEQ ID NO: 54521 - protein, 143 aa, Rubrivivax gelatinosus PM1; identical to SEQ ID NO: 37808

SEQ ID NO: 54522 - DNA, 429 bp, Rhodospirillum rubrum; identical to SEQ ID NO: 37809
  CDS (1)..(429)

SEQ ID NO: 54523 - protein, 142 aa, Rhodospirillum rubrum; identical to SEQ ID NO: 37810

SEQ ID NO: 54524 - DNA, 432 bp, Ralstonia metallidurans CH34; identical to SEQ ID NO: 37811
  CDS (1)..(432)

SEQ ID NO: 54525 - protein, 143 aa, Ralstonia metallidurans CH34; identical to SEQ ID NO: 37812

SEQ ID NO: 54526 - DNA, 429 bp, Magnetococcus sp. MC-1; identical to SEQ ID NO: 37813
  CDS (1)..(429)

SEQ ID NO: 54527 - protein, 142 aa, Magnetococcus sp. MC-1; identical to SEQ ID NO: 37814

SEQ ID NO: 54528 - DNA, 486 bp, Methanosarcina barkeri str. fusaro; identical to SEQ ID NO: 37815
  CDS (1)..(486)

SEQ ID NO: 54529 - protein, 161 aa, Methanosarcina barkeri str. fusaro; identical to SEQ ID NO: 37816

SEQ ID NO: 54530 - DNA, 423 bp, Geobacter metallireducens GS-15; identical to SEQ ID NO: 37817
  CDS (1)..(423)

SEQ ID NO: 54531 - protein, 140 aa, Geobacter metallireducens GS-15; identical to SEQ ID NO: 37818

SEQ ID NO: 54532 - DNA, 432 bp, Novosphingobium aromaticivorans DSM 12444; identical to SEQ ID NO: 37819
  CDS (1)..(432)

SEQ ID NO: 54533 - protein, 143 aa, Novosphingobium aromaticivorans DSM 12444; identical to SEQ ID NO: 37820

SEQ ID NO: 54534 - DNA, 477 bp, Ferroplasma acidarmanus; identical to SEQ ID NO: 37821
  CDS (1)..(477)

SEQ ID NO: 54535 - protein, 158 aa, Ferroplasma acidarmanus; identical to SEQ ID NO: 37822

SEQ ID NO: 54536 - DNA, 444 bp, Cytophaga hutchinsonii; identical to SEQ ID NO: 37823
  CDS (1)..(444)

SEQ ID NO: 54537 - protein, 147 aa, Cytophaga hutchinsonii; identical to SEQ ID NO: 37824

SEQ ID NO: 54538 - DNA, 426 bp, Clostridium thermocellum ATCC 27405; identical to SEQ ID NO: 37825
  CDS (1)..(426)

SEQ ID NO: 54539 - protein, 141 aa, Clostridium thermocellum ATCC 27405; identical to SEQ ID NO: 37826

SEQ ID NO: 54540 - DNA, 432 bp, Microbulbifer degradans 2-40; identical to SEQ ID NO: 37827
  CDS (1)..(432)

SEQ ID NO: 54541 - protein, 143 aa, Microbulbifer degradans 2-40; identical to SEQ ID NO: 37828

SEQ ID NO: 54542 - DNA, 609 bp, Oenococcus oeni PSU-1; identical to SEQ ID NO: 37829
  CDS (1)..(609)

SEQ ID NO: 54543 - protein, 202 aa, Oenococcus oeni PSU-1; identical to SEQ ID NO: 37830

SEQ ID NO: 54544 - DNA, 426 bp, Trichodesmium erythraeum IMS101; identical to SEQ ID NO: 37831
  CDS (1)..(426)

SEQ ID NO: 54545 - protein, 141 aa, Trichodesmium erythraeum IMS101; identical to SEQ ID NO: 37832

SEQ ID NO: 54546 - DNA, 426 bp, Moorella thermoacetica ATCC 39073; identical to SEQ ID NO: 37833
  CDS (1)..(426)

SEQ ID NO: 54547 - protein, 141 aa, Moorella thermoacetica ATCC 39073; identical to SEQ ID NO: 37834

SEQ ID NO: 54548 - DNA, 426 bp, Streptococcus suis 89/1591; identical to SEQ ID NO: 37835
  CDS (1)..(426)

SEQ ID NO: 54549 - protein, 141 aa, Streptococcus suis 89/1591; identical to SEQ ID NO: 37836

SEQ ID NO: 54550 - DNA, 432 bp, Thiobacillus denitrificans ATCC 25259; identical to SEQ ID NO: 37837
  CDS (1)..(432)

SEQ ID NO: 54551 - protein, 143 aa, Thiobacillus denitrificans ATCC 25259; identical to SEQ ID NO: 37838

SEQ ID NO: 54552 - DNA, 402 bp, Silicibacter sp. TM1040; identical to SEQ ID NO: 37839
  CDS (1)..(402)

SEQ ID NO: 54553 - protein, 133 aa, Silicibacter sp. TM1040; identical to SEQ ID NO: 37840

SEQ ID NO: 54554 - DNA, 438 bp, Rickettsia akari str. Hartford; identical to SEQ ID NO: 37841
  CDS (1)..(438)

SEQ ID NO: 54555 - protein, 145 aa, Rickettsia akari str. Hartford; identical to SEQ ID NO: 37842

SEQ ID NO: 54556 - DNA, 426 bp, Nostoc punctiforme PCC 73102; identical to SEQ ID NO: 37843
  CDS (1)..(426)

SEQ ID NO: 54557 - protein, 141 aa, Nostoc punctiforme PCC 73102; identical to SEQ ID NO: 37844

SEQ ID NO: 54558 - DNA, 456 bp, Polaromonas sp. JS666; identical to SEQ ID NO: 37845
  CDS (1)..(456)

SEQ ID NO: 54559 - protein, 151 aa, Polaromonas sp. JS666; identical to SEQ ID NO: 37846

SEQ ID NO: 54560 - DNA, 426 bp, Campylobacter lari RM2100; identical to SEQ ID NO: 37847
  CDS (1)..(426)

SEQ ID NO: 54561 - protein, 141 aa, Campylobacter lari RM2100; identical to SEQ ID NO: 37848

SEQ ID NO: 54562 - DNA, 579 bp, Xenopus laevis; identical to SEQ ID NO: 37849
  CDS (1)..(579)

SEQ ID NO: 54563 - protein, 192 aa, Xenopus laevis; identical to SEQ ID NO: 37850

SEQ ID NO: 54564 - DNA, 429 bp, uncultured marine gamma proteobacterium EBAC20E09; identical to SEQ ID NO: 37851
  CDS (1)..(429)

SEQ ID NO: 54565 - protein, 142 aa, uncultured marine gamma proteobacterium EBAC20E09; identical to SEQ ID NO: 37852

SEQ ID NO: 54566 - DNA, 429 bp, uncultured bacterium 562; identical to SEQ ID NO: 37853
  CDS (1)..(429)

SEQ ID NO: 54567 - protein, 142 aa, uncultured bacterium 562; identical to SEQ ID NO: 37854

SEQ ID NO: 54568 - DNA, 429 bp, uncultured marine alpha proteobacterium HOT2C01; identical to SEQ ID NO: 37855
  CDS (1)..(429)

SEQ ID NO: 54569 - protein, 142 aa, uncultured marine alpha proteobacterium HOT2C01; identical to SEQ ID NO: 37856

SEQ ID NO: 54570 - DNA, 708 bp, Chlorarachnion sp; identical to SEQ ID NO: 37857
  CDS (1)..(708)

SEQ ID NO: 54571 - protein, 235 aa, Chlorarachnion sp; identical to SEQ ID NO: 37858

SEQ ID NO: 54572 - DNA, 474 bp, Schistosoma japonicum; identical to SEQ ID NO: 37859
  CDS (1)..(474)

SEQ ID NO: 54573 - protein, 157 aa, Schistosoma japonicum; identical to SEQ ID NO: 37860

SEQ ID NO: 54574 - DNA, 558 bp, Echinococcus multilocularis; identical to SEQ ID NO: 37861
  CDS (1)..(558)

SEQ ID NO: 54575 - protein, 185 aa, Echinococcus multilocularis; identical to SEQ ID NO: 37862

SEQ ID NO: 54576 - DNA, 417 bp, Candidatus Tremblaya princeps; identical to SEQ ID NO: 37863
  CDS (1)..(417)

SEQ ID NO: 54577 - protein, 138 aa, Candidatus Tremblaya princeps; identical to SEQ ID NO: 37864

SEQ ID NO: 54578 - DNA, 465 bp, Triticum aestivum; identical to SEQ ID NO: 37865
  CDS (1)..(465)

SEQ ID NO: 54579 - protein, 154 aa, Triticum aestivum; identical to SEQ ID NO: 37866

SEQ ID NO: 54580 - DNA, 423 bp, Staphylococcus aureus; identical to SEQ ID NO: 37867
  CDS (1)..(423)

SEQ ID NO: 54581 - protein, 140 aa, Staphylococcus aureus; identical to SEQ ID NO: 37868

SEQ ID NO: 54582 - DNA, 429 bp, Carsonella ruddii; identical to SEQ ID NO: 37869
  CDS (1)..(429)

SEQ ID NO: 54583 - protein, 142 aa, Carsonella ruddii; identical to SEQ ID NO: 37870

SEQ ID NO: 54584 - DNA, 633 bp, Oryza sativa; identical to SEQ ID NO: 37871
  CDS (1)..(633)

SEQ ID NO: 54585 - protein, 210 aa, Oryza sativa; identical to SEQ ID NO: 37872

SEQ ID NO: 54586 - DNA, 669 bp, Arabidopsis thaliana; identical to SEQ ID NO: 37873
  CDS (1)..(669)

SEQ ID NO: 54587 - protein, 222 aa, Arabidopsis thaliana; identical to SEQ ID NO: 37874

SEQ ID NO: 54588 - DNA, 669 bp, Arabidopsis thaliana; identical to SEQ ID NO: 37875
  CDS (1)..(669)

SEQ ID NO: 54589 - protein, 222 aa, Arabidopsis thaliana; identical to SEQ ID NO: 37876

SEQ ID NO: 54590 - DNA, 426 bp, Cyanidium caldarium; identical to SEQ ID NO: 37877
  CDS (1)..(426)

SEQ ID NO: 54591 - protein, 141 aa, Cyanidium caldarium; identical to SEQ ID NO: 37878

SEQ ID NO: 54592 - DNA, 417 bp, Cyanidioschyzon merolae; identical to SEQ ID NO: 37879
  CDS (1)..(417)

SEQ ID NO: 54593 - protein, 138 aa, Cyanidioschyzon merolae; identical to SEQ ID NO: 37880

SEQ ID NO: 54594 - DNA, 426 bp, Cyanophora paradoxa; identical to SEQ ID NO: 37881
  CDS (1)..(426)

SEQ ID NO: 54595 - protein, 141 aa, Cyanophora paradoxa; identical to SEQ ID NO: 37882

SEQ ID NO: 54596 - DNA, 426 bp, Guillardia theta; identical to SEQ ID NO: 37883
  CDS (1)..(426)

SEQ ID NO: 54597 - protein, 141 aa, Guillardia theta; identical to SEQ ID NO: 37884

SEQ ID NO: 54598 - DNA, 426 bp, Odontella sinensis; identical to SEQ ID NO: 37885
  CDS (1)..(426)

SEQ ID NO: 54599 - protein, 141 aa, Odontella sinensis; identical to SEQ ID NO: 37886

SEQ ID NO: 54600 - DNA, 426 bp, Porphyra purpurea; identical to SEQ ID NO: 37887
  CDS (1)..(426)

SEQ ID NO: 54601 - protein, 141 aa, Porphyra purpurea; identical to SEQ ID NO: 37888

SEQ ID NO: 54602 - DNA, 675 bp, Spinacia oleracea; identical to SEQ ID NO: 37889
  CDS (1)..(675)

SEQ ID NO: 54603 - protein, 224 aa, Spinacia oleracea; identical to SEQ ID NO: 37890

SEQ ID NO: 54604 - DNA, 429 bp, Acinetobacter sp; identical to SEQ ID NO: 37891
  CDS (1)..(429)

SEQ ID NO: 54605 - protein, 142 aa, Acinetobacter sp; identical to SEQ ID NO: 37892

SEQ ID NO: 54606 - DNA, 432 bp, Agrobacterium tumefaciens; identical to SEQ ID NO: 37893
  CDS (1)..(432)

SEQ ID NO: 54607 - protein, 143 aa, Agrobacterium tumefaciens; identical to SEQ ID NO: 37894

SEQ ID NO: 54608 - DNA, 426 bp, Anabaena sp; identical to SEQ ID NO: 37895
  CDS (1)..(426)

SEQ ID NO: 54609 - protein, 141 aa, Anabaena sp; identical to SEQ ID NO: 37896

SEQ ID NO: 54610 - DNA, 438 bp, Aquifex aeolicus; identical to SEQ ID NO: 37897
  CDS (1)..(438)

SEQ ID NO: 54611 - protein, 145 aa, Aquifex aeolicus; identical to SEQ ID NO: 37898

SEQ ID NO: 54612 - DNA, 474 bp, Archaeoglobus fulgidus; identical to SEQ ID NO: 37899
  CDS (1)..(474)

SEQ ID NO: 54613 - protein, 157 aa, Archaeoglobus fulgidus; identical to SEQ ID NO: 37900

SEQ ID NO: 54614 - DNA, 444 bp, Bacteroides fragilis; identical to SEQ ID NO: 37901
  CDS (1)..(444)

SEQ ID NO: 54615 - protein, 147 aa, Bacteroides fragilis; identical to SEQ ID NO: 37902

SEQ ID NO: 54616 - DNA, 429 bp, Bartonella henselae; identical to SEQ ID NO: 37903
  CDS (1)..(429)

SEQ ID NO: 54617 - protein, 142 aa, Bartonella henselae; identical to SEQ ID NO: 37904

SEQ ID NO: 54618 - DNA, 429 bp, Bartonella quintana; identical to SEQ ID NO: 37905
  CDS (1)..(429)

SEQ ID NO: 54619 - protein, 142 aa, Bartonella quintana; identical to SEQ ID NO: 37906

SEQ ID NO: 54620 - DNA, 432 bp, Bifidobacterium longum; identical to SEQ ID NO: 37907
  CDS (1)..(432)

SEQ ID NO: 54621 - protein, 143 aa, Bifidobacterium longum; identical to SEQ ID NO: 37908

SEQ ID NO: 54622 - DNA, 432 bp, Bordetella bronchiseptica; identical to SEQ ID NO: 37909
  CDS (1)..(432)

SEQ ID NO: 54623 - protein, 143 aa, Bordetella bronchiseptica; identical to SEQ ID NO: 37910

SEQ ID NO: 54624 - DNA, 429 bp, Bradyrhizobium japonicum; identical to SEQ ID NO: 37911
  CDS (1)..(429)

SEQ ID NO: 54625 - protein, 142 aa, Bradyrhizobium japonicum; identical to SEQ ID NO: 37912

SEQ ID NO: 54626 - DNA, 429 bp, Brucella melitensis; identical to SEQ ID NO: 37913
  CDS (1)..(429)

SEQ ID NO: 54627 - protein, 142 aa, Brucella melitensis; identical to SEQ ID NO: 37914

SEQ ID NO: 54628 - DNA, 429 bp, Buchnera aphidicola; identical to SEQ ID NO: 37915
  CDS (1)..(429)

SEQ ID NO: 54629 - protein, 142 aa, Buchnera aphidicola; identical to SEQ ID NO: 37916

SEQ ID NO: 54630 - DNA, 441 bp, Buchnera aphidicola; identical to SEQ ID NO: 37917
  CDS (1)..(441)

SEQ ID NO: 54631 - protein, 146 aa, Buchnera aphidicola; identical to SEQ ID NO: 37918

SEQ ID NO: 54632 - DNA, 432 bp, Burkholderia mallei; identical to SEQ ID NO: 37919
  CDS (1)..(432)

SEQ ID NO: 54633 - protein, 143 aa, Burkholderia mallei; identical to SEQ ID NO: 37920

SEQ ID NO: 54634 - DNA, 426 bp, Campylobacter jejuni; identical to SEQ ID NO: 37921
  CDS (1)..(426)

SEQ ID NO: 54635 - protein, 141 aa, Campylobacter jejuni; identical to SEQ ID NO: 37922

SEQ ID NO: 54636 - DNA, 441 bp, Candidatus Blochmannia floridanus; identical to SEQ ID NO: 37923
  CDS (1)..(441)

SEQ ID NO: 54637 - protein, 146 aa, Candidatus Blochmannia floridanus; identical to SEQ ID NO: 37924

SEQ ID NO: 54638 - DNA, 432 bp, Caulobacter crescentus; identical to SEQ ID NO: 37925
  CDS (1)..(432)

SEQ ID NO: 54639 - protein, 143 aa, Caulobacter crescentus; identical to SEQ ID NO: 37926

SEQ ID NO: 54640 - DNA, 426 bp, Chlamydophila caviae; identical to SEQ ID NO: 37927
  CDS (1)..(426)

SEQ ID NO: 54641 - protein, 141 aa, Chlamydophila caviae; identical to SEQ ID NO: 37928

SEQ ID NO: 54642 - DNA, 426 bp, Chlamydia muridarum; identical to SEQ ID NO: 37929
  CDS (1)..(426)

SEQ ID NO: 54643 - protein, 141 aa, Chlamydia muridarum; identical to SEQ ID NO: 37930

SEQ ID NO: 54644 - DNA, 426 bp, Chlamydia pneumoniae; identical to SEQ ID NO: 37931
  CDS (1)..(426)

SEQ ID NO: 54645 - protein, 141 aa, Chlamydia pneumoniae; identical to SEQ ID NO: 37932

SEQ ID NO: 54646 - DNA, 426 bp, Chlorobium tepidum; identical to SEQ ID NO: 37933
  CDS (1)..(426)

SEQ ID NO: 54647 - protein, 141 aa, Chlorobium tepidum; identical to SEQ ID NO: 37934

SEQ ID NO: 54648 - DNA, 432 bp, Chromobacterium violaceum; identical to SEQ ID NO: 37935
  CDS (1)..(432)

SEQ ID NO: 54649 - protein, 143 aa, Chromobacterium violaceum; identical to SEQ ID NO: 37936

SEQ ID NO: 54650 - DNA, 426 bp, Clostridium acetobutylicum; identical to SEQ ID NO: 37937
  CDS (1)..(426)

SEQ ID NO: 54651 - protein, 141 aa, Clostridium acetobutylicum; identical to SEQ ID NO: 37938

SEQ ID NO: 54652 - DNA, 426 bp, Clostridium perfringens; identical to SEQ ID NO: 37939
  CDS (1)..(426)

SEQ ID NO: 54653 - protein, 141 aa, Clostridium perfringens; identical to SEQ ID NO: 37940

SEQ ID NO: 54654 - DNA, 426 bp, Clostridium tetani; identical to SEQ ID NO: 37941
  CDS (1)..(426)

SEQ ID NO: 54655 - protein, 141 aa, Clostridium tetani; identical to SEQ ID NO: 37942

SEQ ID NO: 54656 - DNA, 429 bp, Corynebacterium diphtheriae; identical to SEQ ID NO: 37943
  CDS (1)..(429)

SEQ ID NO: 54657 - protein, 142 aa, Corynebacterium diphtheriae; identical to SEQ ID NO: 37944

SEQ ID NO: 54658 - DNA, 438 bp, Corynebacterium glutamicum; identical to SEQ ID NO: 37945
  CDS (1)..(438)

SEQ ID NO: 54659 - protein, 145 aa, Corynebacterium glutamicum; identical to SEQ ID NO: 37946

SEQ ID NO: 54660 - DNA, 438 bp, Coxiella burnetii; identical to SEQ ID NO: 37947
  CDS (1)..(438)

SEQ ID NO: 54661 - protein, 145 aa, Coxiella burnetii; identical to SEQ ID NO: 37948

SEQ ID NO: 54662 - DNA, 435 bp, Deinococcus radiodurans; identical to SEQ ID NO: 37949
  CDS (1)..(435)

SEQ ID NO: 54663 - protein, 144 aa, Deinococcus radiodurans; identical to SEQ ID NO: 37950

SEQ ID NO: 54664 - DNA, 426 bp, Desulfotalea psychrophila; identical to SEQ ID NO: 37951
  CDS (1)..(426)

SEQ ID NO: 54665 - protein, 141 aa, Desulfotalea psychrophila; identical to SEQ ID NO: 37952

SEQ ID NO: 54666 - DNA, 423 bp, Enterococcus faecalis; identical to SEQ ID NO: 37953
  CDS (1)..(423)

SEQ ID NO: 54667 - protein, 140 aa, Enterococcus faecalis; identical to SEQ ID NO: 37954

SEQ ID NO: 54668 - DNA, 429 bp, Erwinia carotovora; identical to SEQ ID NO: 37955
  CDS (1)..(429)

SEQ ID NO: 54669 - protein, 142 aa, Erwinia carotovora; identical to SEQ ID NO: 37956

SEQ ID NO: 54670 - DNA, 426 bp, Fusobacterium nucleatum; identical to SEQ ID NO: 37957
  CDS (1)..(426)

SEQ ID NO: 54671 - protein, 141 aa, Fusobacterium nucleatum; identical to SEQ ID NO: 37958

SEQ ID NO: 54672 - DNA, 426 bp, Geobacter sulfurreducens; identical to SEQ ID NO: 37959
  CDS (1)..(426)

SEQ ID NO: 54673 - protein, 141 aa, Geobacter sulfurreducens; identical to SEQ ID NO: 37960

SEQ ID NO: 54674 - DNA, 426 bp, Gloeobacter violaceus; identical to SEQ ID NO: 37961
  CDS (1)..(426)

SEQ ID NO: 54675 - protein, 141 aa, Gloeobacter violaceus; identical to SEQ ID NO: 37962

SEQ ID NO: 54676 - DNA, 480 bp, Halobacterium volcanii; identical to SEQ ID NO: 37963
  CDS (1)..(480)

SEQ ID NO: 54677 - protein, 159 aa, Halobacterium volcanii; identical to SEQ ID NO: 37964

SEQ ID NO: 54678 - DNA, 426 bp, Helicobacter pylori J99; identical to SEQ ID NO: 37965
  CDS (1)..(426)

SEQ ID NO: 54679 - protein, 141 aa, Helicobacter pylori J99; identical to SEQ ID NO: 37966

SEQ ID NO: 54680 - DNA, 426 bp, Lactobacillus johnsonii; identical to SEQ ID NO: 37967
  CDS (1)..(426)

SEQ ID NO: 54681 - protein, 141 aa, Lactobacillus johnsonii; identical to SEQ ID NO: 37968

SEQ ID NO: 54682 - DNA, 432 bp, Leifsonia xyli; identical to SEQ ID NO: 37969
  CDS (1)..(432)

SEQ ID NO: 54683 - protein, 143 aa, Leifsonia xyli; identical to SEQ ID NO: 37970

SEQ ID NO: 54684 - DNA, 429 bp, Leptospira interrogans; identical to SEQ ID NO: 37971
  CDS (1)..(429)

SEQ ID NO: 54685 - protein, 142 aa, Leptospira interrogans; identical to SEQ ID NO: 37972

SEQ ID NO: 54686 - DNA, 429 bp, Liberibacter asiaticus; identical to SEQ ID NO: 37973
  CDS (1)..(429)

SEQ ID NO: 54687 - protein, 142 aa, Liberibacter asiaticus; identical to SEQ ID NO: 37974

SEQ ID NO: 54688 - DNA, 426 bp, Listeria innocua; identical to SEQ ID NO: 37975
  CDS (1)..(426)

SEQ ID NO: 54689 - protein, 141 aa, Listeria innocua; identical to SEQ ID NO: 37976

SEQ ID NO: 54690 - DNA, 429 bp, Mannheimia succiniciproducens; identical to SEQ ID NO: 37977
  CDS (1)..(429)

SEQ ID NO: 54691 - protein, 142 aa, Mannheimia succiniciproducens; identical to SEQ ID NO: 37978

SEQ ID NO: 54692 - DNA, 429 bp, Mesoplasma florum; identical to SEQ ID NO: 37979
  CDS (1)..(429)

SEQ ID NO: 54693 - protein, 142 aa, Mesoplasma florum; identical to SEQ ID NO: 37980

SEQ ID NO: 54694 - DNA, 486 bp, Methanosarcina acetivorans; identical to SEQ ID NO: 37981
  CDS (1)..(486)

SEQ ID NO: 54695 - protein, 161 aa, Methanosarcina acetivorans; identical to SEQ ID NO: 37982

SEQ ID NO: 54696 - DNA, 486 bp, Methanococcus jannaschii; identical to SEQ ID NO: 37983
  CDS (1)..(486)

SEQ ID NO: 54697 - protein, 161 aa, Methanococcus jannaschii; identical to SEQ ID NO: 37984

SEQ ID NO: 54698 - DNA, 501 bp, Methanopyrus kandleri; identical to SEQ ID NO: 37985
  CDS (1)..(501)

SEQ ID NO: 54699 - protein, 166 aa, Methanopyrus kandleri; identical to SEQ ID NO: 37986

SEQ ID NO: 54700 - DNA, 486 bp, Methanosarcina mazei; identical to SEQ ID NO: 37987
  CDS (1)..(486)

SEQ ID NO: 54701 - protein, 161 aa, Methanosarcina mazei; identical to SEQ ID NO: 37988

SEQ ID NO: 54702 - DNA, 483 bp, Methanobacterium thermoautotrophicum; identical to SEQ ID NO: 37989
  CDS (1)..(483)

SEQ ID NO: 54703 - protein, 160 aa, Methanobacterium thermoautotrophicum; identical to SEQ ID NO: 37990

SEQ ID NO: 54704 - DNA, 459 bp, Mycoplasma gallisepticum; identical to SEQ ID NO: 37991
  CDS (1)..(459)

SEQ ID NO: 54705 - protein, 152 aa, Mycoplasma gallisepticum; identical to SEQ ID NO: 37992

SEQ ID NO: 54706 - DNA, 429 bp, Mycobacterium leprae; identical to SEQ ID NO: 37993
  CDS (1)..(429)

SEQ ID NO: 54707 - protein, 142 aa, Mycobacterium leprae; identical to SEQ ID NO: 37994

SEQ ID NO: 54708 - DNA, 429 bp, Mycobacterium paratuberculosis; identical to SEQ ID NO: 37995
  CDS (1)..(429)

SEQ ID NO: 54709 - protein, 142 aa, Mycobacterium paratuberculosis; identical to SEQ ID NO: 37996

SEQ ID NO: 54710 - DNA, 483 bp, Nanoarchaeum equitans; identical to SEQ ID NO: 37997
  CDS (1)..(483)

SEQ ID NO: 54711 - protein, 160 aa, Nanoarchaeum equitans; identical to SEQ ID NO: 37998

SEQ ID NO: 54712 - DNA, 435 bp, Neisseria meningitidis; identical to SEQ ID NO: 37999
  CDS (1)..(435)

SEQ ID NO: 54713 - protein, 144 aa, Neisseria meningitidis; identical to SEQ ID NO: 38000

SEQ ID NO: 54714 - DNA, 435 bp, Neisseria meningitidis; identical to SEQ ID NO: 38001
  CDS (1)..(435)

SEQ ID NO: 54715 - protein, 144 aa, Neisseria meningitidis; identical to SEQ ID NO: 38002

SEQ ID NO: 54716 - DNA, 432 bp, Nitrosomonas europaea; identical to SEQ ID NO: 38003
  CDS (1)..(432)

SEQ ID NO: 54717 - protein, 143 aa, Nitrosomonas europaea; identical to SEQ ID NO: 38004

SEQ ID NO: 54718 - DNA, 426 bp, Onion yellows phytoplasma; identical to SEQ ID NO: 38005
  CDS (1)..(426)

SEQ ID NO: 54719 - protein, 141 aa, Onion yellows phytoplasma; identical to SEQ ID NO: 38006

SEQ ID NO: 54720 - DNA, 429 bp, Parachlamydia sp; identical to SEQ ID NO: 38007
  CDS (1)..(429)

SEQ ID NO: 54721 - protein, 142 aa, Parachlamydia sp; identical to SEQ ID NO: 38008

SEQ ID NO: 54722 - DNA, 429 bp, Pasteurella multocida; identical to SEQ ID NO: 38009
  CDS (1)..(429)

SEQ ID NO: 54723 - protein, 142 aa, Pasteurella multocida; identical to SEQ ID NO: 38010

SEQ ID NO: 54724 - DNA, 429 bp, Photorhabdus luminescens; identical to SEQ ID NO: 38011
  CDS (1)..(429)

SEQ ID NO: 54725 - protein, 142 aa, Photorhabdus luminescens; identical to SEQ ID NO: 38012

SEQ ID NO: 54726 - DNA, 429 bp, Photobacterium profundum; identical to SEQ ID NO: 38013
  CDS (1)..(429)

SEQ ID NO: 54727 - protein, 142 aa, Photobacterium profundum; identical to SEQ ID NO: 38014

SEQ ID NO: 54728 - DNA, 468 bp, Picrophilus torridus; identical to SEQ ID NO: 38015
  CDS (1)..(468)

SEQ ID NO: 54729 - protein, 155 aa, Picrophilus torridus; identical to SEQ ID NO: 38016

SEQ ID NO: 54730 - DNA, 438 bp, Porphyromonas gingivalis; identical to SEQ ID NO: 38017
  CDS (1)..(438)

SEQ ID NO: 54731 - protein, 145 aa, Porphyromonas gingivalis; identical to SEQ ID NO: 38018

SEQ ID NO: 54732 - DNA, 429 bp, Gamma; identical to SEQ ID NO: 38019
  CDS (1)..(429)

SEQ ID NO: 54733 - protein, 142 aa, Gamma; identical to SEQ ID NO: 38020

SEQ ID NO: 54734 - DNA, 426 bp, Prochlorococcus marinus subsp; identical to SEQ ID NO: 38021
  CDS (1)..(426)

SEQ ID NO: 54735 - protein, 141 aa, Prochlorococcus marinus subsp; identical to SEQ ID NO: 38022

SEQ ID NO: 54736 - DNA, 432 bp, Pseudomonas aeruginosa; identical to SEQ ID NO: 38023
  CDS (1)..(432)

SEQ ID NO: 54737 - protein, 143 aa, Pseudomonas aeruginosa; identical to SEQ ID NO: 38024

SEQ ID NO: 54738 - DNA, 432 bp, Pseudomonas putida; identical to SEQ ID NO: 38025
  CDS (1)..(432)

SEQ ID NO: 54739 - protein, 143 aa, Pseudomonas putida; identical to SEQ ID NO: 38026

SEQ ID NO: 54740 - DNA, 432 bp, Pseudomonas syringae; identical to SEQ ID NO: 38027
  CDS (1)..(432)

SEQ ID NO: 54741 - protein, 143 aa, Pseudomonas syringae; identical to SEQ ID NO: 38028

SEQ ID NO: 54742 - DNA, 495 bp, Pyrococcus horikoshii; identical to SEQ ID NO: 38029
  CDS (1)..(495)

SEQ ID NO: 54743 - protein, 164 aa, Pyrococcus horikoshii; identical to SEQ ID NO: 38030

SEQ ID NO: 54744 - DNA, 432 bp, Ralstonia solanacearum; identical to SEQ ID NO: 38031
  CDS (1)..(432)

SEQ ID NO: 54745 - protein, 143 aa, Ralstonia solanacearum; identical to SEQ ID NO: 38032

SEQ ID NO: 54746 - DNA, 429 bp, Rhizobium meliloti; identical to SEQ ID NO: 38033
  CDS (1)..(429)

SEQ ID NO: 54747 - protein, 142 aa, Rhizobium meliloti; identical to SEQ ID NO: 38034

SEQ ID NO: 54748 - DNA, 426 bp, Rhodopirellula baltica; identical to SEQ ID NO: 38035
  CDS (1)..(426)

SEQ ID NO: 54749 - protein, 141 aa, Rhodopirellula baltica; identical to SEQ ID NO: 38036

SEQ ID NO: 54750 - DNA, 429 bp, Rhodopseudomonas palustris; identical to SEQ ID NO: 38037
  CDS (1)..(429)

SEQ ID NO: 54751 - protein, 142 aa, Rhodopseudomonas palustris; identical to SEQ ID NO: 38038

SEQ ID NO: 54752 - DNA, 438 bp, Rickettsia typhi; identical to SEQ ID NO: 38039
  CDS (1)..(438)

SEQ ID NO: 54753 - protein, 145 aa, Rickettsia typhi; identical to SEQ ID NO: 38040

SEQ ID NO: 54754 - DNA, 429 bp, Shewanella oneidensis; identical to SEQ ID NO: 38041
  CDS (1)..(429)

SEQ ID NO: 54755 - protein, 142 aa, Shewanella oneidensis; identical to SEQ ID NO: 38042

SEQ ID NO: 54756 - DNA, 423 bp, Staphylococcus epidermidis; identical to SEQ ID NO: 38043
  CDS (1)..(423)

SEQ ID NO: 54757 - protein, 140 aa, Staphylococcus epidermidis; identical to SEQ ID NO: 38044

SEQ ID NO: 54758 - DNA, 426 bp, Synechococcus elongatus; identical to SEQ ID NO: 38045
  CDS (1)..(426)

SEQ ID NO: 54759 - protein, 141 aa, Synechococcus elongatus; identical to SEQ ID NO: 38046

SEQ ID NO: 54760 - DNA, 426 bp, Synechococcus sp; identical to SEQ ID NO: 38047
  CDS (1)..(426)

SEQ ID NO: 54761 - protein, 141 aa, Synechococcus sp; identical to SEQ ID NO: 38048

SEQ ID NO: 54762 - DNA, 471 bp, Thermoplasma acidophilum; identical to SEQ ID NO: 38049
  CDS (1)..(471)

SEQ ID NO: 54763 - protein, 156 aa, Thermoplasma acidophilum; identical to SEQ ID NO: 38050

SEQ ID NO: 54764 - DNA, 426 bp, Thermotoga maritima; identical to SEQ ID NO: 37695
  CDS (1)..(426)

SEQ ID NO: 54765 - protein, 141 aa, Thermotoga maritima; identical to SEQ ID NO: 37696

SEQ ID NO: 54766 - DNA, 444 bp, Thermus thermophilus; identical to SEQ ID NO: 38053
  CDS (1)..(444)

SEQ ID NO: 54767 - protein, 147 aa, Thermus thermophilus; identical to SEQ ID NO: 38054

SEQ ID NO: 54768 - DNA, 423 bp, Thermoanaerobacter tengcongensis; identical to SEQ ID NO: 38055
  CDS (1)..(423)

SEQ ID NO: 54769 - protein, 140 aa, Thermoanaerobacter tengcongensis; identical to SEQ ID NO: 38056

SEQ ID NO: 54770 - DNA, 477 bp, Thermoplasma volcanium; identical to SEQ ID NO: 38057
  CDS (1)..(477)

SEQ ID NO: 54771 - protein, 158 aa, Thermoplasma volcanium; identical to SEQ ID NO: 38058

SEQ ID NO: 54772 - DNA, 432 bp, Treponema denticola; identical to SEQ ID NO: 38059
  CDS (1)..(432)

SEQ ID NO: 54773 - protein, 143 aa, Treponema denticola; identical to SEQ ID NO: 38060

SEQ ID NO: 54774 - DNA, 426 bp, Tropheryma whipplei; identical to SEQ ID NO: 38061
  CDS (1)..(426)

SEQ ID NO: 54775 - protein, 141 aa, Tropheryma whipplei; identical to SEQ ID NO: 38062

SEQ ID NO: 54776 - DNA, 453 bp, Ureaplasma parvum; identical to SEQ ID NO: 38063
  CDS (1)..(453)

SEQ ID NO: 54777 - protein, 150 aa, Ureaplasma parvum; identical to SEQ ID NO: 38064

SEQ ID NO: 54778 - DNA, 429 bp, Vibrio parahaemolyticus; identical to SEQ ID NO: 38065
  CDS (1)..(429)

SEQ ID NO: 54779 - protein, 142 aa, Vibrio parahaemolyticus; identical to SEQ ID NO: 38066

SEQ ID NO: 54780 - DNA, 429 bp, Vibrio vulnificus; identical to SEQ ID NO: 38067
  CDS (1)..(429)

SEQ ID NO: 54781 - protein, 142 aa, Vibrio vulnificus; identical to SEQ ID NO: 38068

SEQ ID NO: 54782 - DNA, 429 bp, Wigglesworthia glossinidia brevipalpis; identical to SEQ ID NO: 38069
  CDS (1)..(429)

SEQ ID NO: 54783 - protein, 142 aa, Wigglesworthia glossinidia brevipalpis; identical to SEQ ID NO: 38070

SEQ ID NO: 54784 - DNA, 441 bp, Wolbachia pipientis wMel; identical to SEQ ID NO: 38071
  CDS (1)..(441)

SEQ ID NO: 54785 - protein, 146 aa, Wolbachia pipientis wMel; identical to SEQ ID NO: 38072

SEQ ID NO: 54786 - DNA, 426 bp, Wolinella succinogenes; identical to SEQ ID NO: 38073
  CDS (1)..(426)

SEQ ID NO: 54787 - protein, 141 aa, Wolinella succinogenes; identical to SEQ ID NO: 38074

SEQ ID NO: 54788 - DNA, 429 bp, Xanthomonas axonopodis; identical to SEQ ID NO: 38075
  CDS (1)..(429)

SEQ ID NO: 54789 - protein, 142 aa, Xanthomonas axonopodis; identical to SEQ ID NO: 38076

SEQ ID NO: 54790 - DNA, 429 bp, Xanthomonas campestris; identical to SEQ ID NO: 38077
  CDS (1)..(429)

SEQ ID NO: 54791 - protein, 142 aa, Xanthomonas campestris; identical to SEQ ID NO: 38078

SEQ ID NO: 54792 - DNA, 429 bp, Xylella fastidiosa; identical to SEQ ID NO: 38079
  CDS (1)..(429)

SEQ ID NO: 54793 - protein, 142 aa, Xylella fastidiosa; identical to SEQ ID NO: 38080

SEQ ID NO: 54794 - DNA, 429 bp, Yersinia pestis; identical to SEQ ID NO: 38081
  CDS (1)..(429)

SEQ ID NO: 54795 - protein, 142 aa, Yersinia pestis; identical to SEQ ID NO: 38082

SEQ ID NO: 54796 - DNA, 588 bp, Caenorhabditis elegans; identical to SEQ ID NO: 38083
  CDS (1)..(588)

SEQ ID NO: 54797 - protein, 195 aa, Caenorhabditis elegans; identical to SEQ ID NO: 38084

SEQ ID NO: 54798 - DNA, 591 bp, Drosophila melanogaster; identical to SEQ ID NO: 38085
  CDS (1)..(591)

SEQ ID NO: 54799 - protein, 196 aa, Drosophila melanogaster; identical to SEQ ID NO: 38086

SEQ ID NO: 54800 - DNA, 438 bp, Reclinomonas americana; identical to SEQ ID NO: 38087
  CDS (1)..(438)

SEQ ID NO: 54801 - protein, 145 aa, Reclinomonas americana; identical to SEQ ID NO: 38088

SEQ ID NO: 54802 - DNA, 477 bp, Saccharomyces cerevisiae; identical to SEQ ID NO: 38089
  CDS (1)..(477)

SEQ ID NO: 54803 - protein, 158 aa, Saccharomyces cerevisiae; identical to SEQ ID NO: 38090

SEQ ID NO: 54804 - DNA, 25 bp, Primer
atggctaagaaagtacaagcctatg

SEQ ID NO: 54805 - DNA, 22 bp, Primer
ttagtcctccactaccaggccc

SEQ ID NO: 54806 - protein, 167 aa, consensus; identical to SEQ ID NO: 38093
  MISC_FEATURE (1)..(167): consensus for the disclosure of xaa see table XV

SEQ ID NO: 54807 - protein, 38 aa, consensus; identical to SEQ ID NO: 38094
  MISC_FEATURE (1)..(38): consensus for the disclosure of xaa see table XV

SEQ ID NO: 54808 - protein, 39 aa, consensus; identical to SEQ ID NO: 38095
  MISC_FEATURE (1)..(39): consensus for the disclosure of xaa see table XV

SEQ ID NO: 54809 - protein, 46 aa, consensus; identical to SEQ ID NO: 38096
  MISC_FEATURE (1)..(46): consensus for the disclosure of xaa see table XV

SEQ ID NO: 54810 - DNA, 1194 bp, Escherichia coli
  CDS (1)..(1194)
atgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaa

SEQ ID NO: 54811 - protein, 397 aa, Escherichia coli
MFQKVDAYAGDPILTLMERFKEDPRSDKVNLSIGLYYNEDGIIPQLQAVAEAEARLNAQPHGASLYLPMEGLNCYRHAIAPLLFGADHPVLKQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDAVIEILKARELIPFLDIAYQGFGAGMEEDAYAIRAIASAGLPALVSNSFSKIFSLYGERVGGLSVMCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 54812 - DNA, 1451 bp, Mus musculus
  CDS (62)..(1276)
agcgctgccaaggttctggaagaaagaggcctgaaattattggcaccgcacgtgctcaactatgaccagtctttctgtgttcagggatgtacccacagcccagaagctagaaggcagcttactaaagatctacaggcaagatggctatcccagcaagttgttcctggcctacaaagtctgcatgaccgaagaaggccatccctgggtttctcttgtggtgcacaagacccgcctgcagattgcagaggacccctctctggactatgagtacttgcccctggtgggcctgaaatcattcatccagtcttctctggaactcctctttggaaagcacagcgaagccattgcggagaaaagggttgggggtgtgcacatcgttggtgagagtggagccttccagcttggggctcagttcctcaagacgtggcgaaagaatgtgaaaatcgtttgtatcgtctcatgtcaaaaagaacagtgtggactcatcttccaggacatgggctttatagtttatgagtactctatctggaacgccagtgatctctgctcagaccccagcatgttcgtggaagtactccagcatatcccggtcggcagcatccttgtgattgggaacatcactgattgcaagttcacacagaatcagtggacgaaactgatgtccatcattaagagcaagcagatattcccattctttgacattccctgtcaaggtttatccactggtgacctcgaggaagataccaaaatcttacagtactttgtgtccctaggcttggagttcttctgcagccaatctctgtccaagaattttggcatttatgatgaaggagtggggatcctagtagtggctgccctcagcaaccagcacctgctgtgtgtcctctcccagctgatggattatgtccaggccctgtggggaaaccctcctgccacgggtgctcggataatcacctccatcctctgcaaccctgctctgtttggagaatggaagcagagtctcaaaggtgtggtggagaacatgatgctgatcaaggagaaagtgaaggagaagctgcggctcctagggacccctgggtcgtgggatcacatcacccgacagagcgggacccatggttatctgggactcacctatcaacaggtggagtttctggtcaagaagaaacatatctacttgcccaaaactagccggatcaacttcacctgcatcaatgccaggaatatagactacatcactcagagcatccatgaggccgtgatgctaacagagggctgagagggtgtctgctcaaaactgcccctgactggaacgaaagctttacgctgtctttgaaaataaaaatcctggaggaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 54813 - protein, 404 aa, Mus musculus
MTSLSVFRDVPTAQKLEGSLLKIYRQDGYPSKLFLAYKVCMTEEGHPWVSLVVHKTRLQIAEDPSLDYEYLPLVGLKSFIQSSLELLFGKHSEAIAEKRVGGVHIVGESGAFQLGAQFLKTWRKNVKIVCIVSCQKEQCGLIFQDMGFIVYEYSIWNASDLCSDPSMFVEVLQHIPVGSILVIGNITDCKFTQNQWTKLMSIIKSKQIFPFFDIPCQGLSTGDLEEDTKILQYFVSLGLEFFCSQSLSKNFGIYDEGVGILVVAALSNQHLLCVLSQLMDYVQALWGNPPATGARIITSILCNPALFGEWKQSLKGVVENMMLIKEKVKEKLRLLGTPGSWDHITRQSGTHGYLGLTYQQVEFLVKKKHIYLPKTSRINFTCINARNIDYITQSIHEAVMLTEG

SEQ ID NO: 54814 - DNA, 1390 bp, Cryptococcus neoformans var. neoformans JEC21
  CDS (71)..(1312)
agcttgttttggttctgcatttctttcctgctcctgttctatagactatacagcaaccacatcttacaaaatgagttttaccaacttctgggctggtgttcccgagggtcctcccgaccccatcctcggtgtgactgatgcattcaagaaggacacatctccaaaaaaggttaaccttggtgtcggcgcctatcgtgacgaggatggcaagccttacgttctcgactctgtcttgaaggccgaagacatcttgcacaagaagaggctcgataaggagtaccttcctatcaccggtgctgccgactttatcaagctcgcttctgaactcgcctatggcaaagactccaagcctctgcgggagggtagagtcgctgtctctcaatccatctctggtacaggcgccctccggatcgctactggtttcctctccagtttctactctggccccaaggtcatctacttgcccaaccccacttggggtaaccacgttcctttggccgaatctgtcggtatcaaggtcgaaagatataggtattttgacaagaagacagtcggtcttgactttgagggcatgaaggaggacatcaagaacgccgaatccggctctattattcttctccatgcctgtgcccaaaaccctactggtatcgaccctacgcaggagcaatggaaggagttgagcgatttgctcaaagccaagaagcatcttcccttgttcgacatggcttaccaaggtttcgcatctggcgacattatccgtgacgcttttgccgtacgatactttgttgagcagggtcaccagatcatcctctgccaatctttcgccaagaacctgggtctctacgctgagcgtgccggtaccttctccatggtctgcgcttcccccgaggagaaggaacgggtcatgtcccagatcaagcgtgtcgtccgacctctctactcttctccccccatccatggtgctcagctggttgctaccatcctcggtactcctgagctttacgacgagtggcttaccgaggtgaagaagatggctgaccgtatcatcgccatgcgagaaaagctttacaacctcctcattgagctcaagactcctggagaatggggccacatcaagtctcaaatcggcatgttctctttcaccggtatctccaaagaacaagtcgacgaccttgccgagtacgctcacgtgtatatgaccaaggacggccgtatctccatggctggtttgaacgaacataacattcagtactttgctgagagcttgtccaaggctgtcaaaggcgaattgaggaccaagtcggcactttagaaggatgatgatggatttgtaagaagttatgacaagaagcttaaatatgcactgtgatgtggaaaatacttcttttaa

SEQ ID NO: 54815 - protein, 413 aa, Cryptococcus neoformans var. neoformans JEC21
MSFTNFWAGVPEGPPDPILGVTDAFKKDTSPKKVNLGVGAYRDEDGKPYVLDSVLKAEDILHKKRLDKEYLPITGAADFIKLASELAYGKDSKPLREGRVAVSQSISGTGALRIATGFLSSFYSGPKVIYLPNPTWGNHVPLAESVGIKVERYRYFDKKTVGLDFEGMKEDIKNAESGSIILLHACAQNPTGIDPTQEQWKELSDLLKAKKHLPLFDMAYQGFASGDIIRDAFAVRYFVEQGHQIILCQSFAKNLGLYAERAGTFSMVCASPEEKERVMSQIKRVVRPLYSSPPIHGAQLVATILGTPELYDEWLTEVKKMADRIIAMREKLYNLLIELKTPGEWGHIKSQIGMFSFTGISKEQVDDLAEYAHVYMTKDGRISMAGLNEHNIQYFAESLSKAVKGELRTKSAL

SEQ ID NO: 54816 - DNA, 1539 bp, Cryptococcus neoformans var. neoformans JEC21
  CDS (26)..(1387)
ctaactgcgtgaacaacgtctactcatgttaccccgactaggtgcgatacaatcaactactcatcccttcttcttcacaaccacaaaaatgcttgttcactcctcgaaatatctccttgcccggtccgctgccatctccaaggttctccccgccgtcgctgccagacgagccggctctacttggactaacgtccctgctggtcctcctgaccctatccttggtgttactgaaaagttcaaggccgacaagtctcccaagaagatcaatcttggtgtcggtgcttaccgagatggttcgggcaagccttacgtccttcctaccgtaaggaaagccgagaagatcctcgccgaagctatgcaggacaaggaataccttcccatcaccggtctctctgactttactaagctcgctgccgagctcgcgtatggcaaggactctaagccgctcgtcgagaatcgacttgcaatcacccagtctatctccggtactggtgctctccgaatcggtactgccttccttgccaggtggttccccggcgcaaagtccatatatcttcccactcctacttggggtaatcatattcccattgctaaggactctggtttggaggtcaagcagtacaaatactttgacaaaaaaaccgtcggccttgactttgaaggtatgaaggccgacattaaggccgctcctgagggctccatcgtccttctccacgcttgtgcacacaaccccactggtatcgaccctaccgaggctcagtggaaggagctttctgatattgtcaaggagaagaagcatttccccttctttgacatggcctaccaaggctttgcctctggtgacacactcaaggacgctttcgccgtccgatatttcgtcgagcagggtcaccagctcttgctttgtcaatcttttgccaagaacatgggtctatatggtgaaagagctggggccatctctttcgtctgtgaaagccccgaggagaaggccagggtcgattctcagttgaagattatcattcgacctatgtactccaaccctcccgttcacggcgcgcgtctcgtctctactattcttggctcccccgagctcaccaaggaatggctcgtcgaagtcaagggcatggccgaccgtatcatcgagatgcgtgagcgtctttacaacaagctcgtcgagcttgatacccctggagagtggggccacatcaagtctcagattggcatgttctcattcaccggtctcaagcccgagcaagtcgataagcttgcggagaaggcgtctatctacttgaccagggacggacgtatttccatggcaggattaaactctaacaacgttgattacttcgccgagagcgttagcaaggctgttaagggtacactttaagcagcatgtaagcgaccgatgagataacgatgtagttgttttgaacatggctggcgagcgaacttacaacatgtttgtgaagatgtgaaaagaagaatacaaagacggaagcgatacaggcgagcgtggctgcatgtatccgggtctgagct

SEQ ID NO: 54817 - protein, 453 aa, Cryptococcus neoformans var. neoformans JEC21
MLPRLGAIQSTTHPFFFTTTKMLVHSSKYLLARSAAISKVLPAVAARRAGSTWTNVPAGPPDPILGVTEKFKADKSPKKINLGVGAYRDGSGKPYVLPTVRKAEKILAEAMQDKEYLPITGLSDFTKLAAELAYGKDSKPLVENRLAITQSISGTGALRIGTAFLARWFPGAKSIYLPTPTWGNHIPIAKDSGLEVKQYKYFDKKTVGLDFEGMKADIKAAPEGSIVLLHACAHNPTGIDPTEAQWKELSDIVKEKKHFPFFDMAYQGFASGDTLKDAFAVRYFVEQGHQLLLCQSFAKNMGLYGERAGAISFVCESPEEKARVDSQLKIIIRPMYSNPPVHGARLVSTILGSPELTKEWLVEVKGMADRIIEMRERLYNKLVELDTPGEWGHIKSQIGMFSFTGLKPEQVDKLAEKASIYLTRDGRISMAGLNSNNVDYFAESVSKAVKGTL

SEQ ID NO: 54818 - DNA, 1590 bp, Cryptococcus neoformans var. neoformans JEC21
  CDS (1)..(1590)
atgggtagaccgttgagtggaagctccagtgcagcctcaggcgataagaaaggattagagctttggtcgtcactgccgaaagcctcccaagagacaactgtcgcaatcgcttcggcctttgaggacgatgatgctccgaacaagatcaacatctgcactcccgggtaccgtgatgagacaggcaaactcttcgtgcctcctacggtccgttatgcggagaagcaacttaatagcgaaagcatggtgtcaagggaggctttgccaatcgaaggccatgcgcctttccttgacgctggagtaaaattcgcctatggaggtgacagtcacccttatagacataagcgggtcgctgccgttcaagctgtttctctcactggtgctcttcgtctcgctggaacattcctctctcgcttccctacacttcctcctaccaagacggtctttattccttcaccaactactgatgaagacgtgactgccctccaagatgcggggctcgaaatccgatcttttaggttcctcgatctgaaaaccggtggggttgactgggaaagcttacgcgaggacttgcaagatgccccaatgaagagcatagtgttgttgcatgtcagcggaagtgttcctagtggtgcggagttaacgactaatcagtggagattactggcatcattgttacaagagcgagaaatgattccgctcgtgatcatggctttccagggtctgtcatcaggtgataccaatcgcgacgctcaagcgctccggttcatggtccacgaaggtcttcctgtcgtactcgtccaaaactttgacgccactatgggtctctatgccgattctccctccatcgtctccatcgttacacgaaattccgaagataaggaccgtgttgaatcgcagcttcgggctattggccgtgggatgtggatacacccttcgccttggggtgcccacatcgcacaccagatattgacggatgccaagctacatccttcatggttgaaggagatgcgattgatgtcagacaggttgaggagtgcaagaagcaagttgtatatgcagctggtggacaagttgaagactcctggagattgggcgcacataaaaaaggcaaacgggatgtattgtaccgccctgctgccttctgctcaaaccgaggcgctaaccgctaagcatcatatccatttgcttcccgatggatgttttaacctcggatctctcaatagctcaaagattgatgccctcagtcgtgccattgactctgtggttagagaaggtatacgagaggcggaagaggctcaggcccatcgtttggccatggaattagcattggcggctgccaaagagcaagcagcaagggaagagactcagagagaggaagagagggaggcggcagagatgcgtgccgcaagagaggaagacacattgctcatggagagaagtattgcgaacgctatcgagaggcagaagagagaagaagaagaagagcgaaagagggaagagcaaagaaagagagaggacgaacaacagagaaagcaaagggagagagaagagattgcaagacaggcagaggctattttggcgactatttaa

SEQ ID NO: 54819 - protein, 529 aa, Cryptococcus neoformans var. neoformans JEC21
MGRPLSGSSSAASGDKKGLELWSSLPKASQETTVAIASAFEDDDAPNKINICTPGYRDETGKLFVPPTVRYAEKQLNSESMVSREALPIEGHAPFLDAGVKFAYGGDSHPYRHKRVAAVQAVSLTGALRLAGTFLSRFPTLPPTKTVFIPSPTTDEDVTALQDAGLEIRSFRFLDLKTGGVDWESLREDLQDAPMKSIVLLHVSGSVPSGAELTTNQWRLLASLLQEREMIPLVIMAFQGLSSGDTNRDAQALRFMVHEGLPVVLVQNFDATMGLYADSPSIVSIVTRNSEDKDRVESQLRAIGRGMWIHPSPWGAHIAHQILTDAKLHPSWLKEMRLMSDRLRSARSKLYMQLVDKLKTPGDWAHIKKANGMYCTALLPSAQTEALTAKHHIHLLPDGCFNLGSLNSSKIDALSRAIDSVVREGIREAEEAQAHRLAMELALAAAKEQAAREETQREEEREAAEMRAAREEDTLLMERSIANAIERQKREEEEERKREEQRKREDEQQRKQREREEIARQAEAILATI

SEQ ID NO: 54820 - DNA, 1287 bp, Staphylococcus aureus subsp. aureus COL
  CDS (1)..(1287)
atgaatcctttagcccaaagcttaaatgaacaacttcaacagtcaaatgcaactgcctttacaatgttatctgacttaggtcaaaatatgttttatccaaaaggcattttatctcaatctgctgaagcaaagagtacaacatataatgcaactataggtatggcgacaaacaaagacggaaaaatgtttgcatcatctttagatgcaatgtttaatgatttaactccagatgaaatattcccttatgtgccaccacaaggcatcgaagaattacgtgatttatggcaacaaaaaatgttgcgtgacaatccagagctatcaatcgacaacatgtcactaccaattgttacgaatgcattaacacatggtttatctttagttggcgatttatttgtaaatcaaggtgacactatcttgttaccagagcataattggggtaattacaaacttgttttcaatacgagaaatggtgcaaaccttcaaacatatcctatctttgataaagacgggcattatactactgattcacttgtagaagctttacaatcatacaataaagataaagtcattatgattttaaattatcctaataatccgacaggttacacacctacgcataaagaagtgactaccatcgtcgatgcaattaaagcattagctgataaaggtacaaaagttatagctgttgtggatgacgcatactatggtttattctatgaagatgtgtatactcaatcattatttactgcattatctaatttaaattcaaatgcaatattacctgttcgtttagatggtgcaacaaaagaatttttcgcatggggattccgtgttgggtttatgacatttggaacgtctgatcaaacaactaaagaagtattagaagccaaagtaaaaggtcttatacgaagtaacatttctagtggacctcttccaacacaaagcgctgttaagcatgtattaaaaaataataaacaattcgataaagaaatcgaacaaaatattcaaacattaaaagaacgctatgaagtcactaaggaagttgtctatgctgatcaatatcattcacattggcaagcctatgactttaactctggatactttatggcaataaaagttcatgatgttgaccctgaagaacttcgtaaacatttaattgaaaaatattcaattggtgttattgcacttaatgcaacagatattcgtattgcgtttagctgtgtagaaaaagaagatatcccacatgtatttgattcaattgctaaagcgattgatgacttaagataa

SEQ ID NO: 54821 - protein, 428 aa, Staphylococcus aureus subsp. aureus COL
MNPLAQSLNEQLQQSNATAFTMLSDLGQNMFYPKGILSQSAEAKSTTYNATIGMATNKDGKMFASSLDAMFNDLTPDEIFPYVPPQGIEELRDLWQQKMLRDNPELSIDNMSLPIVTNALTHGLSLVGDLFVNQGDTILLPEHNWGNYKLVFNTRNGANLQTYPIFDKDGHYTTDSLVEALQSYNKDKVIMILNYPNNPTGYTPTHKEVTTIVDAIKALADKGTKVIAVVDDAYYGLFYEDVYTQSLFTALSNLNSNAILPVRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEELRKHLIEKYSIGVIALNATDIRIAFSCVEKEDIPHVFDSIAKAIDDLR

SEQ ID NO: 54822 - DNA, 1200 bp, Vibrio fischeri ES114
  CDS (1)..(1200)
atgatgactatgtttgaaaaaatcgctgccgctcctgctgaccctattcttggcttaacagatgaatttaaaaatgaccctcgtgctgaaaaaatcaaccttggtgttggtatttacaaaaacgaagcgggtcaaactccagttttaaccacagttaaaaaagcagaagcagtattgcttgatacagaaaaaacaaagtcatacctaaccattcaaggtaccgcagaatacggccttgcagtacaaaagctactgtttggcgctgatgcacaagtaatcactgaaaaacgtgcacaaacagctcaagctccaggtggtactggtgcgctacgtgtagctggtgaattcatcaaacgtcaacttggcgatgtaaaaatttggatcagcaaccctacatgggcaaaccacattggtgtatttactgctgctggtattgaaacagcgcaatacacttactacaacgcagaaacgaaatctaaagacttcgctgcaatgctaacggatttacaacaagcggaagctggtgatgtggttcttctacacggttgttgtcataaccctactggtatcgatccaacggctgatgagtgggaagagctagctaaactatgtgcaaataaaggtctacttccactgtttgatttcgcataccaaggttttgcaaaaggtgttgaagaagatgcggctggtttacgtacttttgctcaatactgcccagagctgcttgtagcaagttcgttctctaagaactttggtttgtataacgagcgtgttggtgcatttactcttgttgctaaagacgcaacggttgctgcggatgcattctctcaagttaaagctatcatccgttctatctactctaacccaccagctcacggtgctgctgttgttacgcatattcttaatgacgatgcgctacgtgcagaatgggagcaagaagtcgctgaaatgcgtgaccgtattcaagagatgcgtactttgtttgttaccacactaaaagagcaaggtgtggatgcagactttagctttattgaacgtcaaaacggtatgttctctttctctggtctttctaaagagcaagtaaatcgcctgaaagacgaattcgcaatttacatcgttggttctggccgtatcagtgttgctggtatgacaaaagacaacatgcttcctttatgtaaaggtattgctgcggttctttaa

SEQ ID NO: 54823 - protein, 399 aa, Vibrio fischeri ES114
MMTMFEKIAAAPADPILGLTDEFKNDPRAEKINLGVGIYKNEAGQTPVLTTVKKAEAVLLDTEKTKSYLTIQGTAEYGLAVQKLLFGADAQVITEKRAQTAQAPGGTGALRVAGEFIKRQLGDVKIWISNPTWANHIGVFTAAGIETAQYTYYNAETKSKDFAAMLTDLQQAEAGDVVLLHGCCHNPTGIDPTADEWEELAKLCANKGLLPLFDFAYQGFAKGVEEDAAGLRTFAQYCPELLVASSFSKNFGLYNERVGAFTLVAKDATVAADAFSQVKAIIRSIYSNPPAHGAAVVTHILNDDALRAEWEQEVAEMRDRIQEMRTLFVTTLKEQGVDADFSFIERQNGMFSFSGLSKEQVNRLKDEFAIYIVGSGRISVAGMTKDNMLPLCKGIAAVL

SEQ ID NO: 54824 - DNA, 1188 bp, Vibrio fischeri ES114
  CDS (1)..(1188)
atgctgcaaaacatagcaactcctgctaaagatcccattctttctctttctatcgaataccgagctgatgatcgtgataataaagtcgatctcggcatcggtgtttatcgtaacgatcaaggtttaacaccaatcatgaaagccgtaagcgattcggttaaatctattgcagcagagcaaaccacaaaagcttatgttggtcttgctggttgtgaagtttttaatcaaagcatggttgatttattgttacgtgatacctcagcttatgagcgtgtatctgcgattcaaactcctggagcgagtggtgctttacgcatgcttgctgatttaattaaatcaacagagccaggtgcaactgtttggataagtaacccaagttatgttaaccatcagcctgtaatggaagctgctggccttaacgttcgtcattacacatatttcaatcctctgacaaaacaagtggatagcgaagctatgcttgctgacttagcaaacgctggtcctaaagacattattttactgcacggttgttgccataatccgactggcgcagatattcgtctttctgattggatagctataacagagttagcattaaaaaatggctttattccttttgtcgatattgcataccaaggatttggtgatggactagaagctgatgctgctggtttacggtttatggcagaccgtgtacctcaaatgtttatagcaacatcatgctcgaaaaattttggtttgtatcgtgaacgaacaggtgcggcgatggtgatcgctggcaatattgagatagcaatgaatgctaaagcgaaactgctgcaaatggctcgtgcgacttatactatgccgccagatcatggtgctgcgattgttggtcgaattttaaatgatgagcaattaacgttatcgtggcgcactgaattggatgagatgcaaaaacgcttagttggtttacgaactaacttatgtgaagcactacgtaatgaaacgcaatcagagacatttgattttattgaacagcataaaggtatgttctcagtaattggttttacgccagagcagatggcatctttaaaatcagaacatggtatttacgctgtgggtgatggtcgaatcaatattgcaggaatgcaagaaaagcacattgagtatattgctaaatctgttgcctctgttgcaaataagtaa

SEQ ID NO: 54825 - protein, 395 aa, Vibrio fischeri ES114
MLQNIATPAKDPILSLSIEYRADDRDNKVDLGIGVYRNDQGLTPIMKAVSDSVKSIAAEQTTKAYVGLAGCEVFNQSMVDLLLRDTSAYERVSAIQTPGASGALRMLADLIKSTEPGATVWISNPSYVNHQPVMEAAGLNVRHYTYFNPLTKQVDSEAMLADLANAGPKDIILLHGCCHNPTGADIRLSDWIAITELALKNGFIPFVDIAYQGFGDGLEADAAGLRFMADRVPQMFIATSCSKNFGLYRERTGAAMVIAGNIEIAMNAKAKLLQMARATYTMPPDHGAAIVGRILNDEQLTLSWRTELDEMQKRLVGLRTNLCEALRNETQSETFDFIEQHKGMFSVIGFTPEQMASLKSEHGIYAVGDGRINIAGMQEKHIEYIAKSVASVANK

SEQ ID NO: 54826 - DNA, 1194 bp, Neisseria gonorrhoeae FA 1090
  CDS (1)..(1194)
atgtaccgacacatcgaatactatcccggcgacccgattttgagtttggtcgaaaccttcaaaaacgacccgcgccccgaaaaagtcaatttgagcataggcatttatttcgacgacgaaggcagaatgcccgtattggaatccgtaagccgtgccgaaaccgcccgtgccgccgcgccagcgccgtcgccctacctgccgatggagggtttggacgtttaccgcagcgcggtgcagcatttgttgttcggcaaaggcaaccccgcgctcgcgcagggacgcatcgttaccgtacagactctgggcggctcgggcgcgctcaaagtcggggcggatttcctgcaccgctggtttcccgaagcgcgcgcctacgtcagcgatccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctcatcctccatccctgctgccacaacccgaccggcgtggatatgtcggaacggcaatgggacgaagtgttgcagatcatcaaaacgcgcaaactgattccgtttatggacatcgcctaccaaggcttcggcggcgatttggacagcgatgcctacgccgtccgcaaagcggtggaaatggatttgccgctgtttgtcagcaattcgttttcaaaaaacctgtcgctctacggcgaacgcgtcggcggcttaagcgtggtttgccccaataaagaagaagcggatttggtgttcggacaactcaaattcaccgtccgccgcatctactccagcccgcccgcgcacggcgcgtatatcgccgccgacgtgatgaacagctccgaactttacgccttgtggcaaaacgaagtttatatgatgcgcgaccgcatccgtgcgatgcggcagaaactttacggcgtattgaccgcccgaatccccgaccgcgatttcacttatttcatcaaacagcgcggaatgttcggctacacggggttgagcgtggggcaagtccgcaggttgcgcgacgaatttgccgtttacctgctggattccggcaggatgtgcgtcgccgggctgaatacatcaaatatcacttatgtcgccgatgcgcttgccgaagtgttgaaatag

SEQ ID NO: 54827 - protein, 397 aa, Neisseria gonorrhoeae FA 1090
MYRHIEYYPGDPILSLVETFKNDPRPEKVNLSIGIYFDDEGRMPVLESVSRAETARAAAPAPSPYLPMEGLDVYRSAVQHLLFGKGNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLQIIKTRKLIPFMDIAYQGFGGDLDSDAYAVRKAVEMDLPLFVSNSFSKNLSLYGERVGGLSVVCPNKEEADLVFGQLKFTVRRIYSSPPAHGAYIAADVMNSSELYALWQNEVYMMRDRIRAMRQKLYGVLTARIPDRDFTYFIKQRGMFGYTGLSVGQVRRLRDEFAVYLLDSGRMCVAGLNTSNITYVADALAEVLK

SEQ ID NO: 54828 - DNA, 1272 bp, Neisseria gonorrhoeae FA 1090
  CDS (82)..(1272)
ttgcgtctgtttccagcccgtgtaaaacagcgtaaaatcggcaaacccgaattatcttccgtccccatcaaggagcaagctatgttcttcaagcacatcgaagccgcccccgccgatccgattctcggtttgggcgaagcgttcaaagccgaaacccgccccgaaaaagtcaacctcggcatcggcgtgtacaaagacgcatccggcgcgacacccattgtcaaagccgtcaaagaggctgaaaaacgcctgttggaaagcgaaaccaccaaaaattacctgaccatcgacggcgttgccgactacaacgagcaaacccaaatcctgctgttcggcaaagaccacgaaatcatcgccagccgccgcgccaaaacagcgcaaagccttggcggtacaggcgcattgcgtattgcggccgaatttgccaaacgtcagttgaacgcgcaaaccatctggatttccaatccgacctggccaaaccacaacgccattgccaaagcggtcggtatccaagacaaaccttatcgctactatgatgccgccaaacactgcttggattgggacggcatgattgaagatttgaaccaagcgcaaaaaggcgacatcgtcctgctgcacggctgctgccacaaccctaccggtatcgaccctacgcccgaacaatgggaaactttagcaaaactttctgccgaaaaaggctggttgccattgtttgactttgcctaccaaggcttcggcaatggtttggaagaagatgcctatggcttgcgcgtgttcttgaaacacaatacagaattgctgattgccagctcttattccaaaaacttcggcatgtacaacgagcgtgtcggtgcattcactttggtggccgaagatgaagaaacagcagcccgcgcccacagccaaatcaaaaccatcatccgtaccttgtattccaacccggcttcacatggtgcgaacaccattgcactggtgttgaaaaatgatgatttgaaagcacaatggattgccgaacttgacgaaatgcgcggccgcatcaaagccatgcgccaaaaatttgtcgagttgctcaaggccaaaggttcaacccaagactttgattttattattgaacaaaacggtatgttctctttcagcggcttgactcccgaacaagttgaccgtttgaaaaacgagtttgccatttatgccgtccgttccggccgcatcaacgtcgccggcattaccgacgacaacatcgattatctgtgtgaaagcatcgtgaaagtatag

SEQ ID NO: 54829 - protein, 396 aa, Neisseria gonorrhoeae FA 1090
MFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDKPYRYYDAAKHCLDWDGMIEDLNQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQIKTIIRTLYSNPASHGANTIALVLKNDDLKAQWIAELDEMRGRIKAMRQKFVELLKAKGSTQDFDFIIEQNGMFSFSGLTPEQVDRLKNEFAIYAVRSGRINVAGITDDNIDYLCESIVKV

SEQ ID NO: 54830 - DNA, 1242 bp, Homo sapiens
  CDS (1)..(1242)
atggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 54831 - protein, 413 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 54832 - DNA, 1356 bp, Saccharomyces cerevisiae
  CDS (1)..(1356)
atgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataa

SEQ ID NO: 54833 - protein, 451 aa, Saccharomyces cerevisiae
MLRTRLTNCSLWRPYYTSSLSRVPRAPPDKVLGLSEHFKKVKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNYFVYLTGDGRLSLSGVNDSNVDYLCESLEAVSKMDKLA

SEQ ID NO: 54834 - DNA, 1257 bp, Saccharomyces cerevisiae
  CDS (1)..(1257)
atgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 54835 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 54836 - DNA, 1242 bp, Mus musculus
  CDS (1)..(1242)
atggcgcctccatcagtctttgcccaggttccgcaagctcctccggttctggtctttaagctcactgcggacttccgggatgatccagatccccgcaaggttaacctcggcgtgggagcgtaccgcacagatgaatctcagccctgggttttgccagtagtgagaaaggtcgaacagaagattgctaatgacaacagcctcaaccacgagtacctgcccatcttgggcctggcagagttccggagctgtgcttctcgcctagttcttggggacaacagcccggctatcagggagaatcgggttggaggggtgcagtctttgggagggacaggcgctcttcggattggagctgacttcttagggcgatggtacaatggtacagataacaagaacacaccaatttacgtatcatcgccaacctgggagaaccataatgctgtgttttctgccgccggttttaaggacattcggccctattgctactgggatgcggagaagagaggactggacctccagggtttcctgaatgatctggagaatgcccccgagttctccatctttgtcctccatgcctgtgcgcacaacccaacagggaccgacccgactccagagcagtggaagcagatcgctgctgtcatgcagcgccgttttctgttccccttctttgactcagcctatcagggctttgcatctggagacctagagaaagatgcgtgggctattcgctattttgtgtctgaaggcttcgagctcttctgtgcccagtccttctccaagaacttcgggctctacaatgagagagtggggaatctgaccgtggtcggaaaagagtctgacagcgtcctgcgggtcctttcccagatggagaagattgtacgaatcacctggtccaatcccccagcccaaggagctcggattgtggccgccaccctctctgacccggagctctttaaggagtggaaaggtaacgtgaagacaatggctgaccggattctgaccatgagatccgaactcagggcaagactagaagctctcaagacccccgggacttggtctcacatcactgagcagattggaatgttcagtttcaccggcttgaaccccaagcaggtcgagtatttggtcaacgagaagcatatctatctcctgccgagtggtcggatcaacatgtgcggcttgaccaccaagaacctagattacgtcgctacctccatccatgaagccgtcaccaaaatccagtga

SEQ ID NO: 54837 - protein, 413 aa, Mus musculus
MAPPSVFAQVPQAPPVLVFKLTADFRDDPDPRKVNLGVGAYRTDESQPWVLPVVRKVEQKIANDNSLNHEYLPILGLAEFRSCASRLVLGDNSPAIRENRVGGVQSLGGTGALRIGADFLGRWYNGTDNKNTPIYVSSPTWENHNAVFSAAGFKDIRPYCYWDAEKRGLDLQGFLNDLENAPEFSIFVLHACAHNPTGTDPTPEQWKQIAAVMQRRFLFPFFDSAYQGFASGDLEKDAWAIRYFVSEGFELFCAQSFSKNFGLYNERVGNLTVVGKESDSVLRVLSQMEKIVRITWSNPPAQGARIVAATLSDPELFKEWKGNVKTMADRILTMRSELRARLEALKTPGTWSHITEQIGMFSFTGLNPKQVEYLVNEKHIYLLPSGRINMCGLTTKNLDYVATSIHEAVTKIQ

SEQ ID NO: 54838 - DNA, 1242 bp, Rattus norvegicus
  CDS (1)..(1242)
atggcccctccatcattctttgcccaggttccacaggccccgccggttctggtctttaagctcattgcggacttccgggatgatcccgatccccgcaaggttaacctcggcgtgggagcgtaccgcacagatgactctcagccctgggttttgccagtagtgacgaaggtcgaacagaagattgctaacgaccacagtctcaaccacgagtacttgcccatcctgggcctggcggagttccggagctgtgcttctcagctagtacttggggacaacagcccagctctcagggagaatggggttgggggtgtgcagtctttgggagcgaccggtgcacttcgaattggagctgacttcttagcgcgatggtacaatggcacagacaacaagaacacgcccgtctacgtatcatcgccgacctgggagaaccataatggcgtgttttctgccgctggttttaaagacattcggtcctatcgctactgggatgcagagaagagaggacttgatctccagggtttcctgaatgatctggagaatgctcctgagttctccatctttgtcctccacgcctgtgcacacaacccaacggggaccgacccaactgaagaggagtggaagcagatcgccgccgtcatgaagcgccgttttctgttccccttctttgactcagcctatcagggctttgcatctggagacctagagaaagatgcctgggctattcgctattttgtgtctgaaggcttcgagctcttctgtccccagtccttctccaagaacttcgggctctacaatgagagagtggggaatctgaccgtggtcggaaaagagcatgacagcgtcctgcgggtcctttcccagatggagaagattgtacgaatcacctggtccaatccccctgcccagggagctcggatcgtggccaccaccctctccaaccctgagctctttaaggagtggaaaggaaacgtgaagacaatggctgaccggattctgaccatgagatccgaactcagggcgcgactagaagctctcaagactcccgggacttggtctcacatcactgagcagattggaatgttcagctttactgggttgaaccccaagcaggtcgagtatttggtcaacgagaagcacatctatctgatgccgagcggtcggatcaacatgtgcggcttgaccaccaagaacctagattatgtggctacctccatcaatgaagctgtcaccaaattccagtga

SEQ ID NO: 54839 - protein, 413 aa, Rattus norvegicus
MAPPSFFAQVPQAPPVLVFKLIADFRDDPDPRKVNLGVGAYRTDDSQPWVLPVVTKVEQKIANDHSLNHEYLPILGLAEFRSCASQLVLGDNSPALRENGVGGVQSLGATGALRIGADFLARWYNGTDNKNTPVYVSSPTWENHNGVFSAAGFKDIRSYRYWDAEKRGLDLQGFLNDLENAPEFSIFVLHACAHNPTGTDPTEEEWKQIAAVMKRRFLFPFFDSAYQGFASGDLEKDAWAIRYFVSEGFELFCPQSFSKNFGLYNERVGNLTVVGKEHDSVLRVLSQMEKIVRITWSNPPAQGARIVATTLSNPELFKEWKGNVKTMADRILTMRSELRARLEALKTPGTWSHITEQIGMFSFTGLNPKQVEYLVNEKHIYLMPSGRINMCGLTTKNLDYVATSINEAVTKFQ

SEQ ID NO: 54840 - DNA, 1149 bp, Mesorhizobium loti MAFF303099
  CDS (1)..(1149)
atggtcgtttcgctctcgcgtcgtggcaatgtcgagccgttccacgccatggatgtgctggccgaagcgaaccggctgaaagcgcagggtgtgccggtgatctccatggcggtcggccaaccgtccgatccggcgcccgtacgggtccgagccgccgcggccagggccttgcaggacggtcgcatcggctacaccgacacgctggggctagctggcctgcgcaaggcgatcgccgagcactacgcggatcactataggctggaagtcgagcccgcccggatcgcggtgaccaccggatcgtccgcggccttcaatctcgccttcttggctatgttcgatccgggcgatcgcgttgccatcgcggcacccggctaccctgcctatcgcaacatcatggcggcgctcggcatcgatgtggtcgagatcgagctcggcgacgcggcctatctgcatgccggtcatcttgagaccgcgcatcgcgagaaaccgctgaagggtgtgctttttgcaagtccggccaatccgaccggtgccgtcataccggccgacgaactgtcggcgctggtcaatacggcggaggcactggggatcgccgtcatttccgacgaaatctaccaccggttggcctatggtgcgcctgacaccaccgcacttgccttcggcaacagcgtcacggtgatcaattccttctcgaaatactactgcatgaccggttggcgcatcggctggatggtgttgccggaagagctggtgcggcccgtcgagcgcatcgcccagagcctctacatttcgccgccggaactctcgcagatcgccgcgatcgaggcctttgccgccaccgaagagctggaggcggtcaaaggccgctatgcctggaatcgcgaactgctgatgaagcgcctgccggaactcggctttccgctggccgcgcccatggacggcgccttctatgcgttttgcgatgtcacccgccacagcaatgacagcatggccttcgcgcgcaagatgctggccgaggcgcatgtcgcggcgacgcccggccgcgatttcgacacccaggccggacatcgcacgatgcggttttcctacgccggcagccatgacgacatggtcgaggcgatggcgcgcatcgaacgctggttgaggtag

SEQ ID NO: 54841 - protein, 382 aa, Mesorhizobium loti MAFF303099
MVVSLSRRGNVEPFHAMDVLAEANRLKAQGVPVISMAVGQPSDPAPVRVRAAAARALQDGRIGYTDTLGLAGLRKAIAEHYADHYRLEVEPARIAVTTGSSAAFNLAFLAMFDPGDRVAIAAPGYPAYRNIMAALGIDVVEIELGDAAYLHAGHLETAHREKPLKGVLFASPANPTGAVIPADELSALVNTAEALGIAVISDEIYHRLAYGAPDTTALAFGNSVTVINSFSKYYCMTGWRIGWMVLPEELVRPVERIAQSLYISPPELSQIAAIEAFAATEELEAVKGRYAWNRELLMKRLPELGFPLAAPMDGAFYAFCDVTRHSNDSMAFARKMLAEAHVAATPGRDFDTQAGHRTMRFSYAGSHDDMVEAMARIERWLR

SEQ ID NO: 54842 - DNA, 1185 bp, Mesorhizobium loti MAFF303099
  CDS (1)..(1185)
atgttcgaagacctgcagccagctcccgccgacaagatcctggccctcatcggcctctatcgcgccgatccgcgtcccaacaaggtcgacctcggcgtcggcgtctacaaggatcgcgacggcaagaccccagtgatgcgcgccgtgcgtgaggctgaaaagcggctgctgaacagccaggacaccaagacctatctcgggctcgccggcgacaccggcttcaacgcggtgatggccaagctcgccttcggcccgggcgcggacatgacgcgcattcgggcggcccaggcgcctggcggctccggtgcgcttcgcctggtggcggagctgctcaagcggacccgttcggacgccacgatctggctgtcggacccaacctggccgaaccatatgccggtgatgcgcgctgccggcctgcagatccgcgaatatccctatttcgacgcggcctccggtgctgttcgcttcgacgacatgctggcggcgttgcggacggccaagagcggcgacgtggtgctgctgcacggctgctgccacaatccaaccggcgccaatctggatgcggcgcagtggcaggccgtcaccgatctgatggtcgagcgcggcctgctgccattcgtcgacatcgcctatcagggctttggcgacggcctcgaggccgacgctcttggcctgcgcctgctggcggcgaaagttccggaaatggttgttgcctcgagctgctcgaagaatttcgccgtctaccgcgaccgtgtcggcgcagcgatggttttggccagggacagcgcgcaggctgacgtggcgatgagccagatgctgtcggcggcgcgcgccatgtattcgatgccgccggaccatggtgccgcggcggtgcgcatcgtgctcgaagacgcaagcctgcgcgccgactgggaagccgaattggaagagatgcgcctgcgcatgctgaggcttcgcgtggctttcgccgaggcgctgcgccggcagtccaactccgaccgcttcgacttcgtcgccagccaccgcggcatgttctcacggcttggcctgacggaagcgcaggtcgagcggctgcgcgccgagcacggcgtgtacatggtcggcgatagccgcatcaacgtcgctggactgccggaggatggcatggacgcgctcgccaaggcgatcgtctccgtgctcgactga

SEQ ID NO: 54843 - protein, 394 aa, Mesorhizobium loti MAFF303099
MFEDLQPAPADKILALIGLYRADPRPNKVDLGVGVYKDRDGKTPVMRAVREAEKRLLNSQDTKTYLGLAGDTGFNAVMAKLAFGPGADMTRIRAAQAPGGSGALRLVAELLKRTRSDATIWLSDPTWPNHMPVMRAAGLQIREYPYFDAASGAVRFDDMLAALRTAKSGDVVLLHGCCHNPTGANLDAAQWQAVTDLMVERGLLPFVDIAYQGFGDGLEADALGLRLLAAKVPEMVVASSCSKNFAVYRDRVGAAMVLARDSAQADVAMSQMLSAARAMYSMPPDHGAAAVRIVLEDASLRADWEAELEEMRLRMLRLRVAFAEALRRQSNSDRFDFVASHRGMFSRLGLTEAQVERLRAEHGVYMVGDSRINVAGLPEDGMDALAKAIVSVLD

SEQ ID NO: 54844 - DNA, 1170 bp, Pyrococcus horikoshii OT3; identical to SEQ ID NO: 33931
  CDS (1)..(1170)

SEQ ID NO: 54845 - protein, 389 aa, Pyrococcus horikoshii OT3; identical to SEQ ID NO: 33932

SEQ ID NO: 54846 - DNA, 1230 bp, Aeropyrum pernix K1
  CDS (1)..(1230)
gtgaactggctgttgccccagaaggatcctaccctggacatccaggagagggttgttgagatagagggtgagactgctttcgcatacctcgcagtggccaggaagctgatccaggagggtaggcgcgtaataagctttgggataggccagcccgacttcccgacgccccatcacattagagaggctgcgaagaaggctttagacgaggggttcacaggctataccgagacggccgggataccggagctgagggaggctatcgcatggtacctcaactccaggtacggggccgacgtgtctccggaggaggttatagccacgacgggggctaagactgcaatattcctgggtatggccctctacctgaggccgggagacgaggtcataataccggaccccagctactacgcctacgcacaggtggctaaactcttcggcgccaggcccgtttacgttccaatgaagtttgagccgggtctagggttcaggttcgatatcgaggggatagaaagggctgtgagcgagaagacgaggatgatagttgtcaacaacccccacaaccccacggggagtgttttcccgccggaccaggtggaggcgatacacgatatagcgaggaggaggggcctaataatactggccgacgagatatacgacaacttcctctacacggagaagcccttcaagagcaccctctccctcccagactggagggagaacctcgtttacgtcaacggtttcagcaagacattcagcatgacgggctggaggctcggctatgttgtgctcaggagggaggtaatcccgaaggccctagacctcgcagtcacaatatacagctgcccccccagcatagctcagaaggctggcgtcgccgcgctcagaggcgactggggtcctgtgagagagatggtagaagagttcaggagcagagcgaggatactttacgacatactatcccaggccgagggtatagagccctacctcccggagggcgccttctacatgttcccccgtgtggccggcctcctgaggaagacggggctcagcgtggagcagctcgcggagaagctgctatacagctacggcgtcctggtcctgcccggcaccagcttccctgagagtgttggcagggagcatgttaggctgagcttcgccacggccaccagcgacgtgaaggagggggcggagataatagtcagggcgtctagggagctgtccagcggctag

SEQ ID NO: 54847 - protein, 409 aa, Aeropyrum pernix K1; identical to SEQ ID NO: 33928

SEQ ID NO: 54848 - DNA, 1203 bp, Chlamydia trachomatis D/UW-3/CX
  CDS (1)..(1203)
gtgagtctttttgaacagttaccttccttttctccggattctattcttggtttagcgcaggctttccaagaggatcctcgtgaggataagattaatttattactaggtacttacgaacgggaaaagaaacgttatggtggtttctcgagcgttagaaaggctcagtctgttttttttgacgatgagaaagataaaaattatctacccatcaaaggatcgtctacctttttagaagaaatggcagctctttgttttggagaagtggatgctagtcgatgggttggtgtgcaggcaattggaggtacaggagccttacatttaggggcttctgtatatgccaacgcatctttagcgggtaaggtgtatattccttctcaaacatgggggaaccattctaggatttttgctcatcaagggttagctttagagtattatccttactatgatcaggagaccaaagaactggatttacagggattgaaagctattttgcgatctgctcctgagacttcattagttctgttgcattgttgctgtcataatcctacagggaaagatattcctctttccgagtggccagaaatcattacgattattaaggagcgggatcttattcctttctttgatatggcttatttaggttttgctagtgggatagaagaagatcgtcgtcctgtgcgactgtgtatagaagctggggttactacttttgtagcaggaggcgctagtaaaattttttcgttatatggttctcgtgtaggattttttggagctatccatcaagataaactggatttaaaccgtattctatcctttttagaagaacagattcgtggggagtactcatctccggctagagaaggagttgctatcgtgacttctatattaagcaatccttacttacggcaagaatgggagcttgaattgaatggcattcggcagtctttggaagagattcgttcgagttttgtgattgccatgcgaaatgtagcggggcactctttcgatttcatagcttctcagaaaggattttttgggtatccaggtttttcaaaggaacaagtgctgttccttagagaagagcttggtatttacacaaccgcaggcgggagattcaatttaaatggcattacggataaaaatataaatcgtgttactcacggttttgctcaggcttatgaataccctcggtccgtatcataa

SEQ ID NO: 54849 - protein, 400 aa, Chlamydia trachomatis D/UW-3/CX
MSLFEQLPSFSPDSILGLAQAFQEDPREDKINLLLGTYEREKKRYGGFSSVRKAQSVFFDDEKDKNYLPIKGSSTFLEEMAALCFGEVDASRWVGVQAIGGTGALHLGASVYANASLAGKVYIPSQTWGNHSRIFAHQGLALEYYPYYDQETKELDLQGLKAILRSAPETSLVLLHCCCHNPTGKDIPLSEWPEIITIIKERDLIPFFDMAYLGFASGIEEDRRPVRLCIEAGVTTFVAGGASKIFSLYGSRVGFFGAIHQDKLDLNRILSFLEEQIRGEYSSPAREGVAIVTSILSNPYLRQEWELELNGIRQSLEEIRSSFVIAMRNVAGHSFDFIASQKGFFGYPGFSKEQVLFLREELGIYTTAGGRFNLNGITDKNINRVTHGFAQAYEYPRSVS

SEQ ID NO: 54850 - DNA, 1215 bp, Vibrio cholerae O1 biovar eltor str. N16961
  CDS (1)..(1215)
ttgttacctgaatttcaaagggttgtgactttcatgtttactcatttaccagcaccagttttagatccaatactttctctctccgtcgcctttcgcaatgatcctcgtccacaaaaagtggatcttggaatcggcgtttataaaaacagtcttggcgaaacgccaattatgcgtgccgttgcgctggcgcaagataaagtggtggcaagccaaaaaaccaaatcttatgtcggccttgccggctgtgaagagttcaaccagagcatgatgcagctcgtattaggttcaaccttggatacggagcgcacgattgcaatccagactccgggagccagcggcgcgctgcgtatgctgggggatttgatgcgtgtggcgcaaccggatactaccgtgtggatcaccgatcctagttatgtcaaccacaagcccgtgatggaagcggctggtctgaaagtacgttactaccgttatttcagccgtgaaaccaaaatggtggataccgaacaaatgttggccgatctggcacaagcgggaacgaaagatgtggtgttactgcatggttgttgtcataacccgacaggtgccgatatcgatttttctgcgtggcaagcgatcactgagttggcgcagaaaaacggctttatcccttttgtcgacatcgcctatcaaggttttggtgacggcttagaacaagatgcacagggtttgcgttacatggctgagcgcatggaagagatgttgatcacgacatcctgctctaagaatttcggcttgtatcgtgagcgtacgggagcggcgattgtgattgggaaaaatcagcaagaggtgaccaatgcacgcggcaaaatgctgaccttagcgcgttccacttacactatgccgcccgatcacggtgctgctctcgtcaaaacagtgttaagagatgaacagctcacggcaatttggaaacaagagttgagtgaaatgcagcaacgtttgttaactctgcgcaaaaatttgtgtaatgagttgagaaatcaacacaatacgcgacaattcgacttcattgagagccatagaggcatgtttactgtactgggattcagtgcagagcagatgggaaggctgcgtgaagagtttgcgatttatggtgtcgcagatggcagaattaatatcgcagggctgaccgaaaaagacattccttatgtggccaatgctattattcatgtgtcgtaa

SEQ ID NO: 54851 - protein, 404 aa, Vibrio cholerae O1 biovar eltor str. N16961
MLPEFQRVVTFMFTHLPAPVLDPILSLSVAFRNDPRPQKVDLGIGVYKNSLGETPIMRAVALAQDKVVASQKTKSYVGLAGCEEFNQSMMQLVLGSTLDTERTIAIQTPGASGALRMLGDLMRVAQPDTTVWITDPSYVNHKPVMEAAGLKVRYYRYFSRETKMVDTEQMLADLAQAGTKDVVLLHGCCHNPTGADIDFSAWQAITELAQKNGFIPFVDIAYQGFGDGLEQDAQGLRYMAERMEEMLITTSCSKNFGLYRERTGAAIVIGKNQQEVTNARGKMLTLARSTYTMPPDHGAALVKTVLRDEQLTAIWKQELSEMQQRLLTLRKNLCNELRNQHNTRQFDFIESHRGMFTVLGFSAEQMGRLREEFAIYGVADGRINIAGLTEKDIPYVANAIIHVS

SEQ ID NO: 54852 - DNA, 1191 bp, Pasteurella multocida subsp. multocida str. Pm70
  CDS (1)..(1191)
atgtttgaaaatattaccgccgcgccagctgatccgattttaggtttaggggaatcatttaaagcggaaacgcgcgataataaaatcaatcttggcattggtgtatataaagatgcgaaaggcaatacaccaattatgcgtgcggtcaaagaggcagaaaagcgcttatttgatcttgaaatgagcaaaaattatttagctattgacggggtcgcagaattcaatgcctgtacgaaagaattgttatttggcgcagattcagagatagttaaacaaggtcgtgcaaaaaccgttcaaagtttaggtggtactggtgcattacgtatcgcagcagagtttattaaacgccaaactaaatcacaaaatgtttggattagcacaccaacttggccaaaccataatgcgatttttaatgctgtcggcatgacgattcgtgaataccgctattatgatgcagaaaataaatgcttagattgggataacttaattgctgatttaagcaatgcgggggaaggcgatgttgttttactacatggttgctgtcataacccgactggaattgaccctactccagcacaatggcaacaattagccaagatgtcggaagaaaaaggttggttaccgttatttgactttgcttaccaaggttttgcaaatggtctcgaagaagatgcgtttggtttacgtacctttgccaaaaatcataaagaattattagtcgcaagttcttattctaaaaactttggtctttatagcgagcgcgttggtgctttcacgttagtggcagaaacagagcaaatagccgcgacggcactcacgcaagtcaaaaccattattcgtacgctctattctaacccagcatcacatggcgcaacgacagtttctatggtattaaaagacagtcagttacgtgccgagtgggaaaacgaattaaccgaaatgcgtgaacgtattaagcaaatgcgtagccaatttgttgaattattgaaagcatttgcttcagaacaagattttagttttattattgatcaaaatgggatgttctctttctgtggcttaaatccagcacaaatggatcgtttaaaagaggaatttgccatttatgccgtgcgttctggtcggattaatgtcgcaggcattactgaacagaatattcgttatctgtgtgaaagtattgcgaaagtcctttaa

SEQ ID NO: 54853 - protein, 396 aa, Pasteurella multocida subsp. multocida str. Pm70
MFENITAAPADPILGLGESFKAETRDNKINLGIGVYKDAKGNTPIMRAVKEAEKRLFDLEMSKNYLAIDGVAEFNACTKELLFGADSEIVKQGRAKTVQSLGGTGALRIAAEFIKRQTKSQNVWISTPTWPNHNAIFNAVGMTIREYRYYDAENKCLDWDNLIADLSNAGEGDVVLLHGCCHNPTGIDPTPAQWQQLAKMSEEKGWLPLFDFAYQGFANGLEEDAFGLRTFAKNHKELLVASSYSKNFGLYSERVGAFTLVAETEQIAATALTQVKTIIRTLYSNPASHGATTVSMVLKDSQLRAEWENELTEMRERIKQMRSQFVELLKAFASEQDFSFIIDQNGMFSFCGLNPAQMDRLKEEFAIYAVRSGRINVAGITEQNIRYLCESIAKVL

SEQ ID NO: 54854 - DNA, 1173 bp, Pseudomonas aeruginosa PAO1
  CDS (1)..(1173)
atggctacctcctatagcgcgcgcagtcgggccatcgagcctttccatgtcatggccctgctggcgcgggccaacgagttgcaggccgccggccacgatgtgatccacctggagatcggcgagccggacttcaccacggccgagccgatcgtcgaggccggacgcgccgccctggccgccgggcatacccgctacaccgccgcccgcggcctgccggcgctgcgcgaggcgatcgcgaaattctacggcgaacgctacggggtcgacctcgacccgcagcgcgtgctggtcactccgggcggctccggcgccctgctgctggccagcagcttgctggtcgaccccggccgccactggttgctcgccgacccgggctacccgtgcaacaggcatttcctgcgcctggtggaaggcgccgcgcaactggtgccggtggggccggacagccgttaccaactgacaccggatctcatcgagcggcactgggattcagacagtgtaggcgctctggtggcgacgccggcgaatccgaccgggaccctgctcgatcgcgacgaactggccggcctgtcgggcgccttgaaggcccgcggcgggcacctggtggtggacgagatctatcacggcctgacctatggcgtggacgccgcgtcggtgctggaagtcgacgacgacgctttcgtcctgaatagtttttccaagtatttcggcatgaccggctggcgcctgggctggctggtggcgccgacagcggcggtgcctgaactggagaagctggcgcagaacctctacatcagcgcgccgagcatggcccagcaggccgcgctggcctgtttcgagccgaccaccattgccattctcgaagagcgtcgcgaagagttcgcccgccgtcgcgacttcctcctgccggccctgcgcgagctgggtttcggaatcgccgtggagccggaaggcgccttctatctctacgccgatatcagcgcgttcggcggcgatgcctacgccttctgcaagcacttcatcgagaccgagcacgtggccttcactccggggctggatttcggccgccaccaggccggccaccacgtgcgtttcgcctatacccagaacctgccgcgcctgcaggaagcggtggagcggatcgcccgcggcctgaagaactggcggccctga

SEQ ID NO: 54855 - protein, 390 aa, Pseudomonas aeruginosa PAO1
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPTAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLPRLQEAVERIARGLKNWRP

SEQ ID NO: 54856 - DNA, 1194 bp, Neisseria meningitidis MC58
  CDS (1)..(1194)
atgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaa

SEQ ID NO: 54857 - protein, 397 aa, Neisseria meningitidis MC58
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQVKTIIRTLYSNPASHGANTIALVLKNDDLKAQWIAELDEMRGRIKAMRQKFVGLLKAKGASQNFDFIIKQNGMFSFSGLTPEQVDRLKNEFAIYAVRSGRINVAGITDNNIDYLCESIVKVL

SEQ ID NO: 54858 - DNA, 1194 bp, Neisseria meningitidis Z2491
  CDS (1)..(1194)
atgtaccgacacatcgaatactatcccggcgacccgattttgagtttggtcgaaaccttcaaaaacgacccgcgccccgaaaaagtcaatttgagcataggcatttatttcgacgacgaaggcaaaatgcccgtgttggaatccgtgagccgagccgaaaccgcccgtgccgccgcgcctgcgccgtcgccctacctgccgatggaaggcttggacacttaccgcagcgcggtgcagcatttattgttcggcaaagacaaccctgcgctcgcgcaaggacgcatcgctaccgtacaaaccttgggcggctcgggcgcgctcaaagtcggagcagatttcctgcaccgctggtttcctgaagcgcgcgcctacgtcagcgacccgacttgggacaaccattgcggcatttttgaaggcgcaggtttcgaggtcggcacttacccatattacgaccctgccactgtcggcgtgaaattcgacgaaatgaccgcgtttttcaacaccctgcccgaaaacagcgtcctgatcctccatccctgctgccacaacccgaccggcgtggatatgtcggaacaacaatgggacgaagtgttgcacatcatcaaaacgcgcaaactgattccgtttatggacatcgcctaccaaggcttcggcggcgatttggacagcgatgcctacgccgtccgtaaagcggtggaaatggaattgcccttgttcgtcagcaattccttctcaaaaaacctgtcgctctacggcgagcgcgtcggcggcttaagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccgatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 54859 - protein, 397 aa, Neisseria meningitidis Z2491
MYRHIEYYPGDPILSLVETFKNDPRPEKVNLSIGIYFDDEGKMPVLESVSRAETARAAAPAPSPYLPMEGLDTYRSAVQHLLFGKDNPALAQGRIATVQTLGGSGALKVGADFLHRWFPEARAYVSDPTWDNHCGIFEGAGFEVGTYPYYDPATVGVKFDEMTAFFNTLPENSVLILHPCCHNPTGVDMSEQQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPDRDFTYFIKQRGMFGYTGLSVEQVRRLRDEFAVYLLDSGRMCVAGLNTSNTDYVARAFAEVLK

SEQ ID NO: 54860 - DNA, 1203 bp, Chlamydia muridarum
  CDS (1)..(1203)
gtgagtctttttgaacagttaccttctttctctccggattctattcttggtttagcacaagcttttcaagaagatcctcgtgaggataaaattaatttattactgggtacttacgagcgagaaaaaagccgatacggaggattctcaagcgtcagaaaggctcaaacagtgttttttggtgatgagaaagataaaaactatcttcccatcagaggatcctcagtttttttagaccagatggctgctctatgttttggcgagattgatgctaatcgatggactggagtgcaagctgttggtgggactggagccttacatttgggcgccttagtgtatgctaaatcttctcttgcaggtaaagtctatatcccagctcaaacttgggggaaccactctagaattttttctcgtctaggattgtccctagaacattatccctactatgatcaagaaaaaaaagatctcgatttgcaaggattaaaagcatctcttcgggatgctcctgaggcttctttaattcttttacattgttgttgtcataaccctacagggaaggatattcccctttctgaatggcctgaaattattgctattataaaggacagaggcctcattcctttctttgatatggcttatttaggttttgctaacggaatagtagaggatcgccgacctgttcggctttgcatagaggctggagttgctacttttgttgcaggaagttgtagtaaaaacttctcattatatggttctcgggtaggattttttggggttgttcaccaagataaaacggatttgagcaggatactttctttcttggaagagcagatccgtggggaatactcttctcctgctagagaaggtgttgcaatcgttacctctatattagagaatccctacttgcgacaagagtgggggcttgaactgaatggtattcgccagtctttggaagaaattcgagcgaattttgttattgcaatgagagaagtagcgggacattcttttgatttcatcgcgtctcagaaaggattttttgggtatccaggtttttcaaaagagcaggttgtgttccttagagaagagcttggtatttatacaacagctggtggaagattcaatttaaatggcattacagataaaaatataaatcgtgttatccacggttttgctaaggcctatgaatactctcggtccgtatcataa

SEQ ID NO: 54861 - protein, 400 aa, Chlamydia muridarum
MSLFEQLPSFSPDSILGLAQAFQEDPREDKINLLLGTYEREKSRYGGFSSVRKAQTVFFGDEKDKNYLPIRGSSVFLDQMAALCFGEIDANRWTGVQAVGGTGALHLGALVYAKSSLAGKVYIPAQTWGNHSRIFSRLGLSLEHYPYYDQEKKDLDLQGLKASLRDAPEASLILLHCCCHNPTGKDIPLSEWPEIIAIIKDRGLIPFFDMAYLGFANGIVEDRRPVRLCIEAGVATFVAGSCSKNFSLYGSRVGFFGVVHQDKTDLSRILSFLEEQIRGEYSSPAREGVAIVTSILENPYLRQEWGLELNGIRQSLEEIRANFVIAMREVAGHSFDFIASQKGFFGYPGFSKEQVVFLREELGIYTTAGGRFNLNGITDKNINRVIHGFAKAYEYSRSVS

SEQ ID NO: 54862 - DNA, 1203 bp, Xylella fastidiosa 9a5c
  CDS (1)..(1203)
gtgcccttatttacagatgtggaattggttccaggtgatcccattctgagcctcaacgatacttataacgccgatacacgtaccaacaaggtcaatttgggtattggcatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagtcgactcccccttgttgacggctggccgtgtggcgacctcacagactattggaggttctggggcattgcgggtgactgctgaggtactgaagcaggtgctaccacatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggggggctgtcgatcgttgcttccaatacggagcaagcccaagcaatccagtcacaagtaaagcgtattatccgtacgatttattccagtccgtcggcacacggcgcctacttggtcgcaggtgtgctcaacagtcatgagctgcggacgctgtgggagcaggagttaacccagatgcgtgaacgtatccacgggttgcgtgcgggtttggttgctcgattgacggcgctgggtgcgccggagtttgatttcatacaacgtcaagcaggcatgttttcgtattcggggctgagcaagatccaggtggatcgtttgcgcgacgagttcgggatttatgcggtcagtagtggacgtatctgtgtggctgcgttgagtcagcacaaattggaatacgtggcgcaggctgtggtgaaggtgcatcaaggctga

SEQ ID NO: 54863 - protein, 400 aa, Xylella fastidiosa 9a5c
MPLFTDVELVPGDPILSLNDTYNADTRTNKVNLGIGIYCDESGCIPLLRAVQQVEEQLAKHPKPRGYLPIDGLPAYIKATQQLLFGVDSPLLTAGRVATSQTIGGSGALRVTAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPSAHGAYLVAGVLNSHELRTLWEQELTQMRERIHGLRAGLVARLTALGAPEFDFIQRQAGMFSYSGLSKIQVDRLRDEFGIYAVSSGRICVAALSQHKLEYVAQAVVKVHQG

SEQ ID NO: 54864 - DNA, 1194 bp, Mycobacterium tuberculosis CDC1551
  CDS (1)..(1194)
atgacggtgtcgcggctgcggccgtatgcgaccacggtgttcgccgaaatgtccgcgctggccacccgtatcggcgcggtcaacctgggacagggctttcccgacgaggacggcccgccgaagatgctgcaggccgcccaagacgccatcgccggcggcgtcaaccagtacccgcccggccctggaagcgctccgctacggcgggccatcgccgcccagcggcggcgccatttcggcgtcgactacgaccccgagaccgaggtgctggtcacggtcggagccaccgaggccatcgccgcagcggtgctcggactggtcgaaccgggctcggaggtgttgctgatcgagccgttctacgactcctactcgccggtggtggcgatggccggcgcccaccgcgtgaccgtaccgctggtgcccgatggccgcggcttcgccctagacgccgacgcgctgcgacgcgcggtgaccccgcgaactcgggcgctgatcattaactcgccgcacaatccgaccggtgcggtgctgagcgcgacggaactcgcagccatcgccgagatcgcggtggcggcgaaccttgtggtgatcaccgacgaggtgtacgagcacctagtgtttgaccacgccagacacctgccgctggcgggtttcgacggcatggccgagcgcacgatcaccatttccagtgcggccaagatgttcaactgcaccggctggaaaatcggatgggcttgcggcccagccgaactcatcgccggggtgcgcgccgcaaaacagtacctgagctatgtgggcggcgcaccgtttcagcctgcggtcgccctcgcgctagacaccgaagacgcctgggtggcggcccttcggaactcgttgcgggcccggcgcgaccggctggcagcgggcctgacggagatcggcttcgcagtgcacgacagctacggcacgtacttcctatgcgccgacccgcgcccgttgggttatgacgacagcaccgaattctgtgcggcgctaccggagaaagtcggggtggccgccatcccgatgtcggcgttctgcgaccccgccgcaggacaggcctcacaacaagccgatgtgtggaaccacctggtgcgcttcaccttctgcaaacgagacgacaccctcgacgaggcaatcaggcgactgagcgtgctcgccgagcgacccgctacctag

SEQ ID NO: 54865 - protein, 397 aa, Mycobacterium tuberculosis CDC1551
MTVSRLRPYATTVFAEMSALATRIGAVNLGQGFPDEDGPPKMLQAAQDAIAGGVNQYPPGPGSAPLRRAIAAQRRRHFGVDYDPETEVLVTVGATEAIAAAVLGLVEPGSEVLLIEPFYDSYSPVVAMAGAHRVTVPLVPDGRGFALDADALRRAVTPRTRALIINSPHNPTGAVLSATELAAIAEIAVAANLVVITDEVYEHLVFDHARHLPLAGFDGMAERTITISSAAKMFNCTGWKIGWACGPAELIAGVRAAKQYLSYVGGAPFQPAVALALDTEDAWVAALRNSLRARRDRLAAGLTEIGFAVHDSYGTYFLCADPRPLGYDDSTEFCAALPEKVGVAAIPMSAFCDPAAGQASQQADVWNHLVRFTFCKRDDTLDEAIRRLSVLAERPAT

SEQ ID NO: 54866 - DNA, 1188 bp, Chlamydophila pneumoniae AR39
  CDS (1)..(1188)
atgagtttttttaatcacataccaacattttctccggatgctattttaggtttgcagaacgttttctttgcagataagcgtcccgaaaaggttaaccttgtgattggtgtttatgagcatccgcaaaagcgttacggcggcttgtcttgtatacgtaaggcacaaactgtcattttggaagaagaacaaaataagagttatcttcctatttcagggttgcaaatatttttagatgagatgcgtgagctggtttttggtgctgtagatccgagtgctatagtcgggtttcagtctttaggaggtacaggagcgctacacttgggagcccggcttctttccgtggcaaaaggatctggtaaggtttatgttcccgagcagacttggagcaatcatatacgcattttctctcaagagggtcttgaggtaatccgatatccttattatagcaaagaacaaaaacagctgttatttgaacccctgatcgcatttttgaaggaagtagaaaagaattccgttatcttattgcatggttgttgtcacaaccctacaggtgtagattttactgaagatatgtggaaagaactcgccatcttaatgaaagaaagagagttaattccattttttgataccgcataccaaggttttgctcacggcatagagttggatagaaaacctatagaaatttttatatcagagggaaatacggttcttgtcgctgcttcatcaagcaaaaactttgctctttatggtgagcgtgtaggatattttgctgttcacagtacttttactgatgagttggttaaaattcacagtttcttagaagaaaaaattcgaggggaatactcttcaccacaacgttggggtgtagaaattgtttctacaattttgagtaatccatatttgaaagaagaatggcaatcagaactcaattttataagagagtctttgggtaaaatgagaacaagatttgttcaagctttgcgtaaggttgccggtcatacatttgactttttattgtcccaacatggattctttgcataccctgggttttccgataaacaggtgctctttttaagagaacaacacgctgtttatacaacagcgggaggaagaatgaatttaaatggaattacggaaaaaaatatagatcatgtagtgcaaagttttattcaagcttatgagctatag

SEQ ID NO: 54867 - protein, 395 aa, Chlamydophila pneumoniae AR39
MSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 54868 - DNA, 1218 bp, Plasmodium falciparum 3D7
  CDS (1)..(1218)
atggataagttattaagcagcttagaaaatatcgaagtcgacaatatcttaaaaacggcaagagagtttaaggaagatacatgtgaggagaaaataaatttatccatcggtgtgtgttgtaatgatgatggagacttacatatatttgatagtgtattaaatgccgataagttagtaacagaaaattataaagagaaaccatatttgttaggtaacggtacagaagatttttcaacattaacacagaatttaatatttggtaataattccaaatatatagaagataaaaaaatatgtacaattcaatgtattggaggtactggtgctatttttgttttattagaatttttaaaaatgttaaatgttgaaactttatatgttacaaatccaccttatattaatcatgtgaatatgattgaatcaaggggatttaatttaaaatatataaatttttttgattataatttgatagatataaattatgatttatttctaaatgatcttagaaatataccaaatggatcctcagttattttacaaatatcttgttataatccttgtagtgttaatattgaagaaaaatattttgatgaaataatagaaattgttttacataaaaaacatgttattatctttgatatagcttatcaaggatttggacatacaaatttagaagaagatgtcttacttattcgaaagtttgaagaaaaaaatatcgccttttcggtatgtcaatccttttcaaaaaatatgtcgctttatggagaaagagcaggtgctcttcatattgtttgtaaaaatcaagaagaaaaaaaaatcgtttttaataatttatgttttatcgtacgtaaattttattcgtctcctgttatacatacgaatcgtattctatgccaacttttaaataatcaaaatttaaaattaaattggattaaagaacttagtcaattatcacaacgtattacgaataatagaatcctattctttaataaattagaaacatatcaaaaaaaatataatctaaattatgattggaatgtctataaaaaacaaagaggccttttttcattcgttcctctactagccaaaattgctgagcatttaaaaacacatcatatttatataattaataatggtagaataaatgtctccggaataaccaaaaataatgtcgattatatagccgacaaaatttgtctttcgctaagtcaaatatga

SEQ ID NO: 54869 - protein, 405 aa, Plasmodium falciparum 3D7
MDKLLSSLENIEVDNILKTAREFKEDTCEEKINLSIGVCCNDDGDLHIFDSVLNADKLVTENYKEKPYLLGNGTEDFSTLTQNLIFGNNSKYIEDKKICTIQCIGGTGAIFVLLEFLKMLNVETLYVTNPPYINHVNMIESRGFNLKYINFFDYNLIDINYDLFLNDLRNIPNGSSVILQISCYNPCSVNIEEKYFDEIIEIVLHKKHVIIFDIAYQGFGHTNLEEDVLLIRKFEEKNIAFSVCQSFSKNMSLYGERAGALHIVCKNQEEKKIVFNNLCFIVRKFYSSPVIHTNRILCQLLNNQNLKLNWIKELSQLSQRITNNRILFFNKLETYQKKYNLNYDWNVYKKQRGLFSFVPLLAKIAEHLKTHHIYIINNGRINVSGITKNNVDYIADKICLSLSQI

SEQ ID NO: 54870 - DNA, 1350 bp, Caenorhabditis elegans
  CDS (1)..(1350)
atgctggcattcttcagaaggttcatgtcaacgactactgtaactgctcaaccagtgctcccgtggttcagaaatgtgccgctagcgcctgctgatccaattctaggagttactgaagcattcaagaaggatacgaatccgaataagattaatttaggagttggagcatatcgtgatgatcagggaaaaccattcgtgctccgagcggtccgcgaagctgagcagcaaattatagatgctaaaatggacaaagagtactcaacaatcactggagttccagaatttgcgccattggctgcgaaactcgctttcggcgacaattccgaagtgattcgcgatggaagagtcttcacaactcaatcgatatccggaactggtgctttgagaattggaggacaatttgtggaaaagtttattccatccaagactttgttttatccaacaccaacttgggctaatcatttgccagtttttagagaaaatcgaagaaccatacttttcgattttttgattttccgtaaagcaaaaaatcaaaatttccatgcacttgttgtattttttcccctaaattctggtctttcgattcaaccataccgttactacaatcaagaaactcttggatttgatgttgaaggagctctcgaagatatttcaaagatgccagaaggatctgttatacttttgcatgcttgtgcacataacccaactggtgttgatcctactaaggagcaatggaaaaagctgagccaagtgctgaaagaacgaaaaattcttccattcttcgatatggcttatcaaggatttgcatcaggagacgttgacgatgacgcatttgctcttcgtcatttcatagaacaaggacacaatgttctcgttgctcaatcatttgcaaaaaatatgggattgtacggagaacgtgttggtgcattttcgattgtttgtgattctgctgaagaagcgattcgtgttggatctcaaatgagaattatcattcgtccaatgatctcaatgccaccacttcatggagcaagaattgcttcacggattttgagtaatccagagttgaagaaatcttggctggaagatgtgaaactaatggctgaccgtatcaaatcaatgcgtacggctctaaaagacggcctgaaagctgaaggatctactctcaactgggatcatattaccaatcaaattggaatgttttgtttcactggaatcaatgagaaacaagttcaaaagctcatcaaagagcactcagtgtacttgacaaatgatggacgtatttctatttctggtattaatactggaaatgttgcatatttggctaaagctctccatgacgtcaccaagtaa

SEQ ID NO: 54871 - protein, 449 aa, Caenorhabditis elegans
MLAFFRRFMSTTTVTAQPVLPWFRNVPLAPADPILGVTEAFKKDTNPNKINLGVGAYRDDQGKPFVLRAVREAEQQIIDAKMDKEYSTITGVPEFAPLAAKLAFGDNSEVIRDGRVFTTQSISGTGALRIGGQFVEKFIPSKTLFYPTPTWANHLPVFRENRRTILFDFLIFRKAKNQNFHALVVFFPLNSGLSIQPYRYYNQETLGFDVEGALEDISKMPEGSVILLHACAHNPTGVDPTKEQWKKLSQVLKERKILPFFDMAYQGFASGDVDDDAFALRHFIEQGHNVLVAQSFAKNMGLYGERVGAFSIVCDSAEEAIRVGSQMRIIIRPMISMPPLHGARIASRILSNPELKKSWLEDVKLMADRIKSMRTALKDGLKAEGSTLNWDHITNQIGMFCFTGINEKQVQKLIKEHSVYLTNDGRISISGINTGNVAYLAKALHDVTK

SEQ ID NO: 54872 - DNA, 1074 bp, Caenorhabditis elegans
  CDS (1)..(1074)
atgcggctatctttctttgatggaattcatgttgcttcgccaatcaaagagctccatacatcggaactcttccagaaagaaatttgccctgtgaaaataaatcttgcaatagaagcttatcgcacggaagatggagagccgtgggttttgccagtggttcgagaaatcgaacttaaattccctcacgagcctcatcacaatcatgagtacctaccgattcttggacatgatggattctgcaaatcagccaccgctttgctactcggaaatgattctttggctatcaaagagggaagatcatttagtgttcagtgcatctctggtacaggtgccatatgtgttggagcagagtttcttgctcaagttcttagtatgaagacgatttatgtcagcaatccatgctgcctgtgctataatccaacaggaatggacccaactcgagagcaatggatacaaatggcgcaagtcatcaaacagaagaatcttttcactttttttcatattgctgatcagggattagcttctggcgacgctgatgcagatgcttgggctgttcggttctttgtcgaacagggtttggaaatgattgtctctcaatctttctcaaagaattttgggctttacaatgatcgtgttggaagccttactgtgatcgtgaacaaaccaagtcatattgcgaacctaaaatcccaactgacacttgttaatgtttctaatttttctaaccctccagcttacggagcacgtattgtgcatgagattctcaagtcgccgaagtacagagaacaatggcaaaattccattaaaatgatggcttttcgtattaagaaaacaagacaagaactgattcgagagttgaatatgcttcaaacttctggaaaatgggatcgtattactcaacaatcggggttgttcagttataccggattgacgccttgtcaagtcgaccatctcatagcccatcacaagatctaccttctcagtgacggtcgtattaatatctgcgggcttaacatgagtaacttggattatgtggctagagcaattgatgacactgtacgaacaattcattaa

SEQ ID NO: 54873 - protein, 357 aa, Caenorhabditis elegans
MRLSFFDGIHVASPIKELHTSELFQKEICPVKINLAIEAYRTEDGEPWVLPVVREIELKFPHEPHHNHEYLPILGHDGFCKSATALLLGNDSLAIKEGRSFSVQCISGTGAICVGAEFLAQVLSMKTIYVSNPCCLCYNPTGMDPTREQWIQMAQVIKQKNLFTFFHIADQGLASGDADADAWAVRFFVEQGLEMIVSQSFSKNFGLYNDRVGSLTVIVNKPSHIANLKSQLTLVNVSNFSNPPAYGARIVHEILKSPKYREQWQNSIKMMAFRIKKTRQELIRELNMLQTSGKWDRITQQSGLFSYTGLTPCQVDHLIAHHKIYLLSDGRINICGLNMSNLDYVARAIDDTVRTIH

SEQ ID NO: 54874 - DNA, 1143 bp, Clostridium perfringens str. 13
  CDS (1)..(1143)
atgaataaaaatgttattgggatagaaatatcaggaataagaaaattctataatgaagttgtaaaattcccagaagctatatcattaactctaggacagccagattttcctgttccagaaaaagttaaagaagctatgataagggctattgaagaaggaaagacaacatatacagctaatgctggtatagttgaattaagagaagaaatatcaagtttattaaagaataattttgatattgattttagtaaggatgaaataattataactgtaggtggaagtgaagggctatatgcagctatgacagcccttttaaatcctggagagaaggttttagttccatcaattgcatatccagcttatgagagcataagtaaaataatagggtgtgaagttataaattatgatttaaatgaagatttttcagttaatatagagagtttaaaagaaggaataaaagaagggggaaaacttttagtactttcttatccatgtaatcctactggggcattacttagtaaaaaaagtagagatgagttaatagagattataaaagaaaatgatatattagtattaactgatgaaatttattcatctctatgctttgaagaggagtattattctgtagctcaatgcaaagatataaaagaaaaaataatatatgtaagtggattctctaagatgttttcaatgacaggtcttagaattggatatgtagcatgtcctaaaaaaatatatgatcaaattataaaggttcatcaatacaattcttcatgtgcaacatctatttctcaatggggagccttagaaggattaaaatcttgtatgaatgatgttgaaaatatgaaagagtcttttaaagaaagaatgaattttacttataaaagattaaaaagtatgggattagaagtggaaaaacctaaaggagcattttatatttatcctaatataagtaagtttggattaacatcagaagaattttgtcatagattacttaaagaaggcaaagttgcctgtgtaccaggagatgcctttggaaagggtggagaaggatacattagaatatcttactgttatagtaaagatgaacttgaaagagccttagataaattagaggcttttgtaaaaactctaaaaaagtaa

SEQ ID NO: 54875 - protein, 380 aa, Clostridium perfringens str. 13
MNKNVIGIEISGIRKFYNEVVKFPEAISLTLGQPDFPVPEKVKEAMIRAIEEGKTTYTANAGIVELREEISSLLKNNFDIDFSKDEIIITVGGSEGLYAAMTALLNPGEKVLVPSIAYPAYESISKIIGCEVINYDLNEDFSVNIESLKEGIKEGGKLLVLSYPCNPTGALLSKKSRDELIEIIKENDILVLTDEIYSSLCFEEEYYSVAQCKDIKEKIIYVSGFSKMFSMTGLRIGYVACPKKIYDQIIKVHQYNSSCATSISQWGALEGLKSCMNDVENMKESFKERMNFTYKRLKSMGLEVEKPKGAFYIYPNISKFGLTSEEFCHRLLKEGKVACVPGDAFGKGGEGYIRISYCYSKDELERALDKLEAFVKTLKK

SEQ ID NO: 54876 - DNA, 1230 bp, Schizosaccharomyces pombe
  CDS (1)..(1230)
atgtcagactacgggtttgcaaatattgaggaagctaaggcagatgcaatttttaaattaaatgctcaataccatcaggatgaagatcccaagaaggttaacatgagtgttggcgcctatcgtgacgatactggtaagccttggattttgcctgcagttaaaaaagcatctaaaatagtggaagaacaggcaagcttcaaccatgaatatttaccaattgctggattgcctcgtttcactaaggctgcggctgaagttcttttcagacccaatcctcatttattgtccgaggaccgtgttgcatctatgcagtcagtctctggtactggtgccaattttcttgctgctagtttcattgagactttctatgtaaagcacactggagcccatgtatacatctccaaccctacttggcctgtccatcgcactttgtgggaaaaattgggagtcactgtagatacatatccttattgggatgccaagaatagatcttttgattacgaaggcatgctaagtaccattaaatctgctcccgaaggaagtatatttttacttcatgcttgtgctcacaatcctactggtattgaccccactagggaacaatggctttctatattcgagagtctgctttctcgcaagcatctggtagtttttgacattgcttatcaaggttttgccagtggtgatctgaatcgtgactcttgggctctaaacgagtttgtcaaatataacaaggactttttcgtttgtcagtcatttgctaaaaatatgggtctttatggtgaacgtactggttgcatgcattacgttgcaaaggacgcttccactaaaaacaaggtcttatctcaattgtgtattgttcaacgtaacaccatttctaaccctcccgcttacggtgcacgtattgctgccgaaattcttaacagtcctcaattgtttgctgaatgggaacaagatttaaagactatgtcttctagaatcattgagatgaggaaacgtcttcgcgattctcttgttgcactcaaaacccccggttcttgggatcatattacacaacaaattggaatgttttcttttaccggtttaacgcctgcacaagtccaattttgccaggagcggtaccatctttatttcagtgcaaatggtcgtatttctatggctggtttgaacaattctaatgtagagcatgttgcacaggcatttaaccatgctgttcgcgagttgccttaa

SEQ ID NO: 54877 - protein, 409 aa, Schizosaccharomyces pombe
MSDYGFANIEEAKADAIFKLNAQYHQDEDPKKVNMSVGAYRDDTGKPWILPAVKKASKIVEEQASFNHEYLPIAGLPRFTKAAAEVLFRPNPHLLSEDRVASMQSVSGTGANFLAASFIETFYVKHTGAHVYISNPTWPVHRTLWEKLGVTVDTYPYWDAKNRSFDYEGMLSTIKSAPEGSIFLLHACAHNPTGIDPTREQWLSIFESLLSRKHLVVFDIAYQGFASGDLNRDSWALNEFVKYNKDFFVCQSFAKNMGLYGERTGCMHYVAKDASTKNKVLSQLCIVQRNTISNPPAYGARIAAEILNSPQLFAEWEQDLKTMSSRIIEMRKRLRDSLVALKTPGSWDHITQQIGMFSFTGLTPAQVQFCQERYHLYFSANGRISMAGLNNSNVEHVAQAFNHAVRELP

SEQ ID NO: 54878 - DNA, 1314 bp, Schizosaccharomyces pombe
  CDS (1)..(1314)
atgttggccaggaatttgcgttgtttgcatccaaatacatttgcatcgttaaaaaccaacgtttcctaccatggagtaaaatgcttggcaagtcagagcaagcgtggattcaaggtttgggcagatgtacctatgggaccaccggatcccatctttggtattacagaggcctataaaaaggatggagatgttaagaaaatgaacttgggtgctggtacatatcgtgatgatgccggaaagccttatgttctgcccagtgttcgtcaggcagaaactgagctgttgagtcagaaactcgacaaagaatatgcacccatcacaggaattcccagtttccgtgtgcaagcaacaaaattggcttatggcgatgtttacgagtctataaaggataggctggtttctgctcaatccattagtggtaccggtgccttgtgtatagcagctaatttccttgcttcattttatccatcaaagactatttacgtatctgaccctacttggggaaatcacaagaatgtattttctcgagctggcttgaccgttaagtcctacaagtattatgatcctgctactcgtgggttggacattaaaggcatgttgtccgatttaacttcagctcctgatggctctattatattattgcatgcttgtgctcacaatccaactggtgtagatcctacgaaagctcagtgggatgatatcctcaaaacaatgcaaaagaaaaaccattttgctcttttagacatggcttaccaaggatttgccagtggtgattttgctcgtgatgcttatgccactcgtctgttcgcctccagcaatgtccccatgttactctgccaatcctttgctaaaaacatgggtctatatggtgaacgtgctggctgctttagcattttagccaacgatgctgaggaagccgctcgtatcgaaagccaaactaagattctcattcgtgctttgtattccaaccctcccgtcaatggggccagaattgccaaccatatattgagcaaccctgcacttcgtgaacagtgggctggtgaagttgtaggcatgtccgaacgtcttaagagtatgcgtaaggctcttcgcaacatccttgaaaaggaccttaagaataaacacagctggaagcatatcactgaccaaattggtatgttttgttatactggtttaaatccccagcaagttgatgttttggctaaacagtatcacatttacctcactaagaatggtcgtattagcatctccggtctcaacacttccaatgtaagatactttgccgaagctatcaatgccgttacttcgaattag

SEQ ID NO: 54879 - protein, 437 aa, Schizosaccharomyces pombe
MLARNLRCLHPNTFASLKTNVSYHGVKCLASQSKRGFKVWADVPMGPPDPIFGITEAYKKDGDVKKMNLGAGTYRDDAGKPYVLPSVRQAETELLSQKLDKEYAPITGIPSFRVQATKLAYGDVYESIKDRLVSAQSISGTGALCIAANFLASFYPSKTIYVSDPTWGNHKNVFSRAGLTVKSYKYYDPATRGLDIKGMLSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHITDQIGMFCYTGLNPQQVDVLAKQYHIYLTKNGRISISGLNTSNVRYFAEAINAVTSN

SEQ ID NO: 54880 - DNA, 1185 bp, Xanthomonas campestris pv. campestris str. ATCC 33913
  CDS (1)..(1185)
atggactcactgctttcgcccgtgtccggctatagccgccgcagccaggacatcgcgcccttccatgtgatggccctgctggcccgcgccaacgcactggaacaggccggccacgatgtcatccacctggaaatcggcgagccggacttcaccaccgctgcgcccgtggtggccgccggccaggctgcattggccgcaggccacacccgttacaccgccgcccgcgggctgcccgcgttgcgcgaggcaattgccgggttttacgcgcagcgttacggctgccacatcgatcccgagcgcgtgctggtcaccccgggaggctccggcgctttgctgctggccagcagcctgttggtcgacccgagcaagcattggttgctcgccgacccggggtatccgtgcaaccgtcacttcctgcgcctggtcgaagctggcgcgcagctggtaccggtgggcccggacagcgactaccaactgaccccggcgctggtggatgcctgctggacggccgacagcgttggcgcgttggtggcctcaccggccaaccccaccggcagcgtgctctcgcgtgcgcagttggccgccttgtcgcaggccttgcaggcgcgtggtggccacctggtggtggatgagatctaccacggcctgacctacggcctggacgcgcacagcgtgctggaagtggacgacagcgcgttcgtgctgaacagtttttccaaatacttcggcatgaccggctggcgcctgggctggctgatcgccccaccctctgcggtgcccgagttggaaaaactcgcgcagaacctctacatcagcgcctcgtccatcgcccagcatgcggccctggcctgcttcacgcccgagagcatcgccatcttcgaagcgcgccgcgccgagttccagcaacgccgcgattacctgttgcctgcactgcgcgcactgggcttcgacatcgccgtcgagccacaaggcgcgttctatctgtatgccgacatcagcgcattctccaaggacgcgcaggccttctgtacgcacttcctggaaaccgagcatgttgccttcactcccggcatcgacttcggcttccaccgcgccaaccagcacgtccgcatcgcctatacgcagagcctgccgcgccttgagcaggcggtggagcgcattgcgcgtgggttacggcacatctga

SEQ ID NO: 54881 - protein, 394 aa, Xanthomonas campestris pv. campestris str. ATCC 33913
MDSLLSPVSGYSRRSQDIAPFHVMALLARANALEQAGHDVIHLEIGEPDFTTAAPVVAAGQAALAAGHTRYTAARGLPALREAIAGFYAQRYGCHIDPERVLVTPGGSGALLLASSLLVDPSKHWLLADPGYPCNRHFLRLVEAGAQLVPVGPDSDYQLTPALVDACWTADSVGALVASPANPTGSVLSRAQLAALSQALQARGGHLVVDEIYHGLTYGLDAHSVLEVDDSAFVLNSFSKYFGMTGWRLGWLIAPPSAVPELEKLAQNLYISASSIAQHAALACFTPESIAIFEARRAEFQQRRDYLLPALRALGFDIAVEPQGAFYLYADISAFSKDAQAFCTHFLETEHVAFTPGIDFGFHRANQHVRIAYTQSLPRLEQAVERIARGLRHI

SEQ ID NO: 54882 - DNA, 1203 bp, Xanthomonas axonopodis pv. citri str. 306
  CDS (1)..(1203)
gtgtccttctttgcaaacgtggaacaggttccaggcgaccccatcctgggcctgaccgaggcctacaacgccgacagccgccccaacaaggtcaacctgggcgtgggcatctattacgacgaaaacgggcgcatcccgctgttgcgcgccgtgcacaagatcgagcagcagctcgcgcaggacgccaaaccgcggggttatctgcccatcgacggcctggccgcgtacgacaaggccacccaggagctgctgtttggcgccgactctgcgctggtgacctccggccgcgtggcgacctcgcagaccgtcggcggcagcggcgcattgcgcgtgggcgcggacctgctcaagaagctgctgcccaccgccaccatcgccatcagcaaccccagctgggaaaaccatcgcgcggtgttcggcgcggccggcttcgaggttgtcgattacacctacttcgatgccgccatccatggcctgaacttcgacggcatgctcgccgacctggccaagctcgaaccgggcaccgtggtgctgctgcacgcctgctgccacaaccccaccggcgccgacctgagcaaggaacagtggaagcaggtggccggcctgttgaaggaacgcaacctgttcccgttcgtcgacatcgcctaccagggcttcgacaagggcatcgaggccgatgcctatgcggtgcgcctgctggctgccgaaggcatcgacagctacgtggtcgccagttcctattccaagtcgttctcgctgtatggcgagcgcgtgggcgcgctgtcggtggtctcggccaccgccgccgaagccaaggcggtgcagtcgcaggtcaagcgcatcatccgcacgatctactccagcccgtccacgcacggcgccgccctggtggccggcgtgctgaccagcccggagctgcgcgatctgtgggagcaggaactgaccgagatgcgcgagcgcatccattccctgcgcgccgggctggtggaaaaactcgccacgctgggtgcgccggagttcgacttcatccagcgccaggccggcatgttctcgtactcgggcctgaccaagacccaggtggaccgcctgcgcgacgagttcgcgatctacgcggtcggcaccggccgcatctgcgtggcagcactgagccagcgtaacctggactacgtggcccaggccgtggccactgtcagccgggtgtag

SEQ ID NO: 54883 - protein, 400 aa, Xanthomonas axonopodis pv. citri str. 306
MSFFANVEQVPGDPILGLTEAYNADSRPNKVNLGVGIYYDENGRIPLLRAVHKIEQQLAQDAKPRGYLPIDGLAAYDKATQELLFGADSALVTSGRVATSQTVGGSGALRVGADLLKKLLPTATIAISNPSWENHRAVFGAAGFEVVDYTYFDAAIHGLNFDGMLADLAKLEPGTVVLLHACCHNPTGADLSKEQWKQVAGLLKERNLFPFVDIAYQGFDKGIEADAYAVRLLAAEGIDSYVVASSYSKSFSLYGERVGALSVVSATAAEAKAVQSQVKRIIRTIYSSPSTHGAALVAGVLTSPELRDLWEQELTEMRERIHSLRAGLVEKLATLGAPEFDFIQRQAGMFSYSGLTKTQVDRLRDEFAIYAVGTGRICVAALSQRNLDYVAQAVATVSRV

SEQ ID NO: 54884 - DNA, 1287 bp, Staphylococcus aureus subsp. aureus MW2
  CDS (1)..(1287)
atgaatcctttagcccaaagcttaaatgaacaacttcaacagtcaaatgcaactgcctttgcaatgttatctgacttaggtcaaaatatgttttatccaaaaggcattttatctcaatctgctgaagcaaagagtacaacatataatgcaactataggtatggcgacaaacaaagacggaaaaatgtttgcatcatctttagatgcaatgtttaatgatttaactccagatgaaatattcccttatgcgccaccacaaggcatcgaagaattacgtgatttatggcaacaaaaaatgttgcgtgacaatccagagctatcaatcgacaacatgtcactaccaattgttacgaatgcattaacacatggtttatctttagttggcgatttatttgtaaatcaaggtgacactatcttgttaccagatcataattggggtaattacaaacttgttttcaatacgagaaatggtgcaaaccttcaaacatatcctatctttgataaagacgggcattatactactgattcacttgtagaagctttacaatcatacaataaagataaagtcattatgattttaaattatcctaataatccgacaggttacacacctacgcataaagaagtgactaccatcgtcgatgcaattaaagcattagctgataaaggtacaaaagttatagctgttgtggatgacgcatactatggtttattctatgaagatgtgtatactcaatcattatttactgcattatctaatttaaattcaaatgcaatattacctgttcgtttagatggtgcaacaaaagaatttttcgcatggggattccgtgttgggtttatgacatttggaacgtctgatcaaacaactaaagaagtattagaagccaaagtaaaaggtcttatacgaagtaacatttctagtggacctcttccaacacaaagcgctgttaagcatgtattaaaaaataataaacaattcgataaagaaatcgaacaaaatattcaaacattaaaagaacgctatgaagtcactaaggaagttgtctatgctgatcaatatcattcacattggcaagcctatgactttaactctggatactttatggcaataaaagttcatgatgttgaccctgaagaacttcgtaaacatttaattgaaaaatattcaattggtgttattgcacttaatgcaacagatattcgtattgcgtttagctgtgtagaaaaagaagatatcccacatgtatttgattcaattgctaaagcgattgatgacttaagataa

SEQ ID NO: 54885 - protein, 428 aa, Staphylococcus aureus subsp. aureus MW2
MNPLAQSLNEQLQQSNATAFAMLSDLGQNMFYPKGILSQSAEAKSTTYNATIGMATNKDGKMFASSLDAMFNDLTPDEIFPYAPPQGIEELRDLWQQKMLRDNPELSIDNMSLPIVTNALTHGLSLVGDLFVNQGDTILLPDHNWGNYKLVFNTRNGANLQTYPIFDKDGHYTTDSLVEALQSYNKDKVIMILNYPNNPTGYTPTHKEVTTIVDAIKALADKGTKVIAVVDDAYYGLFYEDVYTQSLFTALSNLNSNAILPVRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEELRKHLIEKYSIGVIALNATDIRIAFSCVEKEDIPHVFDSIAKAIDDLR

SEQ ID NO: 54886 - DNA, 1266 bp, Homo sapiens
  CDS (1)..(1266)
atgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtggcttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttag

SEQ ID NO: 54887 - protein, 421 aa, Homo sapiens
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSGLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNSQQVEYLVRKKHIYIPKNGQINFSCINANNINYITEGINEAVLLTESSEMCLPKEKKTLIGIKL

SEQ ID NO: 54888 - DNA, 1191 bp, Shigella flexneri 2a str. 301
  CDS (1)..(1191)
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccttgaatttggtcgctgcactcaggaactgctgtttggtaaaggtagcgccctgatcaatgacaaacgtgctcgcacggcacagactccgggtggcactggcgcactacgcgtggctgccgacttcctggcaaaaaataccagcgttaagcgtgtgtgggtgagcaacccaagctggccgaaccataagagcgtctttaactctgcaggtctggaagttcgtgaatacgcttattatgatgcggaaaatcacacccttgacttcgatgcactgattaacagtctgaacgaagctcaggctggcgacgtagtgctgttccatggctgctgccataacccaaccggtatcgaccctacgctggaacaatggcagacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaatcgttgatcgcgcattcagccaaatgaaagcggcgattcgcgctaactactctaaccctccagcacacggcgcttctgttgttgccaccatcctgagcaacgatgcattacgtgcgatttgggaacaagagctgactgatatgcgccagcgtattcagcgtatgcgtcagttgttcgtcaatacgctgcaggaaaaaggtgcaaaccgcgacttcagctttatcatcaaacagaacggcatgttctccttcagtggtctgacaaaagaacaagtgctgcgtctgcgcgaagagtttggcgtatatgctgttgcttctggtcgcgtaaatgtggccgggatgacaccagataacatggctccgctgtgcgaatcgattgtggcagtgctgtaa

SEQ ID NO: 54889 - protein, 396 aa, Shigella flexneri 2a str. 301
MFENITAAPADPILGLADLFRADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSEIVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCESIVAVL

SEQ ID NO: 54890 - DNA, 1194 bp, Shewanella oneidensis MR-1
  CDS (1)..(1194)
atgattttctctcaggtagtgctcgctccagcagatcccatccttggtttaaccgatacttttaaagctgatccacgtcaagataaagtcaaccttggtgtcggcatttataaggatgaagcagggcagactccggtattgcaatcggttaagaaagcagaagccatactgctagaacaagagaagactaaaaactatttaggcatagaaggggtccaaacctacaaccgcgttgtacaagagttgttatttggtgaaggtagtgagctagtggcttctggccgtgccgcaaccgcccaagcgcctggtggtacaggggcattgcgtatagccgccgagtttttattgagaaacacgccatctcgcactatttgggtaagtaatcccacttgggctaaccatcaaaatatttttgaaactgcagggttaacggttaaagagtttggatattacaacgccagtgctcacgatatcgatttcgatggcatgatgaccgatctcgccaatgcacaggcgggtgacattattctactgcacggctgctgtcataacccaacgggtattgacttgactttagcgcaatgggatttagtggctaacctctgtgctgacaaacaattagtgcctttgtttgactttgcttaccaaggttttggaacaggtattgaagaagatgctgcaggcctgcgtttagtcgcttcaaaagttcctgagctgttagtcgcaaattctttctctaaaaactttgggctttataatgaacgtatcggtgctgtgactgtggttgctcacaatgcagatgaagctgttcgcgcttttagccaagtgaaacgtacaattcgggcaaactattcaaatcccccagcccatggtgcgttaattgttagcaccattttaagtgatgcagctttgaaagccctttgggtacaagagctgaccgaaatgcgtgagcgtatagcccttatgcgtactctatttgtgcagagcttaaaagatgagggtgtgactcaagattttagctttatttcgcgccaaaatggtatgtttagcttctctggcttgaataagtcgcaagtggcccgtttaaaagacgaatttggagtttatattgtcggttctggtcgtattagtgtggcgggtatgacgaaagccaatatgcctgcgatctgtaaagcgattgctcaggtcgtataa

SEQ ID NO: 54891 - protein, 397 aa, Shewanella oneidensis MR-1
MIFSQVVLAPADPILGLTDTFKADPRQDKVNLGVGIYKDEAGQTPVLQSVKKAEAILLEQEKTKNYLGIEGVQTYNRVVQELLFGEGSELVASGRAATAQAPGGTGALRIAAEFLLRNTPSRTIWVSNPTWANHQNIFETAGLTVKEFGYYNASAHDIDFDGMMTDLANAQAGDIILLHGCCHNPTGIDLTLAQWDLVANLCADKQLVPLFDFAYQGFGTGIEEDAAGLRLVASKVPELLVANSFSKNFGLYNERIGAVTVVAHNADEAVRAFSQVKRTIRANYSNPPAHGALIVSTILSDAALKALWVQELTEMRERIALMRTLFVQSLKDEGVTQDFSFISRQNGMFSFSGLNKSQVARLKDEFGVYIVGSGRISVAGMTKANMPAICKAIAQVV

SEQ ID NO: 54892 - DNA, 1191 bp, Shewanella oneidensis MR-1
  CDS (1)..(1191)
atgtttaactcactcatcgcaatgcctgcggatccgatccttggcttgttgacccagtaccgcgaagacacacatccacagaaagtagacttaggtgtcggcgtttataaagatcccgcgggaaacacccccattctcaattgtgtaaaaaaagccgagaaatttcgtttagaaaccgagacgacaaaggtctatatcggtccaactggttcgcctcagtttaataccctgatgacagagttagcctttggcagtgatcatagcgcgattatcgctaaccgtattcgtactgtttccacacctggcggtacgggcgctctgcgtgttgcgggtgactttattaagcgttgcaatcctaatgcggtgttgtgggtaagcgatcccacatgggctaatcatacaggtttattcgaagctgctgggatcacagttaaaacttatccctattatgactacgatagtaaatcgttgaaatttgacgagatgcttgctgcattatcgcaagtgagtcctgatgacgtagtgttattacacgcctgctgccataacccaagtgggatggatttgaccactgatcaatgggataaagtcgtcaccctcaccaaagagcaaggttttaccccgcttatcgacatggcttaccaaggttttggtgacggtgtcgatatcgatgcctacggcgtgcgtaaaatggctgcagcggtcgataatatgatcctgtgtagctcttgctcgaagaacttcggtctgtaccgtgagcgtatcggttcctgctctgtggttgcaaaggatgcgaacacggcaaacattgcgcaatctgtactgctttatgtggttcgctgcctctactctatgccacctgcccatggcgcggcgattgttgagacgattttaggatcaaaagaattaacccaagaatggcttgatgagctcaaagtgatgcgcgaccgtatcaatggtaaccgcgcgattttagttgaaaaactcaaagccaatggtgttgctcgcgactttagctttattgctcgccaaaaaggcatgttctctttccttggtgtaaatcctgagcaagtggcgcgtctgcaaaaagaatttagcatctacatggtgggttcaagccggatcagtatcgcggggatcagtgaagataacgtcgattatctcgcccaatcgatcgccaaagtgctttga

SEQ ID NO: 54893 - protein, 396 aa, Shewanella oneidensis MR-1
MFNSLIAMPADPILGLLTQYREDTHPQKVDLGVGVYKDPAGNTPILNCVKKAEKFRLETETTKVYIGPTGSPQFNTLMTELAFGSDHSAIIANRIRTVSTPGGTGALRVAGDFIKRCNPNAVLWVSDPTWANHTGLFEAAGITVKTYPYYDYDSKSLKFDEMLAALSQVSPDDVVLLHACCHNPSGMDLTTDQWDKVVTLTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSKELTQEWLDELKVMRDRINGNRAILVEKLKANGVARDFSFIARQKGMFSFLGVNPEQVARLQKEFSIYMVGSSRISIAGISEDNVDYLAQSIAKVL

SEQ ID NO: 54894 - DNA, 1296 bp, Drosophila melanogaster
  CDS (1)..(1296)
atgagtagaaccattattatgacgcttaaggacattgtgcatgtgtggtccaacgacccgggagaacggatgtgccgagcgaacagagtatcaacatggttctccgaggtgcagatgggcccacccgatgccatcttgggtgtcacggaagccttcaagaaggacaccaaccccaagaagatcaacttgggcgctggcgcctatcgcgatgacaacacccagcccttcgtgctccccagtgttcgggaggccgagaagagagtggtgagccgtagtctggacaaggagtacgccacaatcatcggcattcccgagttctacaacaaggccatcgagctggcattgggcaagggatccaagcgtttggcggccaagcacaacgtgaccgcccagtccatcagtggaactggagctctgcgcatcggagccgccttcctggccaagttctggcagggcaaccgcgagatctacatcccgtcgccatcgtggggcaaccatgtggccattttcgagcacgccggtctgccggtgaaccgataccgctactacgacaaggacacctgtgccctggactttggcggcctgatcgaggatctgaagaaaatccccgagaagagcattgttcttctgcacgcctgcgcccacaaccccactggagtggatcccactctggagcagtggcgtgagatctcggctctggtcaagaaacgcaatctgtatcccttcatcgacatggcctaccaaggcttcgccaccggagacattgaccgcgacgcccaggcggtccgcaccttcgaggccgatggccacgacttctgcctggcccagagtttcgccaagaacatgggattgtatggtgagcgcgctggcgccttcaccgtgctgtgctccgacgaggaggaggctgctcgcgtgatgtcccaagttaagatcctgatccgtggtctgtactccaatcccccggtgcacggagctcgtattgccgccgagatcctcaacaacgaggacttgcgcgcccagtggctgaaggatgtgaagctgatggccgaccgcatcatcgatgtgcgcaccaagctcaaggacaatctaattaagctgggatccagccagaactgggaccacattgtcaaccaaatcggcatgttctgcttcacgggcctgaagccggagcaggtgcagaagctgatcaaggatcacagcgtctatctcaccaacgatggacgtgtttcgatggcgggagtcaccagcaagaatgtcgagtacctggctgagagcatacacaaggttaccaagtaa

SEQ ID NO: 54895 - protein, 431 aa, Drosophila melanogaster
MSRTIIMTLKDIVHVWSNDPGERMCRANRVSTWFSEVQMGPPDAILGVTEAFKKDTNPKKINLGAGAYRDDNTQPFVLPSVREAEKRVVSRSLDKEYATIIGIPEFYNKAIELALGKGSKRLAAKHNVTAQSISGTGALRIGAAFLAKFWQGNREIYIPSPSWGNHVAIFEHAGLPVNRYRYYDKDTCALDFGGLIEDLKKIPEKSIVLLHACAHNPTGVDPTLEQWREISALVKKRNLYPFIDMAYQGFATGDIDRDAQAVRTFEADGHDFCLAQSFAKNMGLYGERAGAFTVLCSDEEEAARVMSQVKILIRGLYSNPPVHGARIAAEILNNEDLRAQWLKDVKLMADRIIDVRTKLKDNLIKLGSSQNWDHIVNQIGMFCFTGLKPEQVQKLIKDHSVYLTNDGRVSMAGVTSKNVEYLAESIHKVTK

SEQ ID NO: 54896 - DNA, 1245 bp, Caenorhabditis elegans
  CDS (1)..(1245)
atgagcgtttccaagaagcttttctctaccgccgtgcgaggaaagtcgtggtggtcgcatgttgagatgggaccaccagatgcgattcttggagtcaccgaggccttcaaagccgattcaaacccaaagaagatcaaccttggagtcggagcttaccgtgacgatcaaggaaagccatttgttctcccatcggtcaaggaagctgaacgtcaagtgatcgctgccaatcttgataaggagtacgccggaattgttggacttcccgagttcaccaagctctctgctcaactcgctcttggagagaactctgatgtgatcaagaacaagagaatcttcaccactcagagcatttctggaactggagcccttagaatcggatctgagttcctttctaagtacgccaagaccaaggttatctaccagccaacaccaacttggggaaaccatgttccaatcttcaaatttgccggagtcgatgtcaagcaataccgctattatgacaagtccacctgtggttttgatgaaactggagcactcgctgacattgctcaaatcccggaaggatccacaatcttgcttcacgcttgtgctcacaacccaactggagttgatccatcccgtgaccagtggaagaagatctccgacattgtgaagaaacgcaacttgtttgtcttcttcgatatggcttaccaaggtttcgcttccggagatgttgacaatgacgcgttcgctgttcgttactttgtcgagcaaggacacaacattgttctctctcaatcctttgccaagaacatgggactttatggtgaacgagtcggtgctttctccgttgttacctcggacgctgatgaggctgctcgtgttgcttctcaagtcaagatccttattcgcccactctactccaacccaccagtccatggagctcgcattgcttcccgcatcctcgcggatccagctctcaacaagcaatggctcggagatgtcaagctcatggctgatcgtatcatcaccatgagaactacgctcaaggatttgctcgccaaggagggatctactcgtaattgggagcacattaccaaccaaattggaatgttctgctttactggaatcaacccacaacaagttgagaagcttatcaaggaacactctgtctacctcaccaaggacggacgtatctcggtggcgggaatttcatcgaacaatgtcgcttaccttgcccacgctctccaccaagtcaccaagtaa

SEQ ID NO: 54897 - protein, 414 aa, Caenorhabditis elegans
MSVSKKLFSTAVRGKSWWSHVEMGPPDAILGVTEAFKADSNPKKINLGVGAYRDDQGKPFVLPSVKEAERQVIAANLDKEYAGIVGLPEFTKLSAQLALGENSDVIKNKRIFTTQSISGTGALRIGSEFLSKYAKTKVIYQPTPTWGNHVPIFKFAGVDVKQYRYYDKSTCGFDETGALADIAQIPEGSTILLHACAHNPTGVDPSRDQWKKISDIVKKRNLFVFFDMAYQGFASGDVDNDAFAVRYFVEQGHNIVLSQSFAKNMGLYGERVGAFSVVTSDADEAARVASQVKILIRPLYSNPPVHGARIASRILADPALNKQWLGDVKLMADRIITMRTTLKDLLAKEGSTRNWEHITNQIGMFCFTGINPQQVEKLIKEHSVYLTKDGRISVAGISSNNVAYLAHALHQVTK

SEQ ID NO: 54898 - DNA, 1197 bp, Pseudomonas putida KT2440
  CDS (1)..(1197)
atgagcctgttttccgctgtcgagctggcaccccgcgaccctattctgggcctcaacgaagcattcaacgccgacccacgtaccgacaaggtcaacctgggcgtaggcgtgtattgcaatgaggaaggccgcattccgctgctgcgcgccgtgatcgaagccgaaacccagcgtgccgcccagcacgcttcgcgcggctacctgccgatcgacggcatcgccacctacgaccaggctgtgcagaagctgctgttcggcgccgagtcgccactgctggccgccggccgcgtggtcaccgtgcaggccgtcggtggtaccggcgcgctgaagatcggtgccgacttcctcaagcgcctctcgcccaatgccgtggttgccatcagcgaccctagctgggaaaaccaccgtgcgctgttcgaatcggccggcttcccggtgcagacctaccgctactacgatgcgccgaccaacgacgtcaaccgcgctggcatgctcgaagacctcaacgccctgccatccggttcgatcgtggtgctgcacgcctgctgccacaacccgaccggtgtcgacctgaacctggacgactggaagaacgtcctggaagtggtcaaggccaagggccacgtgccgttcctcgacatggcctaccagggctttggtgacggtatcgccgaagacgccttcgccgtgcgcctgttcgccgagtcgggcctggagttcttcgtttccagctcgttctccaaatcgttctcgctgtacggcgagcgcgtcggcgcactgtcgatcgtcaccgcctccaaggacgagagcacccgcgtgctgtcgcaggtcaagcgcgtgatccgcaccacctactccaacccgccaacccacggcgcaaccattgttgccaccgtgctgaacagcgcagaactgcgccagatgtgggaaaccgaactggccgaaatgcgcgagcgcatccacggcatgcgcaagcagatggtatcgctgctggccgaatacggtgcaaaccgcgacttcagcttcgttggccgccaggtcggcatgttctcctactcgggcctgaccgttgaacaggtcacccgcctgaagaacgacttcggcatctatgccctggacaccggccgtatcgcggtggccgcgctgaaccagagcaacatccacgtggtgaccaaagcgatcgtggaagtgctgtaa

SEQ ID NO: 54899 - protein, 398 aa, Pseudomonas putida KT2440
MSLFSAVELAPRDPILGLNEAFNADPRTDKVNLGVGVYCNEEGRIPLLRAVIEAETQRAAQHASRGYLPIDGIATYDQAVQKLLFGAESPLLAAGRVVTVQAVGGTGALKIGADFLKRLSPNAVVAISDPSWENHRALFESAGFPVQTYRYYDAPTNDVNRAGMLEDLNALPSGSIVVLHACCHNPTGVDLNLDDWKNVLEVVKAKGHVPFLDMAYQGFGDGIAEDAFAVRLFAESGLEFFVSSSFSKSFSLYGERVGALSIVTASKDESTRVLSQVKRVIRTTYSNPPTHGATIVATVLNSAELRQMWETELAEMRERIHGMRKQMVSLLAEYGANRDFSFVGRQVGMFSYSGLTVEQVTRLKNDFGIYALDTGRIAVAALNQSNIHVVTKAIVEVL

SEQ ID NO: 54900 - DNA, 1197 bp, Pseudomonas putida KT2440
  CDS (1)..(1197)
gtgttcaaacatgtcgatgcctatgccggcgacccgatcctctcgttgatggaaaccttcaaggccgacccgcgcgccgacaaggtcaacctgagtattggcctgtactacgatgaggccggcgtggtgccgcaactggcggcggtggatgcggtggaaaaacgcattgccggtcaggaccacgaagcctccctgtacctgccaatggaaggcctggccagctaccgccaagccatccaggcgctgctgttcggtgctgatcacccggccgtgaccggcggtcgtgtggccaccgtacagaccgtgggtggctccggcgccctgaaagtcggtgccgatttcctcaagcgctacttcccgcagtccgaagtctgggtcagcaacccgacctgggacaaccaccgcgccatcttcgaaggtgcaggcttcaaggtgcacacctatccgtactttgaccaggccacccgtggcgtggacttcgacggcatgctggccaccttgcagagcctgccggccaacagcgtggtactgctgcacccgtgctgccacaaccctaccggtgccgatctgcagcagcaccagtggcaacaagtggtcgaagtggtcaaggcacgccagctgatcccgttcctcgacatcgcttatcaaggcttcgccgaaggcctggtggaagatgcctacgccatccgcgaaatggcccgtgccggcgtgccgtgcctggtcagcaactccttctcgaaaatcttctcgctgtatggcgagcgggtgggcggcctgtcggtggtgtgcgatgacgaggccactgcccagagcgtgcttggccagctgaaggccaccgtgcgccgcaactactccagcccgcccaacttcggcgcccagctggttgccggcgtactgagcgatgctggcctgaatgcccagtgggccgaagaagtcgaagtgatgcgcaagcgtattctcgacatgcgccaggcgctggtcgatgccctggccgtgctgctgccgggccaggacttccagttcttcctgcgccagcgcggcatgttcagctacaccggctttagcgtcgagcaggtacgtcgcctgcgtgacgagttcggcgtgtacctgatcgacagcggccgtgtgtgcatgtccggcctgcgcccggccaacctgcaacgggttgccgaagcgttcgctgccgttcagaagtaa

SEQ ID NO: 54901 - protein, 398 aa, Pseudomonas putida KT2440
MFKHVDAYAGDPILSLMETFKADPRADKVNLSIGLYYDEAGVVPQLAAVDAVEKRIAGQDHEASLYLPMEGLASYRQAIQALLFGADHPAVTGGRVATVQTVGGSGALKVGADFLKRYFPQSEVWVSNPTWDNHRAIFEGAGFKVHTYPYFDQATRGVDFDGMLATLQSLPANSVVLLHPCCHNPTGADLQQHQWQQVVEVVKARQLIPFLDIAYQGFAEGLVEDAYAIREMARAGVPCLVSNSFSKIFSLYGERVGGLSVVCDDEATAQSVLGQLKATVRRNYSSPPNFGAQLVAGVLSDAGLNAQWAEEVEVMRKRILDMRQALVDALAVLLPGQDFQFFLRQRGMFSYTGFSVEQVRRLRDEFGVYLIDSGRVCMSGLRPANLQRVAEAFAAVQK

SEQ ID NO: 54902 - DNA, 1236 bp, Escherichia coli CFT073
  CDS (1)..(1236)
ttgtgttttaaccaccagcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtggcggatgcggaagcgcgcctgaatgcgcagcctcatggtgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggtgcagatttcctgaaacgctacttcccggaatcaggcgtctgggtcagcgatcctacctgggaaaaccacgtagcaatattcgccggggctggattcgaagtgagcacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccattcctcgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgaaggtggtggctgcggtgctgaatgacgaggcattgaaagccagctggctggcggaagtagaagagatgcgaactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtga

SEQ ID NO: 54903 - protein, 411 aa, Escherichia coli CFT073
MCFNHQPVNLENHRVFQKVDAYAGDPILTLMERFKEDPRSDKVNLSIGLYYNEDGIIPQLKAVADAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDSVIEILKARELIPFLDIAYQGFGAGMEEDAYAIRAIASAGLPALVSNSFSKIFSLYGERVGGLSVLCEDAEAAGRVLGQLKATVRRNYSSPPNFGAKVVAAVLNDEALKASWLAEVEEMRTRILAMRQELVKVLSTEMPERNFDYLLNQRGMFSYTGLRTAQVDRLREEFGVYLIASGRMCVAGLNAQNVHRVAKAFAAVM

SEQ ID NO: 54904 - DNA, 1200 bp, Vibrio vulnificus CMCP6
  CDS (1)..(1200)
atgaagattatgtttgaaaaagtagttgccgctcccgcggacccgattcttggcctaactgaagaattcaaaaaagaccctcgcgcagaaaaaattaaccttggcgtgggtatctacaaaacagaacaaggtgaaactcctgttcttgctacggtaaagaaagcggaagcagcgcttgttgaaaccgagaaaaccaaatcttacctaaccatcgaaggaacagcagaatacgcattagcggttcaaaaactactgtttggtgcggatgctgagctaatcaatgcgcaacgtgcaaaaacagcacaagcacctggcggtactggcgcactgcgcgttgcaggcgaattcatcaaacgccaactcggcgatgtaaaaatctggatcagcaacccaacttgggctaaccaccatggtgtgttccgcgcagcaggcctagaaacggttgagtacgcttactacaacccagaaaccaaagacaaagactttgccgctatgctggccgaccttgaaaaagcgtccgctggtgatgtggtactgctgcacggatgttgccataacccaacaggcatcgacccaacggcacaagagtgggaagcgcttgctaaactggttgccgacaagggcctacttccactatttgactttgcctaccaaggtttcgcgaaaggtgttgaagaagatgcgcaaggcctacgtaccttcgctaaattcaacaaagagatcctcgtagcaagttcattctcgaaaaactttggtctgtacaacgagcgtgtaggcgcattcacgttagtggctgaaagccaagagatcgcagaaacggcattctcacaagtgaaagcgatcattcgctctatctactcaaacccaccagcgcacggcagtgcggtagtgactcacatccttaacgatgccgcgcttcgtgcagagtgggaagcggaagtggcagagatgcgcgatcgcatccaagagatgcgcgaactttttgttacgacactgaaagaagaaggcgttgcggctgactttagctttatccaacgtcaaaacggcatgttctctttctctggcttgaacaaagatcaagtggctcgcctaaaagaagagtttgcgatctacatcgtcggttctggtcgcatcagcgttgcgggcatgaccaaatccaacatgggtccgctttgtaaagccatcgctgcggtactgtaa

SEQ ID NO: 54905 - protein, 399 aa, Vibrio vulnificus CMCP6
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVTTLKEEGVAADFSFIQRQNGMFSFSGLNKDQVARLKEEFAIYIVGSGRISVAGMTKSNMGPLCKAIAAVL

SEQ ID NO: 54906 - DNA, 1188 bp, Vibrio vulnificus CMCP6
  CDS (1)..(1188)
atgttctctcaattaccaacaccagctttagatcctattctttctctaaccgttgcttttcgtaacgatccgcgtgaccaaaaagtagaccttggcattggcgtatacaaaaacaacaaaggcgaaacgccaatcatgcgtgcggtgtcccaagcgcaaaaaatcgttgctgatacacagacaaccaagtcgtacgtcggcctagcgggatgcgaagagtttaaccaatcgatggtgaatttattgcttgcgggtacttccgtacttgaccgagtgagtgcgattcaaacaccgggagccagtggcgcactgcgtatgctcggagatttgatgaaagtggcacagccagacaccaccgtttggatctctaaccctagttatgtgaaccataagccagtgatggaagctgccgggttgaaagtgcgttattaccgctacttcagcccagaaacaaagcaagtcgacatcggccagatgttagatgatcttgctactgcaggtccaaaggatgtcgtactgcttcatggttgttgtcacaacccaacgggagcagacattgattttgctgcttggcaagccatcaccgatttggcagtaaagaacggtttcacaccctttgttgatattgcctaccaaggctttggtgatggccttgaagaagacgcaaaagggctgcagttcatggctgaccgtgttgaagaaatgctgattaccacttcatgttcgaagaattttggtctttaccgtgaacgtactggcgcggccattgtgattggcaaaaacgcaaaagaatcatcaaacgcgaaaggtaagttgctgacactcgcacgttcaacttacaccatgccgcctgatcacggtgctgcattggtcaaaacaatcctacaaaatgtcgaacttacaaccacttggaagcaagaattgtgtgaaatgcagcaacgtttgttaaacctgcgtcaaactttatgtaatgaattgagaaatcaacacaatacgtcacaattcgacttcattgaaagccacaagggtatgtttactgtgctaggctttacacctgagcaaatgggaacgctacgagatgaatatggaatttatggtgtaggtgacgggcgaattaacatcgctggccttacagaagctcacattccatacgtggcagacgcgatagtcaaagtctcacaacgttaa

SEQ ID NO: 54907 - protein, 395 aa, Vibrio vulnificus CMCP6
MFSQLPTPALDPILSLTVAFRNDPRDQKVDLGIGVYKNNKGETPIMRAVSQAQKIVADTQTTKSYVGLAGCEEFNQSMVNLLLAGTSVLDRVSAIQTPGASGALRMLGDLMKVAQPDTTVWISNPSYVNHKPVMEAAGLKVRYYRYFSPETKQVDIGQMLDDLATAGPKDVVLLHGCCHNPTGADIDFAAWQAITDLAVKNGFTPFVDIAYQGFGDGLEEDAKGLQFMADRVEEMLITTSCSKNFGLYRERTGAAIVIGKNAKESSNAKGKLLTLARSTYTMPPDHGAALVKTILQNVELTTTWKQELCEMQQRLLNLRQTLCNELRNQHNTSQFDFIESHKGMFTVLGFTPEQMGTLRDEYGIYGVGDGRINIAGLTEAHIPYVADAIVKVSQR

SEQ ID NO: 54908 - DNA, 1146 bp, Bradyrhizobium japonicum USDA 110
  CDS (1)..(1146)
atgtcgaagcctcaatccgcggcactggtccgcaaccgctatttcgacgagctctcggcgacgccggggctctactggctcgggcagaacaccaaccatatcgagagccaccccgccgtgcgcgaggcgatgctgcgctcgatcgaggctggcgagttcaatgcctatgccccgccgctcggcttcgaggcgctgcgtgccgcgatcgtcgccgacctcggtgtgcccggcgcagaggcgctggtgaccgagggcggcgtcaacgcgctggcgatgatctgccgtgcgcgctgcaagcccggaacgacgctggtgacgaccgatccgacctggaaatggccgtgcctgttcgcgcgccagcagggcgccgaagtgatcgaaattccgatctacgatccggcctgcaactaccgcctgacgcccgaggcgttgaaggcgaatgtcgacgagcgcaccgcgatcatctatctcgtcgatcccaacaatccgctcggcattcgctacacccgcgaggagatcgagagcttcgcggcgatcgcgcgcgattggggcgcgctgctggtgcacgactgcacctaccgcgatttcgccgacggccacaccccgtcgctccacgtggcgccgcaaggctcggtcgtctcgaccagcttttcgaaatggctcgggcttgccggcctgcggatcggcgctctggtcgccgcgccggacctgttcgaggaactggcgctgacatccacgagcgtgctcggtgcgagcgtgatcgcccagcgtgcggcgcaggcgggactttccgtcaaggctgagtggatgaagaaggtccgcagcaccgaccggtccaacaaggcgatgatccaggaggcggcggccgcgatcgaagggctggcgctgccgatcatgccctcgcacggaaactttctggtgctggagaccatcgcagcgggcatccgtcccgaggcgctggtcgagtgctatcgccgccagggcatcatgatccgccagggcacgtatcatacgcagcgcttcggcgaccgcttcgtcaagatcagcacctccgtgccgcaggcgtgggtcgaaaagctctgcacgctgctgccggacatggttgcgcaggcgcgcacgctcaacgacctgccgccgcaattctag

SEQ ID NO: 54909 - protein, 381 aa, Bradyrhizobium japonicum USDA 110
MSKPQSAALVRNRYFDELSATPGLYWLGQNTNHIESHPAVREAMLRSIEAGEFNAYAPPLGFEALRAAIVADLGVPGAEALVTEGGVNALAMICRARCKPGTTLVTTDPTWKWPCLFARQQGAEVIEIPIYDPACNYRLTPEALKANVDERTAIIYLVDPNNPLGIRYTREEIESFAAIARDWGALLVHDCTYRDFADGHTPSLHVAPQGSVVSTSFSKWLGLAGLRIGALVAAPDLFEELALTSTSVLGASVIAQRAAQAGLSVKAEWMKKVRSTDRSNKAMIQEAAAAIEGLALPIMPSHGNFLVLETIAAGIRPEALVECYRRQGIMIRQGTYHTQRFGDRFVKISTSVPQAWVEKLCTLLPDMVAQARTLNDLPPQF

SEQ ID NO: 54910 - DNA, 1188 bp, Bradyrhizobium japonicum USDA 110
  CDS (1)..(1188)
atgcacgatgcgacattgaggaaccggttggggcagtggctcgagccctcccgccgtagcgatgttcccccgttcatggtcatggacgtgatggccgcggcggcccgaatcgaggccgccgggggccatgtcatccatatggaggtcggccagcccgcggccggcgcgccgaagaccgcgattgcggccgctcacgcggcgctcgaggcgggacggatcgattatacctccgcgctcggcattcccagcctgcgcgagcgcatcgcgcggcactatcgcgatgcccatggctgtgacgtcagcgccgagcggatcgtggtgacgacgggctcctcgggcggcttcatcctcgccttcctgtcgatgttcgagcctggcgaccgcgtcgccgtgacggtgccgggctatccgccgtaccgccacatcctcaccgcgctcggctgcgagccggtgctgatcgagaccacgaacgagacgcgtcacgcgctcaccggcgaggcgctgcttgccgcccatcgcaaggcgccgctgaagggcgtgctggtcggcagccccgccaatccgacgggaacgatgatgtcccgcgaggcgctctccggcctgatcgcggcggccgaagacgccaagatccgcttcatctcggacgagatctatcacgggctcgactatgcgtttccggcggtgacggcggcggcgctgtcggaccacgcactcgtgatcaactcgttctcgaagtatttttgcatgacgggctggcgcgtcggctggatggtcgtgccggagctcctggtgcggccgatcgagcggctgcagcagaacctgtcgatctcggtgccgtcgctgtcgcagatcgcggccgaggccgccttcgacggcacggccgaaatgggggagatcaagcacggctatcaggaaaaccggcgcatcctgatcgagggattgcccaaggccggcctcaccaggttcctgccggccgacggcgccttctatctctatgccgatgtctcggacttcacctccgacagtttcgagttcgccaagcagatgctggaacaggcccatgtcgcggcaacgccgggcctcgatttcgatcccatccatggccgctcgttcatccggttctcttatgcgcgttcggcggcggagatgcgggaggcagttgaccggatcgctcactggcttaaatag

SEQ ID NO: 54911 - protein, 395 aa, Bradyrhizobium japonicum USDA 110
MHDATLRNRLGQWLEPSRRSDVPPFMVMDVMAAAARIEAAGGHVIHMEVGQPAAGAPKTAIAAAHAALEAGRIDYTSALGIPSLRERIARHYRDAHGCDVSAERIVVTTGSSGGFILAFLSMFEPGDRVAVTVPGYPPYRHILTALGCEPVLIETTNETRHALTGEALLAAHRKAPLKGVLVGSPANPTGTMMSREALSGLIAAAEDAKIRFISDEIYHGLDYAFPAVTAAALSDHALVINSFSKYFCMTGWRVGWMVVPELLVRPIERLQQNLSISVPSLSQIAAEAAFDGTAEMGEIKHGYQENRRILIEGLPKAGLTRFLPADGAFYLYADVSDFTSDSFEFAKQMLEQAHVAATPGLDFDPIHGRSFIRFSYARSAAEMREAVDRIAHWLK

SEQ ID NO: 54912 - DNA, 1179 bp, Ruegeria sp. PR1b
  CDS (1)..(1179)
gtgcttagtgaccttggcagcgtgccatcagatgaaatcctgacgctcatgcaaatgcaccgggaagatccccggcgcgacaagatcgaccagacggttggcgtctaccgcaatgaacttggccagacgccagtcatgcaggccgtcaaggcggcggaatacaagatctggcaggatcagacgagcaaatcctacaccggattgctgggggaccccgagtttctcgaggtcatgcaggcgctggtgcttggtccggaggcgccgccctgtaccgctgctgccgtgcccggcggctctggcgcgtgtcggcaggcctttgaactgatccgccaggccacgccgggggcccgtgtctacgtctccgatccgacttgggcaaaccacacgaccatgctggcgcataccgggctggcccgggaaacctaccgctttcgagacccggcgacggggggcttgaactttgacggcatgatgcaggatctcggaacggctcgggccggtgacgtggtcctgctgcacggctgctgtcacaatcccacgggcatttcgctgacccggacccagtggcgcgccctggcagaccgcatggcgaaaaacggcctggtcggcatgattgacctggcctacctgggctttggggacgggctcgaagaggacgcctggggcacgcgccatctagcggaaacgctggatgaatgcctgatcgccgtgtcctgttccaagaacttcggtctttaccgcgaaagggcaggcgccctgttggtcacggcacgcaacccggcgctgctggcccacacgcgtgaggtcctggcctatctcaatcgacaggcctactcctttccgcccgatcatggagcgcgcatcgtcaccagcatcctcaaggacccggccctgcgcgaagtctggacccaggagctgcatggcatccgcaattcgatcgcggccctgcgcctgcagctgtgcaatgcctttgccgagaaaaccgggacccggcggtttgactacatccgggagcacaaaggcatgttttcctgcctcggtgccacccccgagcaagtccggaccctgcgcgcgaaacacggcatctacatggtcacggacagccggttgaactttgccagtctgagccagcaaaacgtcgaacgcatcgtggacgcggtgaccgacgtaggaatttag

SEQ ID NO: 54913 - protein, 392 aa, Ruegeria sp. PR1b
MLSDLGSVPSDEILTLMQMHREDPRRDKIDQTVGVYRNELGQTPVMQAVKAAEYKIWQDQTSKSYTGLLGDPEFLEVMQALVLGPEAPPCTAAAVPGGSGACRQAFELIRQATPGARVYVSDPTWANHTTMLAHTGLARETYRFRDPATGGLNFDGMMQDLGTARAGDVVLLHGCCHNPTGISLTRTQWRALADRMAKNGLVGMIDLAYLGFGDGLEEDAWGTRHLAETLDECLIAVSCSKNFGLYRERAGALLVTARNPALLAHTREVLAYLNRQAYSFPPDHGARIVTSILKDPALREVWTQELHGIRNSIAALRLQLCNAFAEKTGTRRFDYIREHKGMFSCLGATPEQVRTLRAKHGIYMVTDSRLNFASLSQQNVERIVDAVTDVGI

SEQ ID NO: 54914 - DNA, 1200 bp, Pseudomonas syringae pv. tomato str. DC3000
  CDS (1)..(1200)
atgctagcccacgtggagtcgtacgccggtgatccgatcctttcgctgatggaagcctttggcaaggatccacgcgcagacaaggtcaatctgagcatcggtctgtattacgacgcgcagggacgtatcccgcagttggcatgcgtggcaactgcgcaacaacaattggccgaaggcgagcaggcggcttctgtctatttgccgatggaaggcctggcggcttaccggcaggcggtgcaaaccctgttgttcggcgccgaccatccgctggtgcaggccggtcgcgtggcgactatccaaaccgtgggcggctcgggcgcgcttaaagtgggggccgacttcctcaaatatgcattccccgattctcaggtgtgggtcagtgatccgacctgggaaaaccaccttgcgctgttcggcggtgcgggcttcaaggtcaatacttacccctacttcgatgcccagactggcggcgtcaggttcgaggctatgctcgacaccgtgcagggtctgccggcgcaaagcatccttttgctgcacccgtgctgccacaacccgactggcgcggatttgtccgtcgagcagtgggaccggttgatcgaagtgatcaaggatcgccagctcatcgcgtttctggatatcgcctatcagggcttcggcaaaggcatcgacgaagacgcctacgctatccgcgcgatggccgacgcgggcatcaccacgctggtcagcaactcgttctcgaaaatcttctcgctgtatggcgagcgggtcggcgggctatcggtggtctgcgaagacaccgcatcggccgccaatgtattcggccagctcaaggccacagtacgccgcaactattccagtccgcctgcgcatggcgcgtttctggtgtccagagtgctcaacacaccgcaactgcgtgatcagtggctgagcgaggtcgaaaccatgcgcctgcgcatcatcgacatgcgcagccgtctggtttcggtgctggcgcagaaagttgccgggcgcgatttcagctttatcctcaggcagagcggcatgttcagctacaccggattgacgccgcagcaggttgacgagctgaaagatgttcacggtatttacatgctgcgcagtggccgggtgtgcatggcgggcttgaatgaaagaaatatcgacaaggtgtgtgacgcgattgcgagcctctttgcccactaa

SEQ ID NO: 54915 - protein, 399 aa, Pseudomonas syringae pv. tomato str. DC3000
MLAHVESYAGDPILSLMEAFGKDPRADKVNLSIGLYYDAQGRIPQLACVATAQQQLAEGEQAASVYLPMEGLAAYRQAVQTLLFGADHPLVQAGRVATIQTVGGSGALKVGADFLKYAFPDSQVWVSDPTWENHLALFGGAGFKVNTYPYFDAQTGGVRFEAMLDTVQGLPAQSILLLHPCCHNPTGADLSVEQWDRLIEVIKDRQLIAFLDIAYQGFGKGIDEDAYAIRAMADAGITTLVSNSFSKIFSLYGERVGGLSVVCEDTASAANVFGQLKATVRRNYSSPPAHGAFLVSRVLNTPQLRDQWLSEVETMRLRIIDMRSRLVSVLAQKVAGRDFSFILRQSGMFSYTGLTPQQVDELKDVHGIYMLRSGRVCMAGLNERNIDKVCDAIASLFAH

SEQ ID NO: 54916 - DNA, 1197 bp, Vibrio parahaemolyticus RIMD 2210633
  CDS (1)..(1197)
atgactttcatgttttctaatctaccaactcccgtattagatccaattttatctttatccgttgcataccgtaacgatgaacgtccaaacaaggttgaccttggtattggcgtatacaaaaacagcgcaggcgaaacgccgatcatgaaagccattcaaatggctcaagatgtcgttgttgaaactcaaaaaaccaaatcttacgttggtcttgctggttgtgaagagttcaaccaaagcatgattgatcttctactgacgggaacgtcagcgatggatcgtgttgctgcaattcaaacgccaggagcaagtggtgcactgcgtatgctgggtgacctaatgaaggtcgcacaaccagatacaacggtttggatttcgaatccaagctatgtgaaccacaagccagtaatggaagctgctgggcttaaagttaagttctaccattatttctcgccagaaacgaaacaagtcgacaccgcaaaaatgctggatgatcttgctaaagcagggccgacagatgtggttctactgcatggttgttgtcacaacccaacaggcgcagacatcgacttttccgcatggcaagctattacagaactttctcaaaagaacggttttacgccatttgttgatatcgcgtatcaaggttttggtgacggcttagaagctgacgcaaaaggtcttcgttacatggcggataatgtcgaagagatgttgattacaacttcttgttctaaaaactttggcttgtaccgcgaacgtactggtgcagctattgttgtgggtaagaacacgcaagacatcactaacgcgaaaggcaaattgttaacgttagcgcgctctacgtacacgatgccacccgatcatggtgctgctttagtgaaaaccattctgcaagatgcgaacctgacttctgtctggaagcaagagttgagcgaaatgcaacaacgtttggtcagccttcgtcaaagtttgtgtaacgaattgagaaacaaccataatacagatcaatttgacttcattgagagtcacaaaggcatgtttactgtgctaggctttagtgaaaaccaaatggcgcaactgcgtgaagattatggcatttatggtgttggcgatggtcgaattaacatcgctggcttaaccgaaactcatattccatacgtagctgacgcaattaagaaaatatctcaaccttaa

SEQ ID NO: 54917 - protein, 398 aa, Vibrio parahaemolyticus RIMD 2210633
MTFMFSNLPTPVLDPILSLSVAYRNDERPNKVDLGIGVYKNSAGETPIMKAIQMAQDVVVETQKTKSYVGLAGCEEFNQSMIDLLLTGTSAMDRVAAIQTPGASGALRMLGDLMKVAQPDTTVWISNPSYVNHKPVMEAAGLKVKFYHYFSPETKQVDTAKMLDDLAKAGPTDVVLLHGCCHNPTGADIDFSAWQAITELSQKNGFTPFVDIAYQGFGDGLEADAKGLRYMADNVEEMLITTSCSKNFGLYRERTGAAIVVGKNTQDITNAKGKLLTLARSTYTMPPDHGAALVKTILQDANLTSVWKQELSEMQQRLVSLRQSLCNELRNNHNTDQFDFIESHKGMFTVLGFSENQMAQLREDYGIYGVGDGRINIAGLTETHIPYVADAIKKISQP

SEQ ID NO: 54918 - DNA, 1242 bp, Bos taurus
  CDS (1)..(1242)
atggcgcctccatcaatctttgccgaggttcctcaggcccagccggtccttgtctttaagctaactgctgacttccgggaggatccggacccccgcaaggtcaacctgggagtgggagcttatcgcaccgatgatagccagccctgggttttaccagtcgtgaggaaggtggagcagaggattgctaacgacagcagcataaaccatgagtatctgcccatcctgggcctggcagagttccgaacttgtgcttcccgcctggcccttggggatgacagcccagctctgcaagagaagcgggtgggaggggtgcagtgcttggggggaacaggtgcacttcgaatcggagctgagttcttggcgcgctggtacaatggaacaaacaacaaggacacacccgtctatgtgtcctcgccaacctgggagaatcataatggtgtctttattgctgctggatttaaagacattcggtcctatcactattgggatgcagcgaagagaggactagacctccagggtttcctgaatgatttggagaaagctcccgagttctccatctttgtcctccatgcctgtgcgcacaacccgactgggactgacccgactccggagcagtggaagcagatcgcctccgtcatgaagcgccggtttctgttccccttctttgactcggcctatcaggcgttcgcatctggcagcctggagaaagacgcctgggccattcgctattttgtgtctgaagggttcgagctcttctgtgcccagtccttctccaaaaacttcgggctctacaatgagcgtgtggggaatctgactgtggttgccaaagaaccagatagcatcctgcgggtcctttcccagatggagaagatcgtgcgaattacatggtccaatcccccagctcagggagcacggatcgtggcacgtaccctgtctgatcctgagctctttaatgaatggacaggtaacgtgaagacaatggcagaccgcattctgaccatgagatctgagctcagggcacgattagaagccctcaagaccccaggaacctggaaccacatcacagagcagatcggaatgttcagcttcaccgggttgaaccccaagcaggttgagtatctgatcaatgaaaagcacatctatctgctgccaagtggtcggatcaacatgtgtggcttaaccaccaaaaatctagagtacgtggccacctccatccatgaagcagtcaccaaaatccagtga

SEQ ID NO: 54919 - protein, 413 aa, Bos taurus
MAPPSIFAEVPQAQPVLVFKLTADFREDPDPRKVNLGVGAYRTDDSQPWVLPVVRKVEQRIANDSSINHEYLPILGLAEFRTCASRLALGDDSPALQEKRVGGVQCLGGTGALRIGAEFLARWYNGTNNKDTPVYVSSPTWENHNGVFIAAGFKDIRSYHYWDAAKRGLDLQGFLNDLEKAPEFSIFVLHACAHNPTGTDPTPEQWKQIASVMKRRFLFPFFDSAYQAFASGSLEKDAWAIRYFVSEGFELFCAQSFSKNFGLYNERVGNLTVVAKEPDSILRVLSQMEKIVRITWSNPPAQGARIVARTLSDPELFNEWTGNVKTMADRILTMRSELRARLEALKTPGTWNHITEQIGMFSFTGLNPKQVEYLINEKHIYLLPSGRINMCGLTTKNLEYVATSIHEAVTKIQ

SEQ ID NO: 54920 - DNA, 1191 bp, Chlamydophila caviae GPIC
  CDS (1)..(1191)
atgagttttttcaatcaattacccacgttctcacctgattctattttaggtttgcaaaaactatttttagaagatgagcgagaggaaaaggtgaatcttgttataggtgtctatgaagatcctagcaaggcatatggtggtttttctagcgtccgtaaggcgcaatttctttttttagaagatgagatgaataaggggtatttacccatcagtggcttatcttcttttaatcaagaaatggaaaagctggtttttggtgatgtaaattctagttttgttgttggtgctcaggcgctagggggaactggagctttgcatttaggggctaagattttttctatggcctatacctcaggcaaagtatacattcccgagcaaacttggggaaaccacgtaagaatatttgctcaacaaggtttagaggttcttaaatacccttattatagctcagaaagcaaaagtttgctttttgatgagatgctttctgtattgaaagccgctccaaaaaattctttggtgcttttgcagtgttgttgtcataatcctacgggaatggatcttaatgaagatatgtggacacgtcttgctgaagttatgaaagaacatcagcttcttccattttttgataccgcttatttaggttttgggcgaggcatcaaagaagataggcgtcctatagagattttcatagaagttggtaatcccgtatttgtagcagcatgcgcaagtaaaaatttttctctttatggagagagggtaggctacttcgcagttcatagcaaaattactgaggatttagataagatttctagctgtctcgaagagaaagcccgtggagaatattcttcacctcctagacatggagctaaaattgtttcaacgattttatccgacgcttctttgaagaaagaatggttgtcagaattagatacgattcgtagttctttagggaaaactcgcgcaagacttgttcaagctatgcgaaatcacgtcggtcattcgtttgactttatcttgtctcagaagggattttttggttatcccggattttctgtagaacaggtgctctttttaagatcagagaagggtatctatacgacgagtggagcaagatttaacttaaacggaattactgataaaaatatcgaccacgtctctcagagttttgctgaggcgtatcagttgtcttag

SEQ ID NO: 54921 - protein, 396 aa, Chlamydophila caviae GPIC
MSFFNQLPTFSPDSILGLQKLFLEDEREEKVNLVIGVYEDPSKAYGGFSSVRKAQFLFLEDEMNKGYLPISGLSSFNQEMEKLVFGDVNSSFVVGAQALGGTGALHLGAKIFSMAYTSGKVYIPEQTWGNHVRIFAQQGLEVLKYPYYSSESKSLLFDEMLSVLKAAPKNSLVLLQCCCHNPTGMDLNEDMWTRLAEVMKEHQLLPFFDTAYLGFGRGIKEDRRPIEIFIEVGNPVFVAACASKNFSLYGERVGYFAVHSKITEDLDKISSCLEEKARGEYSSPPRHGAKIVSTILSDASLKKEWLSELDTIRSSLGKTRARLVQAMRNHVGHSFDFILSQKGFFGYPGFSVEQVLFLRSEKGIYTTSGARFNLNGITDKNIDHVSQSFAEAYQLS

SEQ ID NO: 54922 - DNA, 1218 bp, Arabidopsis thaliana
  CDS (1)..(1218)
atgaattccatcttgtcaagcgtccttcctgctcccgaagatcctgttctcagtgtaatttttgcttgtagagatgatcctagtccggttaagttgaatttgagcgcaggtacctatcgaactgaggaaggaaagcctcttgttcttgatgttgtgagaagagcagagcaacagttagccaacgacctgtctagggacaaggaatatcttcccctcaatggacttcctgaatttaataaattaagtaccaagctcatcttaggtgatgatagtcctgcattgaaagagaatagagttgttacaacccaatgtttgtctggtactggttctttgagagttggagctgagtttctagcaacacacaacaaagaaagtgtcattttcgttccaaacccaacgtgggggaaccatccccgtatttttactttggcgggtttgtctgtccagtatttccgttattatgatccgaagagccgaggactcgacttcaaaggcatgctcgaggatcttggcgctgcacctcctggagctatagtggtacttcaagcttgtgcgcataaccccacaggagttgacccaacattcgaacaatgggaaaagattcgacgactagtgagatcgaaaagcttattacctttctttgatagtgcatatcagggttttgctagtggtagccttgacgcagatgcacaagcggttcgtatgtttgtagccgatggaggtgaatgtttgatagctcaaagttatgccaaaaatatgggcctttatggggagcgtattggctctcttacgatcgtatgcacatcagaagatgtcgctaagaaagttgagaaccaagtgctacttgttgtgaggcctatgtatcttacaccacctattcatggtgcatctattgttgccacaattctaaaaaacagtgatatgtacaatgactggaccattgagctgaaaggaatggctgaccgcataattagcatgcgtcaacagttatatgcagctctagaagctagaggaacacctggtgattggagtcacattattaaacatattgggatgtttacttttaccggattgagtgaggagcaagttcgcttgatggccaaagaatatcacatttacatgacttatgatgggaggataagcatggcaagtctaagttcgaagacagtgcctcaactcgctgatgctatacatgctgttgttactcgcatcgcctaa

SEQ ID NO: 54923 - protein, 405 aa, Arabidopsis thaliana
MNSILSSVLPAPEDPVLSVIFACRDDPSPVKLNLSAGTYRTEEGKPLVLDVVRRAEQQLANDLSRDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 54924 - DNA, 1194 bp, Rhodopirellula baltica SH 1
  CDS (1)..(1194)
gtgcaccgattcgactccatctccgttgccccgcccgacgccattttgggactgaccgaagcgttcaaagccgatgaacgcgaaaccaaaatgaatttgtccgtgggcgtgtaccaagacgcttccggcaccacccccgtgcttcgctgcgtcaaagaagccgaaaaacggctgttggatacagaatcgaccaagggatacctctcgatcgacggcctgccggactaccgcgaagccgcccgccgattgatcttctccgaccaaatcgctgccgagcgagtggcagcggttcagacgccgggcggaaccggagccctccgtgtggcggcagaattcctggccactcagtgcggaccgctacgaattttcttgcccacgccaacctgggccaaccacaacgcgatcatggccgcggccggactgccggtggaaacgtattcctacctggcgtctgacaaaaagacgctggacttcgacgcactcatcgaagacctgaagaccaaacccaaggccggcgatgcggttctgctgcatgcgtgctgccacaacccaaccggagtcgacccgacaccggaacagtgggaacaaatcgcgagcgtggtctccgaaaagaaactgatcccattgctggactttgcctaccaagggttcggcgaaggcctggacgaagacgccatcggtgtgcgcacgattctgcgacagatggatgaagccatcgtctgctcgtcattcagcaaaaactttggcctgtacagcgaacgagttggaacagcgtgcttggtatccgggtcagccgaaacgaccaaagccgctctcagccaactcaaacgagtcgtccgagccaactacagcaacccacctcggcacggcggcgcgatcgtggccactgtgttggccgatgagggactgacccaaatgtggcacgaagagctcgccgaaatgcgaactcggatcgcctccctacgaaaacaattcgttgatggaatggccgcgacgggagtcgaccaagacttctcgttcttgctggaccaaaaaggcatgttctctttcagtggtttgtcaccgatgcaggtcgaccaactgcgaagcgaacatggcgtgtatctggtcggtagcggtcgaatcaacgtcgccggaatgaacgaatcgaagatggaatggttgtgcaatgccgtggcggcggtattgcgatag

SEQ ID NO: 54925 - protein, 397 aa, Rhodopirellula baltica SH 1
MHRFDSISVAPPDAILGLTEAFKADERETKMNLSVGVYQDASGTTPVLRCVKEAEKRLLDTESTKGYLSIDGLPDYREAARRLIFSDQIAAERVAAVQTPGGTGALRVAAEFLATQCGPLRIFLPTPTWANHNAIMAAAGLPVETYSYLASDKKTLDFDALIEDLKTKPKAGDAVLLHACCHNPTGVDPTPEQWEQIASVVSEKKLIPLLDFAYQGFGEGLDEDAIGVRTILRQMDEAIVCSSFSKNFGLYSERVGTACLVSGSAETTKAALSQLKRVVRANYSNPPRHGGAIVATVLADEGLTQMWHEELAEMRTRIASLRKQFVDGMAATGVDQDFSFLLDQKGMFSFSGLSPMQVDQLRSEHGVYLVGSGRINVAGMNESKMEWLCNAVAAVLR

SEQ ID NO: 54926 - DNA, 1197 bp, Wigglesworthia glossinidia endosymbiont of Glossina brevipalpis
  CDS (1)..(1197)
atgtttgaattaacagagctttctcctttagatccagtattaggaatgatcgatattattaaaaatgataaaagagatggtttaataaatttaggaattggagtttataaagatataaaaggtaacactcctatattagatagtgtaaaaaaagcagaaaatattttaatagaatcagaaaaaacaaaaaattatttaaatattgaaggactagaatcatttatacaacattcaaaaagtttaatttttggcaaagaaaatttatctgagttaaatgattttattgcttcagtacaatgcccaggaggaacttctgctttaaaaattgctgcagagtttttaattagacatacaaaaatacgtaaaatttggatcagtgatccaagttggcctaatcatgaaaagttattttcatttgccggatttaaagtacataaatatccttattttaataaggaaaaaaatcaattagatttttataatatgaaaaaatgcttagaaaatattaaagatgactctgctgttatttttcacagctcttgtcataatccaacaggaatagatcctagttttgaacaatggttagaattagctaaaatttctagaaataaaaaatggattccaatatttgattctgcatatcaaggtttttccaatggattaaaagatgatgtatttggtataaaaatttttttaaaatatattaatgaatttgtagtttgcaattcattttctaaaaattttagtttgtataatgaaagagttgggacatgcaattttataacaaaaaacaaaaaacatgccagtaatgttttcagtcaattaagatctattatacgtgtaaattactctaatcctccagctcatggagcaaatattataaatgtaattttctctaaaaaagatttatttaatttatggaaatctgaattaaatgaaatgagaaatagaattaaacaaataagatctttatttgcagatacattatttaaaataaataataaaaaaaatttcaattttattaaaaatcagcatggaatgttttcttttattggattaaatagaaaaaatgtaatggatcttagaaataattttagaatatatgttattgattctggaagattaaatttcgcagcaataacaaataaaaatatttatgaggtgtgtagatcaattaattgtgttttaaataattga

SEQ ID NO: 54927 - protein, 398 aa, Wigglesworthia glossinidia endosymbiont of Glossina brevipalpis
MFELTELSPLDPVLGMIDIIKNDKRDGLINLGIGVYKDIKGNTPILDSVKKAENILIESEKTKNYLNIEGLESFIQHSKSLIFGKENLSELNDFIASVQCPGGTSALKIAAEFLIRHTKIRKIWISDPSWPNHEKLFSFAGFKVHKYPYFNKEKNQLDFYNMKKCLENIKDDSAVIFHSSCHNPTGIDPSFEQWLELAKISRNKKWIPIFDSAYQGFSNGLKDDVFGIKIFLKYINEFVVCNSFSKNFSLYNERVGTCNFITKNKKHASNVFSQLRSIIRVNYSNPPAHGANIINVIFSKKDLFNLWKSELNEMRNRIKQIRSLFADTLFKINNKKNFNFIKNQHGMFSFIGLNRKNVMDLRNNFRIYVIDSGRLNFAAITNKNIYEVCRSINCVLNN

SEQ ID NO: 54928 - DNA, 1191 bp, Haemophilus ducreyi 35000HP
  CDS (1)..(1191)
atgttcaatcatatcgaggccgctctaaccgatccaattttaggtttaaatgatgccttccgagcagatattcgaaaaacaaaaactaatttgggcattggtgtgtatatgaatgccgaaggtcagacaccgattatgaatgccgtaaaattagcagaaacgcgtttacttgctgaagaatcacaaaagaattatcttcagattgatggtatcgcacactttaatagttatacgcaaaccttattatttgggcaagatgccgatgttattcaaacggggcgagtaaaaacagcacaaagtttaggtggcacaggcgcattacgtatagcaatggagtttattaagcgccaaactgacgcaaagactatttggatatcaaacccaacttggcctaatcataatgcaattgctgaagcggttggcttaacgataaaaaactaccgctattataatcccgaaactaacggcttagattgggataatctgttggctgacttgcaacaagctgaacgtggcgatgtagtgttattacacggttgttgccataacccgaccggtatcgatccaacagcagaacagtgggataaactcgctatactttcagctgaaaaaggctggttacctttatttgatttcgcttatcaaggattagccaatggcttagatgaagatgcttacggtttacgtgcatttgctaaaaaccataaagaattattaatcgcgagttcttattcaaaaaattttggtttatataatgaacgcgtgggcgcttttactttagtggcagaaaatgcagaaatagcaaataatgcatttactcaaattaaatcgattattcgagtgctctattctaatccagcggcacacggtgctcataccgtaaccaccgtattggctgatgatcaattacgcgcaaattggatcgctgaattaagtgagatgcgtgatcggattaaaacgatgcgaactaaaatggttcaattactagctgaaaaaggcgcgaaaaaagatttctcatttatttctgatcagaatggtatgttttcattcagcggtttaaccgctacacaagtcgaccgtttacgtgatgaatttgcaatttatgcggttcgttctgggcgaataaatgtagccggacttactgatgataatatcgaagcgttttgcgatgctgtagtaaaagtactttag

SEQ ID NO: 54929 - protein, 396 aa, Haemophilus ducreyi 35000HP
MFNHIEAALTDPILGLNDAFRADIRKTKTNLGIGVYMNAEGQTPIMNAVKLAETRLLAEESQKNYLQIDGIAHFNSYTQTLLFGQDADVIQTGRVKTAQSLGGTGALRIAMEFIKRQTDAKTIWISNPTWPNHNAIAEAVGLTIKNYRYYNPETNGLDWDNLLADLQQAERGDVVLLHGCCHNPTGIDPTAEQWDKLAILSAEKGWLPLFDFAYQGLANGLDEDAYGLRAFAKNHKELLIASSYSKNFGLYNERVGAFTLVAENAEIANNAFTQIKSIIRVLYSNPAAHGAHTVTTVLADDQLRANWIAELSEMRDRIKTMRTKMVQLLAEKGAKKDFSFISDQNGMFSFSGLTATQVDRLRDEFAIYAVRSGRINVAGLTDDNIEAFCDAVVKVL

SEQ ID NO: 54930 - DNA, 1221 bp, Candidatus Blochmannia floridanus
  CDS (1)..(1221)
atgtttaaatcaatgataatggctccaccagacccaattcttggattatcaaaaatttatcattctgacactaaaaaaaacaaaattaatcttggtattggagtatatatagaaaaatttcatgcagctccaattttagaaagcgttaaacaagctgaagatttattactcaaaaaagaaattagtaaaaattatcttgctattgaaggttctaatgactttaataatgccaatcaaacattattatttggaccaaatgactcaataatatcaaaaaataggattagaactgttcaagctcctggaggaactggagcattgagaatagccgcggaatgtattgcaaaatatgataatactataaataaaaaaagacgaatatggattagcgaacctagctgggtaaatcataaaaatattttttttgctgctggattagaagtatgtacttatccatattatcaaaaatctacacactccattgaatttgataaactgattgatactttcaacaatatagtaaaacctggagatatagttttattacacggttgttgtcataatccaaccggaatggatcctactatagaacaatggaaaatgttatctgaatgtgcagaaaaaaatagatggatacctttgtttgatctggcatatcaaggatttgataatggattacaagaagacttgataggattacatatgttttgtaaaaacaatccagaattaatagtctgtaattcttactccaaaaattttggtttgtataacgaacgtgtaggagcatgtactataattactgaaaacaataatcatgctgattgtgtgctaagccaactacgagcgaccattagggcaatttattctaatccaccagcacatggagctgccattgtatctacaattttacaaaataaaacactacgtttcatttgggaaaaagaattaaaaaatatgagagatcatattaaaaatatgcgtaaattgttatttaatacactgaataaatataaaaatagtaaagtaataaatcaagattttagttttattaataatcaaaaaggtatgtttgcctatataggattaaactctaatcaagtaattaaattacgtgaagaattaggaatttatttagtagattctggtaggctaaacttagcaggtttatcacacaaaaatatcgattacatatgtaatgcaatatgtaacttatacatttaa

SEQ ID NO: 54931 - protein, 406 aa, Candidatus Blochmannia floridanus
MFKSMIMAPPDPILGLSKIYHSDTKKNKINLGIGVYIEKFHAAPILESVKQAEDLLLKKEISKNYLAIEGSNDFNNANQTLLFGPNDSIISKNRIRTVQAPGGTGALRIAAECIAKYDNTINKKRRIWISEPSWVNHKNIFFAAGLEVCTYPYYQKSTHSIEFDKLIDTFNNIVKPGDIVLLHGCCHNPTGMDPTIEQWKMLSECAEKNRWIPLFDLAYQGFDNGLQEDLIGLHMFCKNNPELIVCNSYSKNFGLYNERVGACTIITENNNHADCVLSQLRATIRAIYSNPPAHGAAIVSTILQNKTLRFIWEKELKNMRDHIKNMRKLLFNTLNKYKNSKVINQDFSFINNQKGMFAYIGLNSNQVIKLREELGIYLVDSGRLNLAGLSHKNIDYICNAICNLYI

SEQ ID NO: 54932 - DNA, 1203 bp, Bordetella parapertussis 12822
  CDS (1)..(1203)
atgagcactcttttcgcttccgtcgaactcgcgccgcgcgaccccattcttggcctgaacgaacagtacaacgccgatacccgtcccggcaaagtgaacctgggcgtgggcgtgtactacgacgacgaaggccgcatcccgctgcttcaggccgtgcgcaaggccgaggtggcccgcatcgaagccgccgccgcccgcggctatctgccgatcgaaggcatcgcggggtacaacgagggtgcgcaggcgctgctgctgggcgccgactcgccgctggccgccgaaggccgcgtgctgaccgcgcaggccctgggcgggaccggcgcgctgaagatcggcgccgacttcctgcgccagttgctgccgcagtccaaggtcctcatcagcgaccccagctgggaaaaccaccgcgccctgttcgagcgcgccggcttcccggtcgagacctacgcttattacgacgccgccacccatggcctgaacttcgaagccatgctggccgccctgcaggccgcgcccgaacagaccatcgtggtgctgcacgcctgctgccacaacccgaccggcgtcgaccccacgccgcagcagtgggaacagatcgccgccgtggtcaaggcgcgcaacctggtgccgttcctcgacatcgcctaccagggcttcggcgaaggcctggagcaggacgccgccgtggtgcgcatgttcgccgcgctcgacctgaccatgttcatcagctcgtcgttctccaagtccttctcgctgtatggcgagcgggtcggggccctgaccgtggtggccggcagcaaggacgaggccgcccgcgtgctcagccagctcaagcgcgtgatccgcaccaactactccaacccgcccacccacggcggcacggtggtgtccacggtcctgaacacgcccgagctgttcgcgctctgggaaaatgaactggccggcatgcgcgaccgcatccgcctgatgcgcaaggaactggtcgagaagatcaaggcccagggcgtggcgcaggacttcagcttcgtgctggcgcagcgcggcatgttctcgtactcgggcctgaccgccgcccaggtcgatcgcctgcgcgaagagcacggcatctacgcggtctccagcggccgcatctgcgtggccgcgctcaacagccgcaacatcgacgcggtcgcggccggcatcgccgcggtgctgaagtag

SEQ ID NO: 54933 - protein, 400 aa, Bordetella parapertussis 12822
MSTLFASVELAPRDPILGLNEQYNADTRPGKVNLGVGVYYDDEGRIPLLQAVRKAEVARIEAAAARGYLPIEGIAGYNEGAQALLLGADSPLAAEGRVLTAQALGGTGALKIGADFLRQLLPQSKVLISDPSWENHRALFERAGFPVETYAYYDAATHGLNFEAMLAALQAAPEQTIVVLHACCHNPTGVDPTPQQWEQIAAVVKARNLVPFLDIAYQGFGEGLEQDAAVVRMFAALDLTMFISSSFSKSFSLYGERVGALTVVAGSKDEAARVLSQLKRVIRTNYSNPPTHGGTVVSTVLNTPELFALWENELAGMRDRIRLMRKELVEKIKAQGVAQDFSFVLAQRGMFSYSGLTAAQVDRLREEHGIYAVSSGRICVAALNSRNIDAVAAGIAAVLK

SEQ ID NO: 54934 - DNA, 1200 bp, Bordetella bronchiseptica RB50
  CDS (1)..(1200)
atgttcgagcacgttcaagcctatccgggcgaccccatcctcagcctgaacgaggatttccagaaagatccccgggccggcaaggtcaacctgaccatcggcatctatttcgacgaagccggccgcatccccgtcatggccgccgcccgcgaggccgaggccgcgctgctggccgacatcgggccgcgcccctacctgccgatggccggcctgccggcctatcgcgacctggtgcaggagctggtgttcggcgccggcagcgccgcgcgccgcgccggccgtatcgccacggtgcagacgctgggcgggtcgggcgcgctgaaagtgggcgccgacttcctcaagcgctattttcccaagtcggaagtctgggtcagcgacccgagctgggaaaaccatcgcaccattttcgagggcgccggcttcgcggtgcacacctatccctattacgacgacgccagcggcggcctgcgctttgacgaaatgctggccacggtgggcggcctgccggccggcagcgtcgtgctgctgcacgcctgctgccacaacccgaccggcgtggacctcgatcgcgcccagtgggacgcgctgattccggtgctgcgcgagcgcggcctgatcgccttcgtcgacatggcctaccagggcttcggcgatggcctggacgacgacgcctatgccgtgcgggccatcgccgaggcgggcgtgacctgtgtggtggccaactcgttctcgaagaatttctcgctgtacggcgagcgctgcggcgggctgagcgtggtgtgcgaaaccgccgagcaggctggctgcgtgctgggccagctgaccagcaccatccgcgccatctacagcaacccgcctacccatggcgcgcgcatcgtcgcccaggtgctgggcacgccggcgctgcggcaatcgtgggaggccgagctgggcgccatgcgcgagcgtatccaggcgatgcggcgcgccatccatgacggcctggccggccgcgtcgagccgcgcatgctgcagcgctacctgtcgcagcgcggcatgttcacctacaccggcctgggcgccgagcaggtcgagaccttgcggcgcgaccagggcgtgtatctgctgcgctcgggccgcatgtgcgtggcgggcctgaaccgcgacaacgtggcggtggccgccgacgccatcgccagcgtgctggcgcgcggctag

SEQ ID NO: 54935 - protein, 399 aa, Bordetella bronchiseptica RB50
MFEHVQAYPGDPILSLNEDFQKDPRAGKVNLTIGIYFDEAGRIPVMAAAREAEAALLADIGPRPYLPMAGLPAYRDLVQELVFGAGSAARRAGRIATVQTLGGSGALKVGADFLKRYFPKSEVWVSDPSWENHRTIFEGAGFAVHTYPYYDDASGGLRFDEMLATVGGLPAGSVVLLHACCHNPTGVDLDRAQWDALIPVLRERGLIAFVDMAYQGFGDGLDDDAYAVRAIAEAGVTCVVANSFSKNFSLYGERCGGLSVVCETAEQAGCVLGQLTSTIRAIYSNPPTHGARIVAQVLGTPALRQSWEAELGAMRERIQAMRRAIHDGLAGRVEPRMLQRYLSQRGMFTYTGLGAEQVETLRRDQGVYLLRSGRMCVAGLNRDNVAVAADAIASVLARG

SEQ ID NO: 54936 - DNA, 1194 bp, Chromobacterium violaceum ATCC 12472
  CDS (1)..(1194)
gtgttccaacatgtagacgcctacgccggcgatcccatcctgtcgctggtggaagctttcggcaaagacccgcgcgagcagaaggtcaacctcagcatcggcctgtattacgacgaggcaggccgcatcccgcggctgaaggcggtggagcaggccgaggcgctgctggccagccagccgcagccgccgtgcacctatctgccgatggacggcatgccggcttaccgcagcgccatccagacgctactattcggcgccgagcatccggcggtgaaagacggccgcatcgccacgctgcagacgctgggcggctccggcgcgctgaaagtgggcgccgacttcctcaagcgctatttcccggcatccggcgtctgggtcagcgacccgacctgggacaaccacgtcgccatcttcgaaggcgcgggcctggccgtggagcgctacccgtatttcgacccggccacccgcggcgtggatttcccggccatgctggccaagctgcagacgctgccggccaagagcatcgtgctgctgcacccgtgttgccacaaccccaccggcgcggacctcaccgacgcgcagtgggaccaggtggtggaagtggccaaggcgcgccagctgattcccttcctggacattgcctaccagggcttcggcgccggtctggaggaagacgcctacgccatccgcgcgatggcagacgccggcatcgccttcctggtcagcaactccttctccaagatcttctcgttgtacggcgaacgctgcggcggcctgtccgtggtgtgcgaaaccgccgccgaggcggcgctggtgtccggccagctcaaggccaccgtgcgccgcaactactccagcccgccgacgcacggcgccagggtgatcgccaccgtgctgaacgatccggagctgaaggcgctgtgggtgtccgaggtgaacgagatgcgcgagcgcatccaggcgatgcgcggcgtgctggtgcaagtgctgaaggaagcgctgcccgagcgcgacttcggctacctggtgaaccagcgcggcatgttcagctacaccggcttcagccaggcgcaggtggacaagctgcgcgagcagttcgccgtctacctggtgggcagcggccgcatgtgcgtggccggcctcaacgccgccaacgcgccctacgtggcccaggccttcgcccaggtgcagtaa

SEQ ID NO: 54937 - protein, 397 aa, Chromobacterium violaceum ATCC 12472
MFQHVDAYAGDPILSLVEAFGKDPREQKVNLSIGLYYDEAGRIPRLKAVEQAEALLASQPQPPCTYLPMDGMPAYRSAIQTLLFGAEHPAVKDGRIATLQTLGGSGALKVGADFLKRYFPASGVWVSDPTWDNHVAIFEGAGLAVERYPYFDPATRGVDFPAMLAKLQTLPAKSIVLLHPCCHNPTGADLTDAQWDQVVEVAKARQLIPFLDIAYQGFGAGLEEDAYAIRAMADAGIAFLVSNSFSKIFSLYGERCGGLSVVCETAAEAALVSGQLKATVRRNYSSPPTHGARVIATVLNDPELKALWVSEVNEMRERIQAMRGVLVQVLKEALPERDFGYLVNQRGMFSYTGFSQAQVDKLREQFAVYLVGSGRMCVAGLNAANAPYVAQAFAQVQ

SEQ ID NO: 54938 - DNA, 1209 bp, Chromobacterium violaceum ATCC 12472
  CDS (1)..(1209)
atgacctcttcgatcttcgccggcgtggagctggcgccgcgcgaccccatcctcggactcaatgaggcgttcaacgccgatacccgcagcaccaaggtcaatcttggcgtgggcgtgtattccgacgacaacggcaagattccactgctggccgcggtgcaggcggccgagaaagctcgcctcgaagcattgccggcgcgcggctaccagccgatcgaaggccccgccgcttacgatgtcgccgtgcagaagctgctgttcggcgagagcagcgaactgctggccgccggccgcgtggtgaccgcccaggcgctgggcggcaccggcgcgctgaagatcggcgcggacttcctgaaacgcctgaatccggccgccaaggtgtacatcagcgacccgtcctgggaaaaccaccgcgcgctgttcgagtccgccggctttgccgtggaaaactacccgtattatcacgcagccagccgcggcgtggatttcgccgcgatgaaggcgcatttgtcctcgctggatgcgggctccatcatcgtgctgcatgcctgctgccacaatcccaccggcgccgacctgtccgccgcgcaatgggaagaagtggtgtcgatctgccgcgagcgcagcctggtgcccttcctggacatggcctaccagggcttcgccgacggcatcgacgccgatgcgctggcggtgcgcctgttcgccgcctcgaatctgcagttcttcgtcgccagctccttctccaagagcttctcgctgtacggagagcgtgtcggcgcgctgtccatcatcacggcagccaaggacgagtcggtccgcgtcttgtcccagctgaagcgcgtgatccgcaccaactactccaatccgcccatccatggcgcggccatcgtcgccgccgtgctgtccagcccggcgctgcgcgcgcaatgggaggaagagctggcgggcatgcgcgatcgcattcgcgacatgcgattggccttgctggaggcgatcaaggcgcaaggcgtggccgtcgacttttccttcatcacggcccagcgcggcatgttctcctacaccggcctgagcgccgcccaggtggaccgcctgcgcgaggagttcggcatttacgcggtatccactggccgcatctgcctggcggccctgaacagcaagaacgtaggctatgtggcctccgccatcgccaaggtggttcaggcctga

SEQ ID NO: 54939 - protein, 402 aa, Chromobacterium violaceum ATCC 12472
MTSSIFAGVELAPRDPILGLNEAFNADTRSTKVNLGVGVYSDDNGKIPLLAAVQAAEKARLEALPARGYQPIEGPAAYDVAVQKLLFGESSELLAAGRVVTAQALGGTGALKIGADFLKRLNPAAKVYISDPSWENHRALFESAGFAVENYPYYHAASRGVDFAAMKAHLSSLDAGSIIVLHACCHNPTGADLSAAQWEEVVSICRERSLVPFLDMAYQGFADGIDADALAVRLFAASNLQFFVASSFSKSFSLYGERVGALSIITAAKDESVRVLSQLKRVIRTNYSNPPIHGAAIVAAVLSSPALRAQWEEELAGMRDRIRDMRLALLEAIKAQGVAVDFSFITAQRGMFSYTGLSAAQVDRLREEFGIYAVSTGRICLAALNSKNVGYVASAIAKVVQA

SEQ ID NO: 54940 - DNA, 1191 bp, Photorhabdus luminescens subsp. laumondii TTO1
  CDS (1)..(1191)
atgtttgagaaaatcaccgcagcgcctgccgaccctattcttggcttagccgatagtttccgttctgatcctcgtacaaataaaatcaaccttggtatcggtgtctataaagacgaaacaggaaaaaccccggttctgaccagtgttaaaaaagctgaacaatatttactggaaaacgaaacaacaaagaattatctgccgattagcggcttagccgaatttggccgcgtaactcaagaattactgtttggcaaagatcacccagttgtcacagataaacgcgcccgcacagcacaaagcccaggcggtaccggtgctttacgtattgctgcggatttcattgccaaacagactaatgctaaacgagtttggatcagcaacccaacctggccaaaccataaaaacgttttttccgccgctggtctggaagtctgtgaatataaatactatgacgctgaaaaacacgcgctgaatttcgaagacatgctggcaagcctgtccgaagctcaggctggtgatgttgttctgttccacggctgctgccacaatccgacaggcatcgatccaaccccggcacaatgggctaaactggcagaaatgtctgcggagaaaggctggttgcctatttttgatttcgcttaccaaggatttgccaagggcctaaacgaagatgcagagggcctacgtatttttgcgaaaaatcataatgaactgattgttgccagctcttactccaaaaactttggcctgtacaatgaacgtgtcggtgcctgtactattgttgctagtgacagtgatacagcagaaaaagcgttcagccaagctaaagcgattatccgtgctaactattccaacccacccgctcatggtgcatctattgtcactaccattttgtcaaatgaagacctgaaagcagcttgggaacaggaactgaccaccatgcgcgaacgtatccagcgtatgcgtcaactgtttgtcaataccttgcaggaaaaaggggcaaaacaggatttcagctttattattagccaaaatggtatgttctcattcagtggcctgacaaaagaacaagtagaacgtctgcgtgatgagtttggtatatacgctgtcagttccggtcgtattaacgtcgctggcttgacgttagaaaacatggctccactatgtgaagccattgttgcagtactctaa

SEQ ID NO: 54941 - protein, 396 aa, Photorhabdus luminescens subsp. laumondii TTO1
MFEKITAAPADPILGLADSFRSDPRTNKINLGIGVYKDETGKTPVLTSVKKAEQYLLENETTKNYLPISGLAEFGRVTQELLFGKDHPVVTDKRARTAQSPGGTGALRIAADFIAKQTNAKRVWISNPTWPNHKNVFSAAGLEVCEYKYYDAEKHALNFEDMLASLSEAQAGDVVLFHGCCHNPTGIDPTPAQWAKLAEMSAEKGWLPIFDFAYQGFAKGLNEDAEGLRIFAKNHNELIVASSYSKNFGLYNERVGACTIVASDSDTAEKAFSQAKAIIRANYSNPPAHGASIVTTILSNEDLKAAWEQELTTMRERIQRMRQLFVNTLQEKGAKQDFSFIISQNGMFSFSGLTKEQVERLRDEFGIYAVSSGRINVAGLTLENMAPLCEAIVAVL

SEQ ID NO: 54942 - DNA, 1200 bp, Photorhabdus luminescens subsp. laumondii TTO1
  CDS (1)..(1200)
atgttccagaatgttgatgcttatgctggtgatccgattctttcgctggctgaagaatttaaaaaagatcctcgtgcggaaaaaattaatctgagcatcgggctttattacgatgagcagggagtgactccgcaattgcaggcagtggctaccgcagaagaacaacttagagcgttgtcacagactgcttctctttatctgccaatggagggattggaatcctatcgtcttgcggttcaggaactgttatttggtaaagatcatccggtgttgaaacagcgggtggtggcaacgattcaatcattaggtggttctggcgctcttaaaattggtgctgactttttgcatcgttatttccctgattcagaagtgtggtgcagtgatccaacttgggaaaaccacgcagctatttttgcgggggcaggtattaaggtgaactattacccttattttgatacacagaccaaaggggtaaaattcagtgaaatgctggaaacattcaggaaactgccggcaaaaagcattattgtgatgcacccttgttgccataacccaaccggatcggatctgacctatgatcaatgggatcaagttgttcaaattgttaaagagagagagctcctgccattccttgatattgcttatcaggggcttgcggatgggatggaaaaagatgcttatgccattcgtgctatggcgacagccggtttgccttgtctggtgagcaactctttctccaagatattttctatgtatggtgagcgagtgggtggcttgtctgttatttgtgatgatgagcagaccaaagaacgggtattggggcagttgaaagcaggtgtgcgtcgcgtttactctagcccaccgagttttggtgcacaggttgtggcgaaagtactgactgatcctgctttgaaggcacaatggttaacagaagttgagcatatgcgcttgcgtattttggaaatgcgcacggtgctggtggatgctctgaaaacggcattaccagagaaaaactttgagtattttctgaaacagcgcgggatgttcagctataccggttttagccagaaacaggtggatcgcttgcgccaagaatttgctgtttatctggtcggtaatggccgagtctgtatggcgggcgtcaaccatcgtaatgttgcacgtattgctgaaacatttgcggcggtaaataagtcataa

SEQ ID NO: 54943 - protein, 399 aa, Photorhabdus luminescens subsp. laumondii TTO1
MFQNVDAYAGDPILSLAEEFKKDPRAEKINLSIGLYYDEQGVTPQLQAVATAEEQLRALSQTASLYLPMEGLESYRLAVQELLFGKDHPVLKQRVVATIQSLGGSGALKIGADFLHRYFPDSEVWCSDPTWENHAAIFAGAGIKVNYYPYFDTQTKGVKFSEMLETFRKLPAKSIIVMHPCCHNPTGSDLTYDQWDQVVQIVKERELLPFLDIAYQGLADGMEKDAYAIRAMATAGLPCLVSNSFSKIFSMYGERVGGLSVICDDEQTKERVLGQLKAGVRRVYSSPPSFGAQVVAKVLTDPALKAQWLTEVEHMRLRILEMRTVLVDALKTALPEKNFEYFLKQRGMFSYTGFSQKQVDRLRQEFAVYLVGNGRVCMAGVNHRNVARIAETFAAVNKS

SEQ ID NO: 54944 - DNA, 1287 bp, Danio rerio
  CDS (1)..(1287)
atggctctcctcaaaaccaccaagttcatctcttctgttgggagtttgactccttcgttggctagcctacctattagagccagctcatggtggactgaggtgcagatgggaccccctgatcccatcctgggggtgactgaggccttcaaaagggacacaaactcaaagaaaatgaaccttggtgtgggggcatacagggatgacaatggcaagccatacgttctcaactgtgtccgcaaggctgaatctctgattgcctctaaggcgctggataaagagtatctaggcattgtgggtctgggggatttcaataaggcttgtgctgagcttgcactggggcaggacagtgacgttctcaaaagcaagaggagcattactgtccagacaatctcaggcactggttctttgagggttggagccaatttcctgtcacgcttccacacagttgcgagggatgtgtacttgccgaagccatcctggggaaatcacacacctattttccgtgatgctggtatgcaactgaaagcgtaccgctactatgatcctgctacttgtggctttgacttcactggagcgcttgatgacatctctaaaattccacagaatagtgtaatcctgctccatgcttgtgctcataaccccactggggttgacccacgaccagagcagtggaaggagctgtcagccgtcattaaggagaggaaacttctgccgttctttgacatggcctaccagggctttgctagtggagacattgatcgggatgcctgggctgtgagatacttcattgagcagggccacaacattctcctgtcccagtcttttgccaagaacatgggtctctatggtgagcgtgttggaggattcacagtggtgtgtggagatgctgaagaggctaaaagagtcgagtctcagcttaagattctgattcgccccatttactccaaccctcccatgaatggtgcccgcatcgcctccacgatcctcactacaccagagctgcgttctacatggctggaggaggtgaagggaatggcagaccgtatcattcgaatgagagaaatgctggtgactaatctgaagaaggagggctccactcacaactggcaacacgtgactgaccaaatcggcatgttctgctttactggactcaaacctgagcaggtggagcgtcttacaaaggacttctctgtttacatgactaaagatggccgtatcagcgttgccggcgtgacctctggaaatgttgaatacctcgcacatgccattcaccaggtcaccaagtag

SEQ ID NO: 54945 - protein, 428 aa, Danio rerio
MALLKTTKFISSVGSLTPSLASLPIRASSWWTEVQMGPPDPILGVTEAFKRDTNSKKMNLGVGAYRDDNGKPYVLNCVRKAESLIASKALDKEYLGIVGLGDFNKACAELALGQDSDVLKSKRSITVQTISGTGSLRVGANFLSRFHTVARDVYLPKPSWGNHTPIFRDAGMQLKAYRYYDPATCGFDFTGALDDISKIPQNSVILLHACAHNPTGVDPRPEQWKELSAVIKERKLLPFFDMAYQGFASGDIDRDAWAVRYFIEQGHNILLSQSFAKNMGLYGERVGGFTVVCGDAEEAKRVESQLKILIRPIYSNPPMNGARIASTILTTPELRSTWLEEVKGMADRIIRMREMLVTNLKKEGSTHNWQHVTDQIGMFCFTGLKPEQVERLTKDFSVYMTKDGRISVAGVTSGNVEYLAHAIHQVTK

SEQ ID NO: 54946 - DNA, 1332 bp, Eremothecium gossypii
  CDS (1)..(1332)
atgacacagacaaaccaggtcagagcaagcaccaaaggagtactgggcatgacaagaaatgtagtaggggcgttcacggctaactggcgctgccgcaggcagcaccaagcgcttggacgggtgccggaggcgatgccagaccagatattggggctcacggagcgattcaaccaggaccggaacccgcacaaggtgaacttgaccgtggggatctacaaggacgacaatggggaggtgacgagcttcccgtccgtggcgcgggcgcagcttatggtggaggggcagcggggcggcaggctggcgtacctgccaattgccgggtgtccgagctacggtgcgagggtcagcgactttttgtacagcgagtgtgcgccgcaggggcgggaattcctagccagcggatgcgtcagcttcatgcagacgctgagtgggacgggggcgctctcgctggcatccctgttcctctcgaacttcatctcgaagacgatctgggtgccgcagccctcgtgggccaaccacatgaatatcttcaagctaaacgggtttgaggaggtccgacggtaccgctactacgaggacggggcggtggacgtcgacagctggcttgcccagctagaacgcgcggccgccgaccggccatatccacagtgtattctgttgcatgcctgctgccacaaccccacgggcgttgaccccacgcgcgagcaatggtcccggatcttgagcgtaatcaacggacttggaatggtgcctatcgtggatatggcctaccaagggttggagtctggtgaccttcgtgccgatgcctacttgttgcggatgtgcctcgagcacagatgggacaacgggctttatgtgtgtcattcttttgcgaagaacatgggtctttatggcgaacgagtggggtccctcagtgtggtgcatccgctgggacaatttcaggctaaggccgcgacagattctcagttgaaatgtataatacgggcttcatactcatcaccgccttcatatggctctcgggtcgcaacgaccgtgctttctgtccccgaaatcaagcaacagtggcatgaagatgtacacgggatgtgcaatagactctggtctgtccgctgcatgttacatgagaaactacggtggcccaagttgatagacagtacctcgcaacacgggatgttttattataccggaattggccctgacgccgtggacaccctgagagagaaatattctgtttatttgaccaaggatggtcgattgtcgctagcaggaataaatactggcaatgttgattacgttgctagggcgcttcgtaacgtatctacatacccgtga

SEQ ID NO: 54947 - protein, 443 aa, Eremothecium gossypii
MTQTNQVRASTKGVLGMTRNVVGAFTANWRCRRQHQALGRVPEAMPDQILGLTERFNQDRNPHKVNLTVGIYKDDNGEVTSFPSVARAQLMVEGQRGGRLAYLPIAGCPSYGARVSDFLYSECAPQGREFLASGCVSFMQTLSGTGALSLASLFLSNFISKTIWVPQPSWANHMNIFKLNGFEEVRRYRYYEDGAVDVDSWLAQLERAAADRPYPQCILLHACCHNPTGVDPTREQWSRILSVINGLGMVPIVDMAYQGLESGDLRADAYLLRMCLEHRWDNGLYVCHSFAKNMGLYGERVGSLSVVHPLGQFQAKAATDSQLKCIIRASYSSPPSYGSRVATTVLSVPEIKQQWHEDVHGMCNRLWSVRCMLHEKLRWPKLIDSTSQHGMFYYTGIGPDAVDTLREKYSVYLTKDGRLSLAGINTGNVDYVARALRNVSTYP

SEQ ID NO: 54948 - DNA, 1260 bp, Eremothecium gossypii
  CDS (1)..(1260)
atgtctttgactgcgtttaaccagctagaaatccttcctccggacgcactgttcgatgtcaagaagcggctaacccaagacacgcggtcgtttaaagttgacctcgggctcggggcataccgggacgaaaacgggaagccgtgggtgctaccgtgtgtgcgcgaagcggagaaacagttgatggcggaccccggatacaaccacgagtacctggggattgccgggctggaggagttccgcgcggccgcggcgcgtgtgctactcggcgaagacagcgaggcgctggccgagggccgggtggtgtcggtgcagtcgatttccggcaccggggcgctgcacgtggcggcgaagctacttgcgaagacggtgccagatgcgacggtgtacatgtcggaccccacgtggggcaaccactttgccgtgttcgagacacagggtctgcgcacggcgacgtacccatactgggatgcggcgacccgctcactggacatggagggcgttctgggcgcgctgggcgcggcgccgcgcgggtcggtcttcgtgctgcacgcttgtgcgcacaatccaacggggcttgaccccaacgaggagcaatgggtgcagatcctggacgcggtagccgcgcgcgagcacaccgtgctgttcgatagcgcctaccaggggtttgcgtcgggcagcctggctcgcgacgcgtacgcgctgcgcgccgggctgcggcgcctggccgaggtcacgccggtgcttgtgtgtcagtcctttgccaagaacattggcatgtacggtgagcgtgtgggcgctctgcatgttgtcctgccccgccagcctgccgagtcgctggcgcacgtcaaggctgccgtgctgtcgcagctgagccacatcacgcgctcggagctgtcgaacccgcccgcctacggcgccaagatcgtgaccaaggtcctcaccacccccgaactcgccgctcagtggaagaaggacatgatcaccatgtcgagccgcattgcgcgcatgcgccgcgtgctccgcgaccgtctggtcgagctcggtacacctggcaactgggaccacatcgtccaacagtgcggcatgttctcatacaccggtttgacgaaggagatggtcgcccgcatggaaaaggacttcgccatctacatggtctcctcgggccgcatttcgatagccggccttaacgacagcaatgtcggccacgttgccaacgcaattgacaatgctgttcgccacttctctacacccaagctgtga

SEQ ID NO: 54949 - protein, 419 aa, Eremothecium gossypii
MSLTAFNQLEILPPDALFDVKKRLTQDTRSFKVDLGLGAYRDENGKPWVLPCVREAEKQLMADPGYNHEYLGIAGLEEFRAAAARVLLGEDSEALAEGRVVSVQSISGTGALHVAAKLLAKTVPDATVYMSDPTWGNHFAVFETQGLRTATYPYWDAATRSLDMEGVLGALGAAPRGSVFVLHACAHNPTGLDPNEEQWVQILDAVAAREHTVLFDSAYQGFASGSLARDAYALRAGLRRLAEVTPVLVCQSFAKNIGMYGERVGALHVVLPRQPAESLAHVKAAVLSQLSHITRSELSNPPAYGAKIVTKVLTTPELAAQWKKDMITMSSRIARMRRVLRDRLVELGTPGNWDHIVQQCGMFSYTGLTKEMVARMEKDFAIYMVSSGRISIAGLNDSNVGHVANAIDNAVRHFSTPKL

SEQ ID NO: 54950 - DNA, 1239 bp, Gallus gallus
  CDS (1)..(1239)
atggccgcctccatcttcgccgctgtgccccgcgctccgcccgtcgccgtcttcaagctgacggcggacttccgggaggacggcgactcgcgaaaggtcaacctgggtgtgggcgcgtaccgcacggatgaagggcagccgtgggtcctgccggtggtgaggaaggtggagcagctgatcgctggcgacggcagcctgaaccacgagtacctgcccatcctcggcctgccggagttccgcgccaacgcctcccgcatcgccctgggcgacgacagcccggccatcgcacagaagagggttgggagtgtccagggtttgggcgggacgggcgctctgcgtataggtgccgagttcctgaggcgttggtacaacgggaacaacaacactgccacccctgtgtacgtctcgtccccaacatgggagaaccacaactctgtatttatggatgctgggtttaaagatatcagaacctaccgctactgggatgctgccaagaggggtttggacctccaggggctgctggatgacatggagaaagccccagagttctccattttcatcctccatgcctgtgcacacaacccaacgggcacagaccctactccagacgagtggaagcagattgctgctgttatgaagcgacggtgcctgtttccgttcttcgactcggcgtatcaaggttttgcctctggcagcctggacaaggatgcctgggctgtgcgatactttgtctccgagggctttgagctcttctgtgcacagtcgttttccaagaactttgggctctacaatgaacgtgtggggaacctgtctgtggtggggaaggatgaagacaatgtgcagcgtgtgctttcccagatggagaagattgtgcgtaccacttggtccaaccctccctcccagggagcacgcattgtggcaactacgcttacttccccacagctctttgctgagtggaaggacaatgtgaagacaatggcagatcgggtcttgctcatgcggtcagagctccggtctcgcctggagtcccttgggaccccaggcacctggaaccacatcacagatcaaattggcatgtttagctttacagggttgaaccctaagcaggtggagtacatgatcaaggaaaaacacatctacctgatggctagtgggcgcatcaacatgtgtggtctgactaccaagaacctggactatgtggccaagtccatccatgaagccgtcacaaaaatccagtga

SEQ ID NO: 54951 - protein, 412 aa, Gallus gallus
MAASIFAAVPRAPPVAVFKLTADFREDGDSRKVNLGVGAYRTDEGQPWVLPVVRKVEQLIAGDGSLNHEYLPILGLPEFRANASRIALGDDSPAIAQKRVGSVQGLGGTGALRIGAEFLRRWYNGNNNTATPVYVSSPTWENHNSVFMDAGFKDIRTYRYWDAAKRGLDLQGLLDDMEKAPEFSIFILHACAHNPTGTDPTPDEWKQIAAVMKRRCLFPFFDSAYQGFASGSLDKDAWAVRYFVSEGFELFCAQSFSKNFGLYNERVGNLSVVGKDEDNVQRVLSQMEKIVRTTWSNPPSQGARIVATTLTSPQLFAEWKDNVKTMADRVLLMRSELRSRLESLGTPGTWNHITDQIGMFSFTGLNPKQVEYMIKEKHIYLMASGRINMCGLTTKNLDYVAKSIHEAVTKIQ

SEQ ID NO: 54952 - DNA, 1233 bp, Danio rerio
  CDS (1)..(1233)
atgtcgatatttggtgaagtcccacaggctgctcctgtcgcagtgttcaaactgacagcagatttccgtgaggatcaggatcagaagaaggtgaatctgggagtcggagcctacaggacagatgaatgtcagccctgggttctccccgtggtgaggaaagtggagaagatgatcgctgatgaccacagtttgaaccacgagtacctgcccatcctaggcctgccagaatttcgttccagcgcatctaagatcgctcttggtgaagacagtcctgctattaaggagaaccgggtaggggctgtgcagtgtttaggaggtactggtgctctaaagatcggagctgaatttcttcgccgctggtacaatggaactgacaacacaaaaactccagtttatgtgtctgcaccaacatgggaaaaccacaatgccgttttctctaatgctgggtttgaggacatccgtccatacaaatactgggacccagtgaagcgtggactcgatctggcaggttttctgggtgacatggagagtgcacctgatcactccatcttcgttctgcatgcctgcgcccacaaccccactggcacagaccccacccaggaccaatggaagcagattgctgaagtcatgaagcgaaagaatctgtttgccttctttgattcagcctatcagggcttcgcctcaggagatttagagaaggacgcctgggccgtgcgttactttgtatcacagggttttgaattgttctgtgctcagtcgttctccaagaacttcggtctgtacaatgagagagtgggaaacctgactgttgtagccaaagatcaagacaatgtgaatcgtgtgctgtctcagatggagaagatcgtgagaatcacctggtcaaaccctccgtcacagggagctcgtctggtcgccatcacactaaacaccccggaactctttgctgagtggaaggccaatgtaaagactatggcagaccgagttctgctgatgcgagctcagctgaaggagaaactgaaggctctgggaactcctgggacctgggagcacatcactgaacagatcggcatgttcagcttcactggtctcaaccctaagcaggtggagtacatgataaaagaaaagcacatttatctaatggccagcggccgcatcaacatgtgcggtctcacctccaagaacatcgactatgtggccgagtccattcacgaggctgtcactaaagtccagtaa

SEQ ID NO: 54953 - protein, 410 aa, Danio rerio
MSIFGEVPQAAPVAVFKLTADFREDQDQKKVNLGVGAYRTDECQPWVLPVVRKVEKMIADDHSLNHEYLPILGLPEFRSSASKIALGEDSPAIKENRVGAVQCLGGTGALKIGAEFLRRWYNGTDNTKTPVYVSAPTWENHNAVFSNAGFEDIRPYKYWDPVKRGLDLAGFLGDMESAPDHSIFVLHACAHNPTGTDPTQDQWKQIAEVMKRKNLFAFFDSAYQGFASGDLEKDAWAVRYFVSQGFELFCAQSFSKNFGLYNERVGNLTVVAKDQDNVNRVLSQMEKIVRITWSNPPSQGARLVAITLNTPELFAEWKANVKTMADRVLLMRAQLKEKLKALGTPGTWEHITEQIGMFSFTGLNPKQVEYMIKEKHIYLMASGRINMCGLTSKNIDYVAESIHEAVTKVQ

SEQ ID NO: 54954 - DNA, 1287 bp, Danio rerio
  CDS (1)..(1287)
atggccctgttcaaatccagcaagattttgtctagtgtcgggtctcagacccctgttttagcagtcttacagctccgggcaagctcatggtggactgaggtacagatgggaccccctgatcccatcctgggggtcacggaggcttttaagcgtgacaccaaccccaagaagatgaaccttggagttggagcttatagagatgatcaggggaagccattcgtcctcagcagtgttcgaaaggctgaagcccagattgctgctaagaagttggataaagagtaccttcctattggaggtttggcagacttttcaaaggcctgtgttcagctggctcttggacctgataacgaggtcctgaagagcggcagaagcatcactgtccagactatctcaggaactggatctctacgtattggagctaactttgtgtcacgattccacaatgcgtcccgggatgtgtacctgcctaaaccctcttggggcaaccacacaccagtcttcagagatgcaggcatgcagctaaaggcttacacctactatgaacccaaaacctgtggctttaatcttaaaggagccttggatgacatttcaaaaatccctgagaagagtgtaattcttcttcatgcctgcgctcataatcccaccggagtggaccccaggcctgagcagtggaaagagatggccgctctgatcaagaaaagaaatctcctggtgttctttgacatggcttaccagggatttgccagtggcgacattgatcgtgacgcttgggctgtgcgttatttcattgagcaaggccacaacattctactgtcccagtcttttgctaagaacatgggcctgtatggtgagcgtgtgggaggcttcacagtggtttgtaaggatgccgaagaggccaagcgtgtggaatctcagctgaaaatcctcattcggcccatctactccaacccacccatgaatggcgctcgcatcgccgccactatcctcaacacacctgaactctacaaagaatggcttcaggaggtaaaaggcatggctgaccgcatcattaggatgagagagatgctcgtttccaaccttaaaaaggagggctccactcacaactggcaacatgtcactgaccagatcgggatgttctgcttcactgggctcaaaccggaacaggtggagcgtctgattaatgaattctctatatacatgacaaaagatggccggatttctgtggccggagtgacgtctgccaacgtggagtatcttgcacatgccatccacgccgtcaccaagtga

SEQ ID NO: 54955 - protein, 428 aa, Danio rerio
MALFKSSKILSSVGSQTPVLAVLQLRASSWWTEVQMGPPDPILGVTEAFKRDTNPKKMNLGVGAYRDDQGKPFVLSSVRKAEAQIAAKKLDKEYLPIGGLADFSKACVQLALGPDNEVLKSGRSITVQTISGTGSLRIGANFVSRFHNASRDVYLPKPSWGNHTPVFRDAGMQLKAYTYYEPKTCGFNLKGALDDISKIPEKSVILLHACAHNPTGVDPRPEQWKEMAALIKKRNLLVFFDMAYQGFASGDIDRDAWAVRYFIEQGHNILLSQSFAKNMGLYGERVGGFTVVCKDAEEAKRVESQLKILIRPIYSNPPMNGARIAATILNTPELYKEWLQEVKGMADRIIRMREMLVSNLKKEGSTHNWQHVTDQIGMFCFTGLKPEQVERLINEFSIYMTKDGRISVAGVTSANVEYLAHAIHAVTK

SEQ ID NO: 54956 - DNA, 1236 bp, Xenopus tropicalis
  CDS (1)..(1236)
atggcttccatttttacctccgttcctcaggctccccctgtggctgtcttcaagcttactgcagatttccgcgctgaccctgacactaggaaggtcaaccttggagtgggagcatatcgtactgatgactctcagccatgggtcctgccagtggtgaaaaaggtggagcagatgattgcaaaagacagctctttgaaccatgaatatctgccaattttggggctgcctgaattccgttctagtgcttccagaattgctttgggggatgacagccctgcatttaaggagaatcgggtaggcggtgtgcaatccttgggtggaactggagctctgcgcattggagcagaatttctgaggcgctggtacaatggaaacaacaacacagctactcccatctatatttcttctccctcatgggaaaaccacaatgctgtgttcagtgacgctggatttaaggatatcagggcttatagttactgggatgctgctaaaaggggccttgatctcgagggattcctgcgggatttagagaatgcccccgagttctctatctttgtgttgcacgcatgtgcgcacaatcccactggtacagaccccacccctgatgagtggaaacagatagctgatgtcatgaagcggaggtctctctttcctttcttcgactcagcctatcaaggatttgcctctggcagcctagacaaggatgcatgggccgtgcgtttctttgtgtctcagggttttgagttgttctgtgctcagtctttttccaagaactttggcttgtacaatgagagagtaggaaacctaactgttgtagggaaagactgtgataacgttgcacgtgtcctgtctcagatggagaaaattgtccgtacaacctggtcaaatcctccatcgcaaggagctcgtattgttgccaccactctcaacactcctgaactatttgatgaatggagagataatgtaaagactatggcagagagagtcctgctgatgagagcagaactgaaatcccgactggaggctcttaaaactcctgggacatggaaccatattgtcaaccagataggaatgttcagctacacaggacttaaccctaagcaagtggagtatcttattaaagagaagcacatctacttgatggccagtggacgtataaatatgtgtgggctgacaacaaagaacctcgactatgtagcccagtctatttatgaagcagcaaccaagatccagtaa

SEQ ID NO: 54957 - protein, 411 aa, Xenopus tropicalis
MASIFTSVPQAPPVAVFKLTADFRADPDTRKVNLGVGAYRTDDSQPWVLPVVKKVEQMIAKDSSLNHEYLPILGLPEFRSSASRIALGDDSPAFKENRVGGVQSLGGTGALRIGAEFLRRWYNGNNNTATPIYISSPSWENHNAVFSDAGFKDIRAYSYWDAAKRGLDLEGFLRDLENAPEFSIFVLHACAHNPTGTDPTPDEWKQIADVMKRRSLFPFFDSAYQGFASGSLDKDAWAVRFFVSQGFELFCAQSFSKNFGLYNERVGNLTVVGKDCDNVARVLSQMEKIVRTTWSNPPSQGARIVATTLNTPELFDEWRDNVKTMAERVLLMRAELKSRLEALKTPGTWNHIVNQIGMFSYTGLNPKQVEYLIKEKHIYLMASGRINMCGLTTKNLDYVAQSIYEAATKIQ

SEQ ID NO: 54958 - DNA, 1242 bp, Sus scrofa
  CDS (1)..(1242)
atggcacctccatcagtctttgccgaggttcctcaggcccagccggtccttgtctttaagctcattgctgacttccgggaggatccggacccccgcaaggtcaacctaggagtgggagcttatcgcaccgatgattgccagccttgggttttgccagtcgtgaggaaggtggagcagaggattgctaatgacagcagcctaaaccacgagtacctgcccatcctgggcctggcagagttccggacctgtgcttcccgccttgcccttggagatgacagcccagctcttcaggagaagcgggtgggaggggtgcagtctttggggggaacgggtgcacttcgaattggagctgagttcttagcacgatggtacaatggaacgaacaacaaagacacgcctgtctacgtatcctcaccaacctgggaaaatcacaatggagtcttcactactgctggattcaaagacattcggtcctatcgctattgggataccgagaagagaggacttgatctccagggtttcctgagtgatctggagaacgctcctgagttctccatctttgtcctccacgcctgtgcccacaacccgacagggaccgacccaactccggagcaatggaagcagatcgcctctgtcatgaagcgccggtttctgttccccttctttgactcagcctatcagggcttcgcatctggcaacctagaaaaagacgcctgggccattcgctattttgtgtctgaagggttcgagctcttctgtgcccagtccttctccaagaacttcgggctctacaatgagcgcgtggggaacctgaccgtggttgcaaaagaacccgatagcatcctgcgagtcctttcccagatggagaagatcgtgcgagtgacgtggtccaatccccctgctcagggagcgagaatcgtggcccgtacgctctctgaccctgagctctttcatgaatggacaggtaacgtgaagacaatggctgaccgcattctgagcatgagatctgagcttagggcacgattagaagccctcaagacccctggaacctggaaccacatcacggaccagattggaatgttcagcttcactgggttgaaccccaagcaggttgaatatctgatcaacgaaaagcacatctatctgctaccaagtggtcggatcaacatgtgtggcttaaccaccaaaaatctagattatgtggccacctccatccatgaagctgtcaccaaaatccagtga

SEQ ID NO: 54959 - protein, 413 aa, Sus scrofa
MAPPSVFAEVPQAQPVLVFKLIADFREDPDPRKVNLGVGAYRTDDCQPWVLPVVRKVEQRIANDSSLNHEYLPILGLAEFRTCASRLALGDDSPALQEKRVGGVQSLGGTGALRIGAEFLARWYNGTNNKDTPVYVSSPTWENHNGVFTTAGFKDIRSYRYWDTEKRGLDLQGFLSDLENAPEFSIFVLHACAHNPTGTDPTPEQWKQIASVMKRRFLFPFFDSAYQGFASGNLEKDAWAIRYFVSEGFELFCAQSFSKNFGLYNERVGNLTVVAKEPDSILRVLSQMEKIVRVTWSNPPAQGARIVARTLSDPELFHEWTGNVKTMADRILSMRSELRARLEALKTPGTWNHITDQIGMFSFTGLNPKQVEYLINEKHIYLLPSGRINMCGLTTKNLDYVATSIHEAVTKIQ

SEQ ID NO: 54960 - DNA, 1347 bp, Rattus norvegicus
  CDS (1)..(1347)
atggccctcctgcactctggtcacgtcctctccgggatggctgctgcgtttcacccaggccttacagctgcagcctctgccagagtcagctcctggtggacccatgttgaaatgggacctccagatcccatcctgggagtgaccgaagccttcaagagagataccaacagcaagaagatgaacctgggagttggtgcctaccaggatgataacgggaagccttacgtgctccccaatgttcggaaagcagaggttcagattgctggaaaaaatttggacaaagaatacctacccatctggggactggctgaattttgtaaggcttctgcagaactggccctggacaagaaaaatgaagtgttgaaaagcggccagtttgttactgtgcagaccatttccgggactggagccttaagggttggagccagttttctgcaaagattttttaagttcagccgagatgtctttctgcccaaaccatcctggggaaaccacacacccatcttcagggatgccggcatgcagctacaaggttatcgatactatgaccccaagacttgcggctttgacttctccggagccttagaagatatatcaaaaatcccagagcagaatgttctcattctgcacacctgtgctcacaaccccatgggtgtggacttgcgtccaaagcagaagaaggaaatggcgtcggtagtgaagaaaaagaaactctctgcattctttgacatggcctaccaaggttttgccagtggtgatggtgataaggactcctggaccatgcagcacttcaccgagcagagcatcaatgtctgcctctgccagtcgtatgccaagaacatgggcctgtacggtgagcatgtgggagccttcaccatggtctgcaaagacgcaaaagaagccaaaagggtggagtcacagctgaagatcctgacccgctccttgtactccaacccacgtctcaatggagcctggattgctgcaaccatcctgacttctccagatttgcgaaagcaatggttgcaagaggtgaaaggcatggctgatcacatcagcatgaggacccagttggtctccaacctgaagaaagagggcttgtcccacaactggcagcacatcaccgactggattggcatgttctgcttcgccggcctaaagcctgagcaggtggagcggctgaccaaggagttctcagtctacatgacaaaggatggccaaatctccatggcaggggtcacctctgacaatgtgggctaccttgccctgccattcaccagcttttctgaaagtttacacatgcaagaaaatcacagcaccaaaaacctgtcagccatggcatcggaatag

SEQ ID NO: 54961 - protein, 448 aa, Rattus norvegicus
MALLHSGHVLSGMAAAFHPGLTAAASARVSSWWTHVEMGPPDPILGVTEAFKRDTNSKKMNLGVGAYQDDNGKPYVLPNVRKAEVQIAGKNLDKEYLPIWGLAEFCKASAELALDKKNEVLKSGQFVTVQTISGTGALRVGASFLQRFFKFSRDVFLPKPSWGNHTPIFRDAGMQLQGYRYYDPKTCGFDFSGALEDISKIPEQNVLILHTCAHNPMGVDLRPKQKKEMASVVKKKKLSAFFDMAYQGFASGDGDKDSWTMQHFTEQSINVCLCQSYAKNMGLYGEHVGAFTMVCKDAKEAKRVESQLKILTRSLYSNPRLNGAWIAATILTSPDLRKQWLQEVKGMADHISMRTQLVSNLKKEGLSHNWQHITDWIGMFCFAGLKPEQVERLTKEFSVYMTKDGQISMAGVTSDNVGYLALPFTSFSESLHMQENHSTKNLSAMASE

SEQ ID NO: 54962 - DNA, 1140 bp, Rattus norvegicus
  CDS (1)..(1140)
atggccctcctgcactccaggatggctactacctttcacccaggccttgcagctgcagcctctgccagagccagctcctggtggacccatgttgaaatgggacctccagatcccatcctgggagtggctgaagccttcaagagagataccaacagcaagaagatgaacctgggagtctgtgcctaccgggatgataacggaaaaccttacatgatccccagtatccggaggcagaggcccagattgctggaaaaaatttggacgaagaatgcctacccatcgggggactggctggttttttttagccaagatgtctttctacccaaaccatcctggggaaaccacacgcccttcttcagggatgccggcatgcagctacaaggttatcgatactatgacccacagacttgcggctttgacttctctggagccttagaagacatatcaagaatcccagagcagagtgttctccttctgcacgcctgtgctcacaaccccatgggtgtggacccacgtccagagaagtggaaggaaatggtgtccgtggtgaagaaaaagagtctcttcgcattctttgacatggcctaccaaggttttgccagcggtgatggtgataaggacgcctgggccgtgcagcacttcatcgagcagggcatcaatgtctgcctctgccaatcgtatgccaagaacatgggcctgtacggtgagcgtgtgggatccttcacggtggtctgcaaagatgagaaagaagccaaaagggtggagtcacagctgaagatcctgattcgccccttgtatccagccccgcctctcaatggagctcggatcgctgcaaccatcctgacttctccagacttgcgaaagcaatggttgcaagaggtgaaaggcatggctgaccgcatcatcagcaagaggacccagttgatctccaacctgaagaaagagggcttgttccacaactggcagcacatcaccgaccagattggcatgttctgcttcactttaaagcctgagcaggtggagcgactggccaaggagttctcagtctacatgataaaggatggccgaatctccgtggccggggtcacctctggcaatgtgtgctacctcacccatgccattcaccaggtcaccaagtaa

SEQ ID NO: 54963 - protein, 379 aa, Rattus norvegicus
MALLHSRMATTFHPGLAAAASARASSWWTHVEMGPPDPILGVAEAFKRDTNSKKMNLGVCAYRDDNGKPYMIPSIRRQRPRLLEKIWTKNAYPSGDWLVFFSQDVFLPKPSWGNHTPFFRDAGMQLQGYRYYDPQTCGFDFSGALEDISRIPEQSVLLLHACAHNPMGVDPRPEKWKEMVSVVKKKSLFAFFDMAYQGFASGDGDKDAWAVQHFIEQGINVCLCQSYAKNMGLYGERVGSFTVVCKDEKEAKRVESQLKILIRPLYPAPPLNGARIAATILTSPDLRKQWLQEVKGMADRIISKRTQLISNLKKEGLFHNWQHITDQIGMFCFTLKPEQVERLAKEFSVYMIKDGRISVAGVTSGNVCYLTHAIHQVTK

SEQ ID NO: 54964 - DNA, 1200 bp, Anopheles gambiae str. PEST
  CDS (1)..(1200)
atggggaataccatgtttgaaaaggttgttgccgccccagcggatccgatcctgggcctgaccgaagccttccgtgctgactctcgcagccacaagatcaacctgggggtcgggatctacaaggatgagaccggtgccacccccattctccactgcgtcaagaaagccgagcagaagctcttgaccgacgagaagaccaagaattacctcggtatcgaaggcaatatcgaatatggccgcatcgtgcagcaactgctgttcgggcaagattctgcgctggtcgccagcggccgggccaagactgctcaggcgccgggcggtaccggtgccctgcgcatcgccgccgagttcgtggcgcgcaacgggctggccaagactgtctggatctccgatcccacctgggccaaccacgtcagcgtgttccaggctgccggcctttccgtcaagtggtacaagtactacgatgcggccaccaagggcctcgactttgccgccatgcaggcctcgctggctgaagtgcaggcaggcgatctggtgctgctgcacggctgctgccacaacccgaccggtatcgaccccacagctgatcagtggtgcgcactggccaagcagagtgctgccgccggctggctgccgctgtttgacttcgcctatcagggctttgcccgcggtatcgaagaggatgccgaaggtctgcgcatcttcgccgagtgccacgacgaactgctggtggcgagctccttctccaagaacttcggcctctacaacgagcgggtcggcgccttcaccctggtcagtgcgaccaaggagatcgccgacgtggccttcacccaggtcaagaccgttattcgtgccaactactctaacccgccgtcacacggcgcagctgtcgtcactgccgtagtgagcgatccggccctctatgccgaatgggtggaagaagtggcggccatgcgggtgcgtattcgcgagatgcgtgagctgctggtggagaaactggcggcgcgcggcgtgaaccaggacttcagctttatccgcgagcaaaacggcatgttctccttctccggtctctccaaggatcaggtggagcgcctcaagagcgagtttgccatctacatcgtcggctcgggccggatcagcgtagcaggtatcacccgcgccaacatagctccgctctgcgatgccatcgccaaggtgtag

SEQ ID NO: 54965 - protein, 399 aa, Anopheles gambiae str. PEST
MGNTMFEKVVAAPADPILGLTEAFRADSRSHKINLGVGIYKDETGATPILHCVKKAEQKLLTDEKTKNYLGIEGNIEYGRIVQQLLFGQDSALVASGRAKTAQAPGGTGALRIAAEFVARNGLAKTVWISDPTWANHVSVFQAAGLSVKWYKYYDAATKGLDFAAMQASLAEVQAGDLVLLHGCCHNPTGIDPTADQWCALAKQSAAAGWLPLFDFAYQGFARGIEEDAEGLRIFAECHDELLVASSFSKNFGLYNERVGAFTLVSATKEIADVAFTQVKTVIRANYSNPPSHGAAVVTAVVSDPALYAEWVEEVAAMRVRIREMRELLVEKLAARGVNQDFSFIREQNGMFSFSGLSKDQVERLKSEFAIYIVGSGRISVAGITRANIAPLCDAIAKV

SEQ ID NO: 54966 - DNA, 1269 bp, Anopheles gambiae str. PEST
  CDS (1)..(1269)
atggtgcttcgcaagtgtgcaactacgttccagcaaataccaccaactgcaacgatgagcatcttcgcctcggtcgagctgggccctcccgtggaggtgtttgcccttaataaggcctgcaacgacgaccccaatccgaacaaggttaatcttggcgtaggagcctatcgcacgaacgagggcaaaccttggattctgccggtggtgaagaaggccgaggccgctatcgtcgccgatggatcgctcaaccacgagtacctgccggtgctcggtatggacagtatcacgaatgcggccagcacgctgctgctgggcgacggtagcgaggcgctcgcgagcaagcgggcgttcggcgtgcagtgcctgtccggtaccggggccctccggctgggggccgaatttttggcccgcatactgcaccgcaccgtcttctactactccgacccgacgtgggaaaaccaccacaaggtgttcctgtacgcgggcttcacggagccgcgcacctaccggtactggcaccaggagacgcgggccatcgactttgccggcatgctggaggatctggagcaggcgcccgagggggcggtcgttattctgcacgcctgcgcccacaacccgaccggcatcgatccgaccgaggaccagtggaagcagatcgcggacgtgtgcgagaagcgcaagctgttcccgttcttcgactccgcctaccagggctttgcgagcggcgacccgaacaaggacgcgttcgccgtgcgctacttcgtgagccgcggatttgagctgttctgtgcgcaaagctttgccaagaattttggcctctacaacgaacgtatcggtaatttgacggtcgtgcagaaggaggccagcaccagtgcggccgtcgcgtcgcagatcacgctgctcgtgcgcggcatgtactcgaacccgcccgccttcggcagccgcatcgtgagccgcgtgctgaacgacacggagctgcgcagcgagtggatggagtgcatcaagacgatgagctcgcgcatcatcaccatgcgcaaggcgctgtacgatgagctggtggcgctgaagacgcccggcacctgggaacacattaccaaccagatcggcatgttctcctacaccggactgaatgagaaacaggtccagatactgatgaaggagtttagcatctacctgctgaaaacgggacgcatcagcatgtgcgggctcaacgagagcaatgtggcgtacgtggccaaggctatccatgccgcagtgaccagggaatag

SEQ ID NO: 54967 - protein, 422 aa, Anopheles gambiae str. PEST
MVLRKCATTFQQIPPTATMSIFASVELGPPVEVFALNKACNDDPNPNKVNLGVGAYRTNEGKPWILPVVKKAEAAIVADGSLNHEYLPVLGMDSITNAASTLLLGDGSEALASKRAFGVQCLSGTGALRLGAEFLARILHRTVFYYSDPTWENHHKVFLYAGFTEPRTYRYWHQETRAIDFAGMLEDLEQAPEGAVVILHACAHNPTGIDPTEDQWKQIADVCEKRKLFPFFDSAYQGFASGDPNKDAFAVRYFVSRGFELFCAQSFAKNFGLYNERIGNLTVVQKEASTSAAVASQITLLVRGMYSNPPAFGSRIVSRVLNDTELRSEWMECIKTMSSRIITMRKALYDELVALKTPGTWEHITNQIGMFSYTGLNEKQVQILMKEFSIYLLKTGRISMCGLNESNVAYVAKAIHAAVTRE

SEQ ID NO: 54968 - DNA, 1206 bp, Anopheles gambiae str. PEST
  CDS (1)..(1206)
atgtcctggtggagcggcgtacagatgggaccgccggacgttatcctgggcgtgacggaagcgtacaagcgcgacacgaacccgaaaaagatcaacctgggcgtcggtgcgtaccgtgacgacagcggcaaaccgttcgtgctgcccagcgtgaaaaaggccgagcagcggcttgcacagaagcagctcgatcacgaatactcgcccatcggtggaacggccgaattttgcaaacacagcatcctgctggcgctgggcgaatcgagcgagcacgtcgcgaatgggctgaacgccacggtgcagggcatcagtggaaccggtgcgctacgcatcggtggtgccttcctggccagcttcttccccggcccgaaggatatctatctgccgacaccgtcctggggcaaccatgggcccatcttccgccactcggggctgaacgtgaaggcgtaccgctactacgatccatcaacctgtggctttgattttgctggcgcgctggaagatctgtcgaaaatcccagaaaagtcaatagtattactacatgcgtgcgcccacaatcccaccggcgtcgacccgaaaccggaacagtgggccgagatgtcggccctcatcaagaagcgcaatctgttcccgttcttcgacatggcctaccagggctttgcgagcggtgacgtcgacaaggatgcgctggcggtgcgcgagttcttgcgcgatggccatcagattgcgctggcccaaagtttcgccaagaacatgggcctgtacggtgagcgggcgggagcgttctcgctggtcacgggcagcaaggacgaagccgaccgtacgatgtcgcagatcaagatcctgatccgaccgatgtactcgaacccgcccattcacggtgcccggctggtggccgaaattttgggcgacaaatcgctccgccaggagtggctcggtgacgtgaagctgatggccgatcgtatcatctccgtgcgctcctcgctgcgcaacaacctgaaggagctgggctcgtcgcgcaactggtcgcacattaccgaccagatcggcatgttctgcttcacgggcatgaatcagcagcagtgcgagcgtttgtcgaaggagttcagcgtttacctcacgaaggacggccgtatttcgatggcgggcgttacctcgaagaatgtgggctatctggccgaagcgatccatgccgttacgaagtag

SEQ ID NO: 54969 - protein, 401 aa, Anopheles gambiae str. PEST
MSWWSGVQMGPPDVILGVTEAYKRDTNPKKINLGVGAYRDDSGKPFVLPSVKKAEQRLAQKQLDHEYSPIGGTAEFCKHSILLALGESSEHVANGLNATVQGISGTGALRIGGAFLASFFPGPKDIYLPTPSWGNHGPIFRHSGLNVKAYRYYDPSTCGFDFAGALEDLSKIPEKSIVLLHACAHNPTGVDPKPEQWAEMSALIKKRNLFPFFDMAYQGFASGDVDKDALAVREFLRDGHQIALAQSFAKNMGLYGERAGAFSLVTGSKDEADRTMSQIKILIRPMYSNPPIHGARLVAEILGDKSLRQEWLGDVKLMADRIISVRSSLRNNLKELGSSRNWSHITDQIGMFCFTGMNQQQCERLSKEFSVYLTKDGRISMAGVTSKNVGYLAEAIHAVTK

SEQ ID NO: 54970 - DNA, 1449 bp, Neurospora crassa
  CDS (1)..(1449)
atggcgcctgcctcgactttattgcgcgctgccgctcccgctcctcacgcccacacttccttcccctcccaccacacaccaacgtcatcgccaaatcgcacaaccatcaccaacaccaaccctagtgccaactccacctcttctactcccctccaccgaatccagaccatcgccaaacacatggcgctgccacaaataacaagtttccccgccgaggtggtacctcaagcccccgaggatcctctctttgggttggcgagagcgttcaaggcggacccaagtccccaaaaagttgatttgggcatcggcgcgtacagagatgagaatgcgaagccgtgggtattaccagttgtcaagaaggccgatgaaattatacgaaatgaccctgaagccaaccacgaatatctccccatcgccggtctcgcttccctaaccagcaaagccgccgagctcgttgtcggtgcctctgctcccgccatcactgaggggcgcgtcgcctcgatccagaccatctccggcactggcgcctgccatctcggcggtctcttcctctcgcgcttctacaacccatacggcgacgcttccaagaagcccaccgtctacctcagcaatccaacatgggccaaccacaaccagatcttctccaacgtcggcctccccatcgcccaatacccttacttcgaccagaagaccaagggcctcgacattgacggcatgaagaaggccctctctgacgcccccgagcgctccatcatcctcctccacgcctgcgcccacaaccctaccggcgtcgaccctacgctcgcccagtggcgcgagatcgccgagatcatggccgccaagggccactttcccttcttcgacaccgcctaccagggtttcgcttcgggcgacctcgaccgggacgcctccgccatccggctcttcgtcgagctcggtttcgagctcgtagtcgcccagtccttcgccaagaactttggtctctacgggcaacgcgctggctgcttccacttcatctccgctccttcgcccgacgctgcgtccataaccacccgcgtggcctcgcagctcaccctactccagcgctccgagatttctaacccgcccatctacggcgccaaggtggcttcgatcgtcctcaacgaccccgcgctcttcgccgagtggaaggagaacctgcgtaccatgtcgggccgcatcatcgacatgaggaaagctctgcgggcaaagctcgaggagctgggcaccccgggcccgtggaaccacattaccgaccaaatcggcatgttctcatttaccgggttgaacgagaagcaggtggctaagctcagggaggagttccacatctacatgaccaagaacggccgcatcagcatggccggtctaaataagaagaacgtagattacgttgccagggcggtggacaaggttgtcagggaagtgcaatag

SEQ ID NO: 54971 - protein, 482 aa, Neurospora crassa
MAPASTLLRAAAPAPHAHTSFPSHHTPTSSPNRTTITNTNPSANSTSSTPLHRIQTIAKHMALPQITSFPAEVVPQAPEDPLFGLARAFKADPSPQKVDLGIGAYRDENAKPWVLPVVKKADEIIRNDPEANHEYLPIAGLASLTSKAAELVVGASAPAITEGRVASIQTISGTGACHLGGLFLSRFYNPYGDASKKPTVYLSNPTWANHNQIFSNVGLPIAQYPYFDQKTKGLDIDGMKKALSDAPERSIILLHACAHNPTGVDPTLAQWREIAEIMAAKGHFPFFDTAYQGFASGDLDRDASAIRLFVELGFELVVAQSFAKNFGLYGQRAGCFHFISAPSPDAASITTRVASQLTLLQRSEISNPPIYGAKVASIVLNDPALFAEWKENLRTMSGRIIDMRKALRAKLEELGTPGPWNHITDQIGMFSFTGLNEKQVAKLREEFHIYMTKNGRISMAGLNKKNVDYVARAVDKVVREVQ

SEQ ID NO: 54972 - DNA, 1290 bp, Neurospora crassa
  CDS (1)..(1290)
atgctttcctcggtcagacttgtcacgcgcagagctgctgtcagaagcgcttttgcttcccctggtcgcagcttgcttgctgtccgcgccgcctcgttctgggccaacgtcccccaaggtcctcctgatgccattctcggtatcacggaagctttcaaggccgacaccttcgacaagaagatcaatctcggtgtcggtgcctaccgcgatgacaagggcaagccttacgtcctcccctccgtccgcaaggccgaggacaaggtcatccactcccgcatgaacaaggagtacgcaggcatcactggtgtccccgagttcaccaaggccgccgccgttctcgcctacggcaaggacagctccgccctggaccgtcttgtcatcacccagtccatctcgggtaccggtgccctccgcattggtggtgaattcctcaaccgcttcttccccggagccaagaagatctacatccccaccccttcgtgggccaaccacggcgccgtcttccgcgactccggtctcgaggtcgcccagtatgcctactacgacaagaacaccatcggcctcgactttgagggtctgatccgcgacctcaaggctgcccccaacagctccatcttcctcttccacgcctgcgcccacaaccccaccggtgtcgaccccacccccgagcagtggaaggagatcgaggccgtcgtcaaggacaagggccactactccttcttcgacatggcctaccagggtttcgcttccggcgacatccacaaggacgcttttgctgttcgctactttgtcgagcagggccacaacatctgccttgcccagtccttcgccaagaacatgggtctctacggcgagcgtgttggtgccttctccattgtctgtgccgacgccgacgagaagaagcgcgttgactcgcaggtcaagattctggtccgccctctctactccaacccccccattcacggtgcccgcatcgccgccgagatcctcaacacccccgagctctacgagcagtggcttaccgaggtcaaggagatggctgaccgcatcatcaagatgcgcgccctcctcaaggagaacctcgagaagctcggcagcaagcacgactggagccacatcaccagccagatcggcatgtttgcctacaccggtctgacccccgagcagatggagaagctggccaaggagcacagcgtgtatgccaccaaggacggccgtatctctgtcgctggtatcactagcgagaacgttggccgtctcgccgaggccattttcaaggtcaagggttag

SEQ ID NO: 54973 - protein, 429 aa, Neurospora crassa
MLSSVRLVTRRAAVRSAFASPGRSLLAVRAASFWANVPQGPPDAILGITEAFKADTFDKKINLGVGAYRDDKGKPYVLPSVRKAEDKVIHSRMNKEYAGITGVPEFTKAAAVLAYGKDSSALDRLVITQSISGTGALRIGGEFLNRFFPGAKKIYIPTPSWANHGAVFRDSGLEVAQYAYYDKNTIGLDFEGLIRDLKAAPNSSIFLFHACAHNPTGVDPTPEQWKEIEAVVKDKGHYSFFDMAYQGFASGDIHKDAFAVRYFVEQGHNICLAQSFAKNMGLYGERVGAFSIVCADADEKKRVDSQVKILVRPLYSNPPIHGARIAAEILNTPELYEQWLTEVKEMADRIIKMRALLKENLEKLGSKHDWSHITSQIGMFAYTGLTPEQMEKLAKEHSVYATKDGRISVAGITSENVGRLAEAIFKVKG

SEQ ID NO: 54974 - DNA, 1215 bp, Magnaporthe grisea 70-15
  CDS (1)..(1215)
atggtttttgaagcgatacagccgggtcctccggatcccatgaacctgctcaagacaacggccgacgcagacaccagtccggacaaggttgatctcggagttggaatctacagaaacgaaaagggaaactatcaggagctggcgtccgtgagggaggccaaggtgcaactgctacaaaatgaccctggacatgattacgaatgcacaaccggcaacgtagactttatcaaacacgcagccggcgtcatgttcggccgggacagcgccctcctcgccgccggcaagatcgcctcggtacagaccatatccggcacgggcgcggtgcacctcgcagcgcagttcatctcgcgcttcgtgcacccttcgccgaccgtctacgtgggcacgccgacctggggcaactacaagccgctgtgcgagctggtggggctgcagatcgtcgagttccagcagtacgactcggaaaaacgcacgctcgacttccccgccatcctggccgccgtccgctccgccccgagggcaagcgtcttcatcttccaggcctgctgccacaacccgacggggatggacccgacgcgcgcgcagtgggacgagctgcgggcggcggtgcgggacatgggccactttcccgtgtttgacaatgcgtaccagggcctcggggacgggctggacgaggacgcgtatgtggtgcggtcgtgggccgccgagggcatcgagatgtttgtctgccagtcatttagcaagaactttgccctgtacggggagcggtgcggcgtcctgcatgctttctgcccggccggggcgggtgcggcgcgcaacgttcacgatcagctgaggtgcttgatccgctgggagttttcgtcctcgccggcatatgggtcgaggctggtgactaggatcttgagttctgaagagctcaggtcgaaatgggaaaatgaactctccgtcatgcggcaaagactcaagggtaaccgtgagcttctattcaaactgctgactgaggaatacaagacgcccgggaactggcaacacatactcgaggaaaaaggcctcttctcctacttccgactaagccccgcccagtgtcgcgctctggtcgacaagcatcatatatatctccctacaaacggccgcatcaacatatccgggctaaatgatgcaaacgcgaaaagggttgccagcaaaatcgacgaggtcgtacgggatacccagtag

SEQ ID NO: 54975 - protein, 404 aa, Magnaporthe grisea 70-15
MVFEAIQPGPPDPMNLLKTTADADTSPDKVDLGVGIYRNEKGNYQELASVREAKVQLLQNDPGHDYECTTGNVDFIKHAAGVMFGRDSALLAAGKIASVQTISGTGAVHLAAQFISRFVHPSPTVYVGTPTWGNYKPLCELVGLQIVEFQQYDSEKRTLDFPAILAAVRSAPRASVFIFQACCHNPTGMDPTRAQWDELRAAVRDMGHFPVFDNAYQGLGDGLDEDAYVVRSWAAEGIEMFVCQSFSKNFALYGERCGVLHAFCPAGAGAARNVHDQLRCLIRWEFSSSPAYGSRLVTRILSSEELRSKWENELSVMRQRLKGNRELLFKLLTEEYKTPGNWQHILEEKGLFSYFRLSPAQCRALVDKHHIYLPTNGRINISGLNDANAKRVASKIDEVVRDTQ

SEQ ID NO: 54976 - DNA, 1374 bp, Magnaporthe grisea 70-15
  CDS (1)..(1374)
atgtcggcaaaagccacccggggcagcacctcttcgagcaccccacagaacagctcttcctcatcccaatctcagtcccaatccaccgcagtttcgaggatacggaatattgcaaaccacatgatggcatcaccaagcacaatcttcacggccgatgtcgttcctcaggccccagaagaccctctctttgggttgatggccgcctacagggccgatgaaagccccgacaaggtcgacttgggaattggtgcatacagggacgacaacgcaaagccgtgggtgcttcctgttgtcaagaaggccgatgaaatcatccgcaacgaccccagcgccaaccatgaatatctcccgatcaccggtctggcctccttcaccagcaaggctggcgagctgatgctcggcgccgatacacctgccaaaggccgcgtcacatctgtgcagaccatctccggcactggagctctgcacctcggagccctcttcctccagaagttctatcgcaaggtctatagcaactcggtcgtgcacctgtcgaaccccacctgggccaaccacaaccagatcttctccaacgtccaagtgccgacgacgacgtacccatactttgacaagggcaccaagggccttgacttcgaaggcatgaaggctacgttgaacaatgccgcagaacactccatcatccttctgcacgcttgtgcacacaatcccaccggtgttgaccccacgcagggccagtggcgcgagattgccgagatcatgaaggccaaaaagcacttcccgtttttcgactgtgcttaccaaggcttcgcttcgggcgatctggaccgcgatgcctgggccgttcgctactttgtggagcagggattcgagctcgtaattgcccagtctttcgccaaaaacttcggcttgtacggtgagcgggcgggctgcttccactacgtgtcggcgcctgcagccgaggctgccgaaacgaccaagagggttgcatcacaactcgccatcctccagcgctccgaaatctcgaacccaccaatctacggcgcccgcgtcgccagcatcgtgctcaacgacccggcgctcatgtccgaatggagagaaaatctgaggaccatgtcgggccgcatcattactatgcgcaacgagcttcgggcaaagctcgaagcgctgggcacccccggcacatggaaccacatcacggaccagatcgggatgttcagcttcacgggtctgaccgaggcacaggtcctgaagatccggagcgactaccacgtttacatgacgaagaatggtcgtatcagcatggcgggactcaactcgcgcaacattgactactttgctaaggcagttgataaggtggtgagggagacgcaataa

SEQ ID NO: 54977 - protein, 457 aa, Magnaporthe grisea 70-15
MSAKATRGSTSSSTPQNSSSSSQSQSQSTAVSRIRNIANHMMASPSTIFTADVVPQAPEDPLFGLMAAYRADESPDKVDLGIGAYRDDNAKPWVLPVVKKADEIIRNDPSANHEYLPITGLASFTSKAGELMLGADTPAKGRVTSVQTISGTGALHLGALFLQKFYRKVYSNSVVHLSNPTWANHNQIFSNVQVPTTTYPYFDKGTKGLDFEGMKATLNNAAEHSIILLHACAHNPTGVDPTQGQWREIAEIMKAKKHFPFFDCAYQGFASGDLDRDAWAVRYFVEQGFELVIAQSFAKNFGLYGERAGCFHYVSAPAAEAAETTKRVASQLAILQRSEISNPPIYGARVASIVLNDPALMSEWRENLRTMSGRIITMRNELRAKLEALGTPGTWNHITDQIGMFSFTGLTEAQVLKIRSDYHVYMTKNGRISMAGLNSRNIDYFAKAVDKVVRETQ

SEQ ID NO: 54978 - DNA, 1287 bp, Magnaporthe grisea 70-15
  CDS (1)..(1287)
atgctttcaaccatgagaattgcctcgcggcaggtcgccggtaggcggatggctgtccgccctcttgctgctttgcgcccagcttcaacttgggccaacgtccagatgggccctccagatgccattttgggtatcactgaagctttcaaggccgacagcaacaacaagaagatcaacctcggtgttggcgcctaccgcgatgacgctggcaagccctacgtgctgccgtcagtcaggcaagccgaggagaaggttattgcagctcgcatgaacaaggagtacgccggaatcactggtgtgcctgaattcacttcaggagctcttaccctggcctacggcaaggactcgaccgccctcgaccgcactgccatcacccagtccatttctggcactggtgctctgcgcatcggcgccgagttcctttccaagttctaccctggcgcgaagaacatctacatccccaccccgtcatgggccaaccacggcgccgtcttcacacaggccggcctgaaggttgagaagtaccgctactacaacaaggacaccatcggcctcgactttgagggtctggtcgccgacgtcaaggccgcacccaagggctccatcttcctcttccacgcctgcgcccacaaccccaccggtgtcgaccctactcctgagcagtggcgcgagattgagactgtcgtcaagtcggccggtcactacgccttcttcgacatggcttaccagggattcgcttcaggtgacatccacaaggacgcttttgcgctgcgccacttcgtcgcccagggtcacaacgtctgcttggcccagtccttcgccaagaacatgggtctgtacggcgagcgcgtcggtgctttctccatcgtgtgcgactcggccgaggagaagaagcgcgttgactcgcagctcaagatcctcgtgcgccccatgtactcgaaccccccaatccacggtgccaggatcgccgcccagatcctcaacaccccggccctctacgaccagtggctggctgaggtcaagggcatggctgaccgcatcattaccatgagggctctgcttaaggagaaccttgagaagctcggcagcaagcacgactggtcccacatcaccagccagattggcatgttcgcctacaccggtctgacccccgagcagatggagcagctcgccaagagccactcggtctacgccaccaaggacggccgtattcggtcgctggtatcaccagcgagaacgttggccgtcttgctgaggctatcttcaagatcaagggttagatggtaa

SEQ ID NO: 54979 - protein, 428 aa, Magnaporthe grisea 70-15
MLSTMRIASRQVAGRRMAVRPLAALRPASTWANVQMGPPDAILGITEAFKADSNNKKINLGVGAYRDDAGKPYVLPSVRQAEEKVIAARMNKEYAGITGVPEFTSGALTLAYGKDSTALDRTAITQSISGTGALRIGAEFLSKFYPGAKNIYIPTPSWANHGAVFTQAGLKVEKYRYYNKDTIGLDFEGLVADVKAAPKGSIFLFHACAHNPTGVDPTPEQWREIETVVKSAGHYAFFDMAYQGFASGDIHKDAFALRHFVAQGHNVCLAQSFAKNMGLYGERVGAFSIVCDSAEEKKRVDSQLKILVRPMYSNPPIHGARIAAQILNTPALYDQWLAEVKGMADRIITMRALLKENLEKLGSKHDWSHITSQIGMFAYTGLTPEQMEQLAKSHSVYATKDGRIRSLVSPARTLAVLLRLSSRSRVRW

SEQ ID NO: 54980 - DNA, 2817 bp, Gibberella zeae PH-1
  CDS (1)..(2817)
atgtctacgcatcagcactcggcctttgcttccgctcagtacatttcgcccgaccccatctttgaagtcaccaagcgcttcaatgccgatcaagacccccagaaagtgaatctcggtcaaggtacataccgagacgagagtgctaagccttgggtcctaccttctgtgagagaagctgagaagttgattgcgaattctggacacgagtatttgcctattgagggcctgcagagctttcgcgatgcggcaaaagacagaatcgccacctgccaatctatatcaggaactgggtcgttgctcctggcaggccttgttctcaaaaaggcaaactcgggcattgagaacatcataattacggacccaacttggtctaaccacgatttgctattccatgagattggcttcaacgttatcaaggcaccttactacaaagaccgatcctttgacttcaaaggttatcttgatactatcaaggcagctgacaagcgttcggctgttgttcttcacgcatgtgctcataatccgaccggctgtgaccccacacgcgatcagtggaaacagattgcagaagtgatcaaagaaaatgggatatttccaatcatcgactcagcataccttggcttcaactcggggaactatgacgaagatgcctgggctgtcaagtacatcatcgaagagctgggtcttgaggcagccatatgtttgtcatttgcaaagaacatgggtctatacggcgagcgcgtcggcttgaccgcaattgtcacaaagtcagaggagacaaaaaaagcagtgttctcactactccagcagtctcagcgacaaaccgtgtctaacccacctgtacatggtgctcggattgccgcggctgtcctcagcaaccccgacacattgaagcaatggcatcaggatctagtgaccatgtcctcacggatcaagtcgatgagaagtaagcttttcgacgaattggtgagactagagacaccaggagattggtcccatatcgtcaaccaaacgggaatgtttgggtacactgggataagcaaaccccaaattgaatgcctagaagagaagtatcatatctacatggcggatacttcaaggattagtctggcgggtttgaacgaacacaatgttgacgtaacgcaaagagcggaaagacacgcaacccctgtcgtcgctttgacaagccgatgcacgatcccacgccgccgccatccaactaccgcaaatagtctagacaatcctgcaagcgacctcaagataggagtagaacaaaagaacggtgccattcccgacgcgaggcgcaaccaagctccatacaatgtccgtgtgacctcttcagacactaccccgctcccccagactccccgcgttatcaatggaggcaacaggagtatcggttggggtaccgacggcgtgatggtcgctttcgggcaacatcactctcaagtcccgggcagcccggaacttgactctcacactcaaggccgctgggccaagacttctggcaatgctgccgctgcccttgaggcgactcgcacaaacactcccgttgtgaacggagcagagacacctctatcagaactacctcccctgatcctttaccgatctctcttcatcaacgctgtttcatcaagaccatggcttctcattccctcccttcaccttctccagaagctctcgcacgcgggaaacccatacttgttcaatgtttcccgcaatcctttgctccgaactattctgaagcataccttctacaaacagttctgcgctggtgagacgggagctgaagcgcaagctacgatgaaggagttgcaggacatggggttcaaaggcacaattctcacatttgcaaaggaaactgtctttgattccaagacaggtaaggaacagggacacggcattgagacctctaccacaaatgaatgccagtggtgcgacaacattgaggcctggagagacggcacgttgaagactgtcgagctactccgagagggtgatcaactggctaccaaactcactggtgctggacctggagtctgcgaagcccttcacaacgacgcccaacttcccaagcaatttgtcgacgcgtgctacgaaatctcccaaaaagtcaaggaccgcggcgcatacattctcatcgacgctgaatcccagcattaccaatggggcatcttccgtctcggtatggagcttcaacaaaagttcaacaccgacggcaatgttgtcctctacaatacataccaggcgtatctcaagagcactcaggagagtctcgagaagcatcttcaaatcgcatccgacaagggcttcactcttggagtcaaggttgttcgcggtgcctacatgtcgtctgatcctcgctcgctcattcacgacacaaagcaagacacagacgacaactacaaccagatcgcgcaaggtgtcctacgtcaagatttccgtggcttcggtggctccaatgccaagccattcccctctgctcaattgcttctcgccagtcacaacaaagagtctctagtcaaagcgcacgagatgcaccaagagcgcacaaaggccaacttgcccacggttccagtcaagtttgctcagctacacggcatgtcggatgaggtcagtttcgggctactcaagctgaaggatgataacggtgttgcgcccgaggtgtacaagtgcactacgtggggtacactgggggagtgcatggcgtacttgaccagacgcgctatcgagaatcgggatgccgcctcaaggacgttggatgagtacacggctttgaagaatgaggcttggagacggcttgctttttggcgatga

SEQ ID NO: 54981 - protein, 938 aa, Gibberella zeae PH-1
MSTHQHSAFASAQYISPDPIFEVTKRFNADQDPQKVNLGQGTYRDESAKPWVLPSVREAEKLIANSGHEYLPIEGLQSFRDAAKDRIATCQSISGTGSLLLAGLVLKKANSGIENIIITDPTWSNHDLLFHEIGFNVIKAPYYKDRSFDFKGYLDTIKAADKRSAVVLHACAHNPTGCDPTRDQWKQIAEVIKENGIFPIIDSAYLGFNSGNYDEDAWAVKYIIEELGLEAAICLSFAKNMGLYGERVGLTAIVTKSEETKKAVFSLLQQSQRQTVSNPPVHGARIAAAVLSNPDTLKQWHQDLVTMSSRIKSMRSKLFDELVRLETPGDWSHIVNQTGMFGYTGISKPQIECLEEKYHIYMADTSRISLAGLNEHNVDVTQRAERHATPVVALTSRCTIPRRRHPTTANSLDNPASDLKIGVEQKNGAIPDARRNQAPYNVRVTSSDTTPLPQTPRVINGGNRSIGWGTDGVMVAFGQHHSQVPGSPELDSHTQGRWAKTSGNAAAALEATRTNTPVVNGAETPLSELPPLILYRSLFINAVSSRPWLLIPSLHLLQKLSHAGNPYLFNVSRNPLLRTILKHTFYKQFCAGETGAEAQATMKELQDMGFKGTILTFAKETVFDSKTGKEQGHGIETSTTNECQWCDNIEAWRDGTLKTVELLREGDQLATKLTGAGPGVCEALHNDAQLPKQFVDACYEISQKVKDRGAYILIDAESQHYQWGIFRLGMELQQKFNTDGNVVLYNTYQAYLKSTQESLEKHLQIASDKGFTLGVKVVRGAYMSSDPRSLIHDTKQDTDDNYNQIAQGVLRQDFRGFGGSNAKPFPSAQLLLASHNKESLVKAHEMHQERTKANLPTVPVKFAQLHGMSDEVSFGLLKLKDDNGVAPEVYKCTTWGTLGECMAYLTRRAIENRDAASRTLDEYTALKNEAWRRLAFWR

SEQ ID NO: 54982 - DNA, 1137 bp, Gibberella zeae PH-1
  CDS (1)..(1137)
atgggatcctattcaccaacttcgcggtttaaggaccttgacactatccctcttgacccccattatgcgctcaaagaaacctttcaagccgatccagacccaagaaaggtaatccttgggtcgggtttatatcgcgacgacgattcaaagccttgggtgctcccagtagtcaaaaaggtactctttggtccacaaagcctcaatgaaagtcgtctggtctcaatccaaaccatctcaggaacgggagccaactttcttggggcacgcttcctggctgaaaccctgaagccatctgctgtgtggctttcagaccccagctgggtcaatcatgccaacatttgggggctcgttaatgtcaacgttaaacgatacccttactggaatgcaaagaccaagagtctagacttcaataacatgattgagaagcttcagactgacgctattgctggagatgttatactgctccacgcttgtgctcacaaccccactggtgtcgatcctaacaaggagcaatggagaaagattgctgacgtttgtgaacgaaaacaactttttccgctcttcgactgtgcctaccagggattcgcgacaggaaatcttgatgatgacgcatgggcaattcgccattttattgaccgtggtaccatggaactcgccgtttgccagtctttctccaagaacatgggcttatacggggagcgtgttggcgcattgcacatgttttgcgcaacatctacagacgctgaaaaggttcgtggccatctctgtcgtctccagcgaggtcagatctctcagcctcccacaaacggagcgagaattgcagcaaccatactctcagactccaagttgttccaagattgggtcacagaccttggagaaatgagcagccggatcaaggagatgcgaaaatctctctatgataacctcatgattcttgacacgccaggaaaatgggatcatatcgtttcgcagattggcatgttttcatacacgggattgactccagagcaagttgcttctattcaacaagatagccacgtttacattttgaaatcaggccgtatctcggtcgcaggactcaactctaagaatgttgacaaatcagttgtcgaattcgcaatagttgggatgaagtag

SEQ ID NO: 54983 - protein, 378 aa, Gibberella zeae PH-1
MGSYSPTSRFKDLDTIPLDPHYALKETFQADPDPRKVILGSGLYRDDDSKPWVLPVVKKVLFGPQSLNESRLVSIQTISGTGANFLGARFLAETLKPSAVWLSDPSWVNHANIWGLVNVNVKRYPYWNAKTKSLDFNNMIEKLQTDAIAGDVILLHACAHNPTGVDPNKEQWRKIADVCERKQLFPLFDCAYQGFATGNLDDDAWAIRHFIDRGTMELAVCQSFSKNMGLYGERVGALHMFCATSTDAEKVRGHLCRLQRGQISQPPTNGARIAATILSDSKLFQDWVTDLGEMSSRIKEMRKSLYDNLMILDTPGKWDHIVSQIGMFSYTGLTPEQVASIQQDSHVYILKSGRISVAGLNSKNVDKSVVEFAIVGMK

SEQ ID NO: 54984 - DNA, 1245 bp, Gibberella zeae PH-1
  CDS (1)..(1245)
atggtttctactacaaatttccctgccgaagtcgtgccccaggcacccgaagatcctctctttggtcttgcacgagagtacaaggccgacgacagccccaacaagattgatcttggtattggcgcatacagagacgagaatgcaaagccctgggtgttgcccgtcgtcaagaaggccgatgagatcctccgaaacgaccctgagctcaaccacgagtacgcccccatcgcgggtattgccagcttcacatccaaggctgccgagctagtctttggccccgattcttctgccatccaagacaagcgctcaacaacactacagacaatctctggtaccggtgccgtgcacttgggagctcttttccttgccaagttctacaagggcaaccagactgtctacctctcaaatcccacatgggcgaaccaccaccagatcttcaagaatgttggcatgtcgatcgacacatacccctacttccacaaggagactaagggtctcgattttgaggggttcaagaagactctgcaatccgctcccgagggttccgtctttgtgcttcacgcatgcgcacacaaccctaccggtgtcgaccctacgcaagatcagtggactgagattgcttcaatcatgaaggagaagaaccacttccccttctttgacaccgcctaccaaggatttgcctctggcgatcttgtcaaggatgcatgggccatccgctactttgtcgatcagggctttgagcttgttgttgctcagagtttcgccaagaactttggtctctacggagagcgtgccggttgcttccacgccgtcacatctcccgctcctgaggcttcaaacacaatcactcgcattggctctcaattggctatcctccagcgatcggagatctccaaccctcctctgtacggtgcccgtatcgtcagcactgttctcaacgatcgcgacctcttcgctgagtgggaagagaacctgcgcaccatgtctggccgcatcatcagcatgcgcgacgtcctccgagccaagcttgaagagctcgagacccctggtacctggaaccacatcaccgaccagatcggcatgttcagcttcactggcttgagcgagaagcaagtacttcagcttcgagaagaattccacgtctacatgaccaagaacggtcgtatcagcatggctggtctcaacgaaaacaacgttgagtactttgcaaaggctgttgataaggttgttcgtgacgctgcttag

SEQ ID NO: 54985 - protein, 414 aa, Gibberella zeae PH-1
MVSTTNFPAEVVPQAPEDPLFGLAREYKADDSPNKIDLGIGAYRDENAKPWVLPVVKKADEILRNDPELNHEYAPIAGIASFTSKAAELVFGPDSSAIQDKRSTTLQTISGTGAVHLGALFLAKFYKGNQTVYLSNPTWANHHQIFKNVGMSIDTYPYFHKETKGLDFEGFKKTLQSAPEGSVFVLHACAHNPTGVDPTQDQWTEIASIMKEKNHFPFFDTAYQGFASGDLVKDAWAIRYFVDQGFELVVAQSFAKNFGLYGERAGCFHAVTSPAPEASNTITRIGSQLAILQRSEISNPPLYGARIVSTVLNDRDLFAEWEENLRTMSGRIISMRDVLRAKLEELETPGTWNHITDQIGMFSFTGLSEKQVLQLREEFHVYMTKNGRISMAGLNENNVEYFAKAVDKVVRDAA

SEQ ID NO: 54986 - DNA, 1275 bp, Gibberella zeae PH-1
  CDS (1)..(1275)
atgctgtccaccctccgagtcgccagccgccgggctgcccgccctgcccagtacaacctggctgccattcgcgctgcctccaactgggccaacgtccctcaaggtcctcctgatgccattcttggtatcactgaagccttcaaggccgacaagttcgacaagaagatcaacctgggtgttggtgcctaccgtgacgatgctggcaagccctacgtgctcccttccgttcgtgaggccgagatgaaggtcgtcgagtccaagttgaacaaggagtacgccggcatcactggtgttcctgagttccctcccgccgccgccaagctggcctacggcgccaacagccccgccctggatcgcatcaccatcacccagaccatctctggtaccggtgctctccgtgtcggtgccgctttcctcgccaagttcttccctggcgaaaagaagatctacatcccccagccttcgtgggcaaaccacaaggccgtcttcaaccacgccggcctcgaggttgagcagtaccgctactacgacaagaagaccatcggccttgacttcgagggcttgattgctgatgtcaagtctgcccccaacggcagtgtcttccttttccacgcctgtgctcacaaccccactggtgttgaccctacccaggagcagtggaagcagatctctgacgtcgtcaaggagaagggtcacttcgccttcttcgacatggcttaccagggctttgccagtggtgacaccgacaaggatgctttcgctgttcgctacttcgttgagcagggccacaacattgctctttgccagtctttcgccaagaacatgggtctctatggtgagcgtattggtgccttctccatggtatgtgccgatgccgacgagaagaagcgcgtcgactctcagctcaagattctcattcgacctctgtactccaaccctcccatccacggtgcccgcatcgccgccgagattctgaacagccccactctctacaagcagtggctcggtgaggtcaaggagatggctgaccgcatcatcaccatgcgtgctctcctcaaggataaccttgagaagctcggctccaagcacgactggtctcacatcaccagccagatcggcatgttcgcctacactggtcttacttccgaggagatgactcgcctcgctgaggagttctccgtttatgccaccaaggacggccgtatctctgttgctggtatcacctctgaaaacgttggccgcctcgctgaggccatctacaaggtcaagggttaa

SEQ ID NO: 54987 - protein, 424 aa, Gibberella zeae PH-1
MLSTLRVASRRAARPAQYNLAAIRAASNWANVPQGPPDAILGITEAFKADKFDKKINLGVGAYRDDAGKPYVLPSVREAEMKVVESKLNKEYAGITGVPEFPPAAAKLAYGANSPALDRITITQTISGTGALRVGAAFLAKFFPGEKKIYIPQPSWANHKAVFNHAGLEVEQYRYYDKKTIGLDFEGLIADVKSAPNGSVFLFHACAHNPTGVDPTQEQWKQISDVVKEKGHFAFFDMAYQGFASGDTDKDAFAVRYFVEQGHNIALCQSFAKNMGLYGERIGAFSMVCADADEKKRVDSQLKILIRPLYSNPPIHGARIAAEILNSPTLYKQWLGEVKEMADRIITMRALLKDNLEKLGSKHDWSHITSQIGMFAYTGLTSEEMTRLAEEFSVYATKDGRISVAGITSENVGRLAEAIYKVKG

SEQ ID NO: 54988 - DNA, 1272 bp, Gibberella zeae PH-1
  CDS (1)..(1272)
atgtcgtgcttctcatccctgccaccacagcctacagacgagatctttgatcttctcggtgcttacaggaaagactctaaccctgaccgcgtcaacctcggtgtcggcgtctactgcaccgacgaaggcaaatcctggcctcttgacgttgtcacccgcgtggagaaggatctcttcgaagaggctagcttgaccagacacgattatcttcccatcgagggagaccagcagttcctcaagcttgcgagggatcttgtttttgcccatcaggatgagttgagcgtcgcttccgtacagaccgtctccggaaccggagcgaaccatatcggtgctcgtttcgtcgcggattaccttcgaccgcaaaatatctgggtgtcggaccctacctgggcgaaccaccacatgatctgggagtctgttggactcaagcccaagctgtatccctactacaaaaagtcggattgttcgttggactttgagggtatgatcaagactcttgaggaagaagctcaacctcgcgatgccgtcttgttgcacgcatgtgcacacaaccctaccggtcttgatcccacaaaggagcagtggaagatcatcgctgaggtctgtcagcgaaagcaactgttcccctttttcgacgccgcctaccaaggcttcgcatccggcagtcccgcggaagacgcctgggccatccgctacttttaccaacagcagccacgacctgacatgattgtcgcgcaatccttttccaagaactttggtctttacggtcatagaacaggagcaattcatttggtgcttgcggagccctccaaggagatcagggacaacgcttactccaccctttcgtatcttttgcgatctgaaatctccatggctcccaagtatggttctacaattgtcaagacggttttggatagtgaggagttgactgctgcttggatggctgatttgcaagtcatgagcagtcgtatcaagagcatgcgccaggctctgtatgatgagttggtgcgcttggagacacctggcacatggaaccacatcattgaccagattggcatgttctcatacactggcttgaccccctttgaggtaaaggtccttcgggagcgcttccacatctacctgctcaagtcgggacgtatttccatttctggcttgaacaagagaaatgtcaactacgttgccaaggccatccacgatgtccgagtaaatggccatgagctcaatggcaccaacggaacaaatggaacaaacggtgtcaacggacactag

SEQ ID NO: 54989 - protein, 423 aa, Gibberella zeae PH-1
MSCFSSLPPQPTDEIFDLLGAYRKDSNPDRVNLGVGVYCTDEGKSWPLDVVTRVEKDLFEEASLTRHDYLPIEGDQQFLKLARDLVFAHQDELSVASVQTVSGTGANHIGARFVADYLRPQNIWVSDPTWANHHMIWESVGLKPKLYPYYKKSDCSLDFEGMIKTLEEEAQPRDAVLLHACAHNPTGLDPTKEQWKIIAEVCQRKQLFPFFDAAYQGFASGSPAEDAWAIRYFYQQQPRPDMIVAQSFSKNFGLYGHRTGAIHLVLAEPSKEIRDNAYSTLSYLLRSEISMAPKYGSTIVKTVLDSEELTAAWMADLQVMSSRIKSMRQALYDELVRLETPGTWNHIIDQIGMFSYTGLTPFEVKVLRERFHIYLLKSGRISISGLNKRNVNYVAKAIHDVRVNGHELNGTNGTNGTNGVNGH

SEQ ID NO: 54990 - DNA, 1302 bp, Ustilago maydis 521
  CDS (1)..(1302)
atgatgctcaccgctgccaccatccgaacggctgttcgagcctcgcaggcccctctcctgggcgctatgtcgctacctgccgtgcgtcagttcaagagtacttgggctcacgtcaaggctggacctcctgacccgattctcggtgttaccgaggcgttcaagcgcgaccaggaccctcgcaagatcaacctcggtgttggtgcctaccgtgacgagaacggaaagccttatgtgctcccctcggtgcgtcaggccgaggagctcgtcatcaccgctaagggtgacaaggagtacctgcccatcactggtctcgccgactttaccaagaacgccgccgttctcgcctacggcaaggacagcgcgcccatcaaggagaaccgcattgctatcacccagtcgatctcgggaaccggtgctcttcgcatcggtggtgctttcctgcagcgacactaccccgaggccaagaccatctacctgcccacaccttcgtggggtaaccacacacctatcttccgtgacagcggtcttgaggtgaaacagtaccgctactacgacaagaagacggtgggtctcgacttcaagggcatgattgaggacatcaaggcggcacctgccggttcgattgtcctgctgcatgcgtgcgcgcacaaccccaccggtgtcgaccccaccgtcgagcagtggaaagaaatcagcaacgtggtcaaggagaagggtcacttccccttcttcgacatggcctaccagggctttgccagtggtgacacggacaaggacgcctttgcggtgcgccactttgtcgccgagggccaccagatctgcctctcgcagtcgttcgccaagaacatgggtctgtatggtgagcgtgtcggcgcgttttcgatcgtctgcgctgaccctgacgagcgtgctcgtgtcgacagccagatcaagatcatcgttcggcccatgtactcgaacccacctatgcacggtgccaagatcgccggtaccatcctggccgaccaacagctgtaccagcaatggctcggtgaggtgaagggcatggccgaccgcatcaacggcatgcgatccacactcaaggacctgctcgtgcaggactttaactcgaagctcaactgggatcacatcaccaaccagatcggcatgtttgccttcctcggcatctcgcccgagcaggtggccaagctagtcaacgagcaccacgtctaccttactggagacggccgtatttcggtcgctggtatcaccgaccacaacgtcaagcacctcgccgagtcgctgcacaaggtcaccagctaa

SEQ ID NO: 54991 - protein, 433 aa, Ustilago maydis 521
MMLTAATIRTAVRASQAPLLGAMSLPAVRQFKSTWAHVKAGPPDPILGVTEAFKRDQDPRKINLGVGAYRDENGKPYVLPSVRQAEELVITAKGDKEYLPITGLADFTKNAAVLAYGKDSAPIKENRIAITQSISGTGALRIGGAFLQRHYPEAKTIYLPTPSWGNHTPIFRDSGLEVKQYRYYDKKTVGLDFKGMIEDIKAAPAGSIVLLHACAHNPTGVDPTVEQWKEISNVVKEKGHFPFFDMAYQGFASGDTDKDAFAVRHFVAEGHQICLSQSFAKNMGLYGERVGAFSIVCADPDERARVDSQIKIIVRPMYSNPPMHGAKIAGTILADQQLYQQWLGEVKGMADRINGMRSTLKDLLVQDFNSKLNWDHITNQIGMFAFLGISPEQVAKLVNEHHVYLTGDGRISVAGITDHNVKHLAESLHKVTS

SEQ ID NO: 54992 - DNA, 1269 bp, Ustilago maydis 521
  CDS (1)..(1269)
atgggttcaatttctgaacaatcctcagctctcgctgtttggagcgccgtcccacaggctccggaggatgccattttcaagctgacctcttcctacaaatccgatacctacgataagaaagtcaacctcggtgttggcgcataccgtgacaacaacggcaagccctacgttctgccctcggtaaaaaaggcgcaggcggatctcatcgcagacgagtcggtcgaccacgagtacctctccatcaccggtctggccgaattcaccagtgctgctgccaagctcatcctcggcgacgattcgcccgcgattgcagagaagcgtgttgcttcggtccagaccatctccggtaccggtgccaaccatctcggtgccgtctttctgcaacgcttctaccagtaccaggcctacggtgtcgaccgtcaaatctacatttcaaatccaacttgggccaatcacaaggccatcttcaatacggtcggcatcaagcccatcgactacccttattacgacgccaagacgattgcgctcgactttgacggtttcaccaacacgttgagacaggccaaaaaccagagcgtgttcttgctacatgcctgcgctcacaaccctaccggtgttgatcctacccaggagcagtggaagcagatcgccgatatctttgtcgagaagggtcactttgcctttttcgactgcgcttaccagggtttcgcctcgggtgacctggacagggatgcctgggcggtacgacactttgtttcgcgcaagagcattcctctgctcatttgccagagcttcgccaagaacgccggcttgtacggcgaacgtgtcggcgcgctccacgttgtgtccgccactccggcacagagcgctgccgtcttctcgcagctcgccgcgattcaacgatccgagatctctaaccctcccgctttcggcgcgcgtgtggtcaagatgatccttaccgatcctgcgctcttccaacagtggcaggccgatgtcaaggagatggcaggtcgcatcatcaccatgcgtcagagcttgtttgatttgctgaccaagaagttccaaacaccgggtaactgggaccacatcttgaaacaaatcggcatgtttacctttttgggtctcgacaccaaccagtgtaaccgtctgttggaggaaggtcacatctatttgaccgccaattcgcgtatttccatggctggattgacgacgaacaacgtcgaatacgttgcttcctggatcgacaaggtggtccgagagaagaagtga

SEQ ID NO: 54993 - protein, 422 aa, Ustilago maydis 521
MGSISEQSSALAVWSAVPQAPEDAIFKLTSSYKSDTYDKKVNLGVGAYRDNNGKPYVLPSVKKAQADLIADESVDHEYLSITGLAEFTSAAAKLILGDDSPAIAEKRVASVQTISGTGANHLGAVFLQRFYQYQAYGVDRQIYISNPTWANHKAIFNTVGIKPIDYPYYDAKTIALDFDGFTNTLRQAKNQSVFLLHACAHNPTGVDPTQEQWKQIADIFVEKGHFAFFDCAYQGFASGDLDRDAWAVRHFVSRKSIPLLICQSFAKNAGLYGERVGALHVVSATPAQSAAVFSQLAAIQRSEISNPPAFGARVVKMILTDPALFQQWQADVKEMAGRIITMRQSLFDLLTKKFQTPGNWDHILKQIGMFTFLGLDTNQCNRLLEEGHIYLTANSRISMAGLTTNNVEYVASWIDKVVREKK

SEQ ID NO: 54994 - DNA, 1290 bp, Aspergillus nidulans FGSC A4
  CDS (1)..(1290)
atgctttctactctaaaagtcgccagccgccaggctgcctcgcgcaatgctagcgtgcgctccgtgtttgccggtgccagatgtgcttccacctggtccaatgttccccagggtcctcctgacgctatccttggtatcaccgaggcctacaaggccgacagtttcaaggaaaagatcaacctgggtgttggtgcctaccgtgacgaccagggtaagccctacgttctgccctccgtccgcgccgccgaggacaaggttgttgcatcgcgtttcgataaggaatatgctggaatcaccggtatcccctcgttcaccaaggctgccgcgcagctggcctacggagcggactctcccgttttgaaggaggaccgtctcgtgatcacccagtccatctctggtaccggtgctctgaggatcggcggcgctttccttcagcgtttctatcccggcgcaaagaagatctatctccctactcccagctgggccaaccacaacgctgtcttcaaggactcgggcttggaggttgagaagtaccgctactacaacaaggacaccatcggcctcgactttgagggtctcgtcgaggacctcaaggctgctcccaacaacagcatcatccttctccatgcttgcgctcacaaccccaccggtgtcgaccctacccaggaccagtggcgccagattagcaacgtaatgaaggagaagggccactttgccttcttcgacatggcttaccagggcttcgccagtggaaacgccgataccgacgcctttgcgcctcgacacttcgttgagcagggccacaacatcgctctgtgccaaagtttcgccaagaacatgggactctacggtgagcgtgtcggtgctttctctctcgtctgcgaatccgccgaggagaagaagcgtgtcgactctcagatcaagatcctcattcgtcccttctactccaaccctcccgtgcacggtgctcgtgtcgcctcgactatcatgaatgaccctgcgcttaacaagcaatggctcggcgaggttaagggcatggctgaccgcatcattgagatgcgtgctcttctcaagaagaacctggaagagcttggcagcaagcacgactggacgcacatcaccagccagatcggcatgtttgcttacactggtctcaagcccgagcagatggaggctcttgccaaggagcactccgtctacgccaccaaggacggccgtatctcagtggctggtatcactacgggcaacgtcaagcgccttgccgaatccatctacaaggtgactggttaa

SEQ ID NO: 54995 - protein, 429 aa, Aspergillus nidulans FGSC A4
MLSTLKVASRQAASRNASVRSVFAGARCASTWSNVPQGPPDAILGITEAYKADSFKEKINLGVGAYRDDQGKPYVLPSVRAAEDKVVASRFDKEYAGITGIPSFTKAAAQLAYGADSPVLKEDRLVITQSISGTGALRIGGAFLQRFYPGAKKIYLPTPSWANHNAVFKDSGLEVEKYRYYNKDTIGLDFEGLVEDLKAAPNNSIILLHACAHNPTGVDPTQDQWRQISNVMKEKGHFAFFDMAYQGFASGNADTDAFAPRHFVEQGHNIALCQSFAKNMGLYGERVGAFSLVCESAEEKKRVDSQIKILIRPFYSNPPVHGARVASTIMNDPALNKQWLGEVKGMADRIIEMRALLKKNLEELGSKHDWTHITSQIGMFAYTGLKPEQMEALAKEHSVYATKDGRISVAGITTGNVKRLAESIYKVTG

SEQ ID NO: 54996 - DNA, 1338 bp, Aspergillus nidulans FGSC A4
  CDS (1)..(1338)
atgtccactccttcatccgtatcttccagttcctactcggccgccaaatctcggcttgcttctctcgcctcacacatcatgggctcctcatcagcttccccggtcttctcgaccgctgttgtcccgtcggcgccagaggatccgctctttggtctcgcgcaggcttatcgccaggacccctcagacaagaaggtcgatctagtcattggtgcttatcgcgacgataatgcgaaaccctgggttttgcctgttgtcaagaaggcagatgagctcatccgcaacgaccccaaccttaaccacgaatacctcccaatcaaaggcctcgctgaatatacaaccgccgcccagaaactcatcatcggcgccgactcgcccgccatcgcggagaaccgtgtctgcacattccagaccatctccggcacaggcgccgtccatctaggcgcgctcttcctcgcccgcttccaccccgcaacccccaaaccgaccctctacctctccagcccgacctgggcaaaccaccaccagatcttcacaaatgtcggcttcacgcttgcgaactacccgtacttctcgccgcagacgaaaggcctcgatttcgacggcatgatcaacgcgttgcgctccgcgcccgccgggtcgatcatcctcctccatgcctgcgcccacaaccccacgggcgtggatctcacccaggagcagtggaaggaagttgccgtggtcatgcgcgaccgctcgcatttccccttttttgactgcgcataccagggtttcgcatcgggcgatctggcgcgtgacgcctgggcgatccggtatttcgtcgagcaagggttcgagctctgcatcgcgcagtccttcgccaagaactttggcttgtacggtgagcgcacgggcgcctttcatttcgtttccgcgccgggcccggaagccgctcagtcctcggcacatgtcgcctcgcagctggccattctgcaacgctctgagatctcgaacccgcctgcgtacggtgcgcggattgcgagtaaagtgctcaatgaccctgagctgtttgcgcaatgggaggacgatctgcgaacgatgagtgggcggatcgtcgagatgaggaaggggctcaggcagcgccttgaggagaagaagacacccggctcgtggaaccatattaccgaccagatcggcatgtttagctttacggggctcagtgaggcacaggttaaggtgctgcgtgagaagtggcatgtctatatgaccaagaacggtcgcatctccatggctggtctcaactcccataacctggattactttgccgaggcggttgatagcgttgtgagggagacatcgtga

SEQ ID NO: 54997 - protein, 445 aa, Aspergillus nidulans FGSC A4
MSTPSSVSSSSYSAAKSRLASLASHIMGSSSASPVFSTAVVPSAPEDPLFGLAQAYRQDPSDKKVDLVIGAYRDDNAKPWVLPVVKKADELIRNDPNLNHEYLPIKGLAEYTTAAQKLIIGADSPAIAENRVCTFQTISGTGAVHLGALFLARFHPATPKPTLYLSSPTWANHHQIFTNVGFTLANYPYFSPQTKGLDFDGMINALRSAPAGSIILLHACAHNPTGVDLTQEQWKEVAVVMRDRSHFPFFDCAYQGFASGDLARDAWAIRYFVEQGFELCIAQSFAKNFGLYGERTGAFHFVSAPGPEAAQSSAHVASQLAILQRSEISNPPAYGARIASKVLNDPELFAQWEDDLRTMSGRIVEMRKGLRQRLEEKKTPGSWNHITDQIGMFSFTGLSEAQVKVLREKWHVYMTKNGRISMAGLNSHNLDYFAEAVDSVVRETS

SEQ ID NO: 54998 - DNA, 1251 bp, Aspergillus nidulans FGSC A4
  CDS (1)..(1251)
atgaccgtgctcaatgtcagcccagttcctccggacgaaattttcgccctgaaccgtgcatacatcgacgatgacttcccgcagaaggtcaatctcggtgtaggcgtttaccgcaccaacgagggccagccatggcctctccccgtcgttgaggaagcagagaagcagctcgcagccgaaaacagcgtcttccgccatgaatacacagccattgaaggtgatagggcattcctccctctcgctcgggacctaatgtttgggttcgacggccaagctacttctgatgcgaagcaggaggcagccaaagcacgcattggcaccgtccagacagtcgccggcaccggcgcaaaccatctcggtgccctcttcctcgcaactcacatgaagccacgaaatgtctggctctccaacccctcttgggcaaaccacctcactatttgggaactcgccggagtgccccgcaaaacatacccctattactctgccgccacccgctcctttgatttcgacggcatgatctcaactctcgaatccgaagctcaggaaggagacgtgattcttctccacgcctgcgcccacaatcccacaggactcgaccccaacaaggagcaatggaaagctatcatcgacctctgcgagcgcaagcgcattttccctttcttcgactcagcataccaaggcttcgcctccggatccgtagacgaagacgcctgggctgtccggtacgtcctaaacgagaagccgcagatggaaatgtgcgttgcgcaatccttctctaagaactttggcctctacggccagcgagtcggcgccttccattacgtcctcaacgaaggcgcagaggatctccgcgatacagtcgtcaacaacctttgccacctcatccgcggagagtactccatgggtcccacggcaggctgcaacatcgtcaagaaagtcctcacaagtcctgagctcacggcaaaatggcaccaggatctgaaggtcatgagttcgcggataatttccatgcgcgaagctctttacaatgaactagtcagactcaaaacccccggaacttggaaacacatcgtcgaacagaacggaatgttctcctacacaggacttacaccttcacaagtctacgctcttaaagataaattccacatctacctgctcaagtccggcagagcctccatcagtggactgagcccgaagaatgtaaattacgtcgccagagctattgacgaggttgtacgaaatgtcaactga

SEQ ID NO: 54999 - protein, 416 aa, Aspergillus nidulans FGSC A4
MTVLNVSPVPPDEIFALNRAYIDDDFPQKVNLGVGVYRTNEGQPWPLPVVEEAEKQLAAENSVFRHEYTAIEGDRAFLPLARDLMFGFDGQATSDAKQEAAKARIGTVQTVAGTGANHLGALFLATHMKPRNVWLSNPSWANHLTIWELAGVPRKTYPYYSAATRSFDFDGMISTLESEAQEGDVILLHACAHNPTGLDPNKEQWKAIIDLCERKRIFPFFDSAYQGFASGSVDEDAWAVRYVLNEKPQMEMCVAQSFSKNFGLYGQRVGAFHYVLNEGAEDLRDTVVNNLCHLIRGEYSMGPTAGCNIVKKVLTSPELTAKWHQDLKVMSSRIISMREALYNELVRLKTPGTWKHIVEQNGMFSYTGLTPSQVYALKDKFHIYLLKSGRASISGLSPKNVNYVARAIDEVVRNVN

SEQ ID NO: 55000 - DNA, 1257 bp, Candida glabrata CBS138
  CDS (1)..(1257)
atgtctgccaccatatttaacaacatcgaagaacttcctgctgatgcccttttcggtatcaagcaaaggtacaatcaagataccagagccaccagagttgacttgggtattggtgcgtaccgtgatgaccaaggcaaaccatgggtgttgccttcggttagaatggctgaaagggcaatccaagaggatccaagctacaatcatgaatacttgggtatcaatggtcttccaagtttgtcttccgctgctgctaatgttatatttggtgaagactccccagctttgaaagaaggcagaaccatctcagttcaatctttgtctggtacaggtgctttgcacattgctgccaagtttatctctaagttcgctgctgacaagaagatttatttgtctcagccaacttgggctaaccacaacgccatcttcaaggcacaaggtttagagactgcttcttatccatactggaagagttctaccaagtcccttgacttggaaggtttcatctcagccatcgaaagtgcgccaaagggttctatattcctgctgcatgcatgtgcacacaacccaactggtttggacccatctgagaagcaatggcccgttatcctggatgctctggtcaagggcgatcacttggccttattcgactccgcttaccaaggttttgcctccggtgacttggacaaggacgcctttgctgtgcgtttgggtgtcgaaaagttggcctccacttcaccaatctttgtatgccagtctttcgccaagaacgtcggtatgtatggtgaaagagtcggttgtttccacttgatcctacctaagcagaatgccaatctcgcaccaatcaagtctgctatcacatctcaaatatctagtattatcagaagtgaagtgtccaactccccagcttatggtgccaagatcgtttctaagattttgaacacaccagagcttactaagcaatggcacgaagacatggttaccatgtcatctagaatcaaggagatgagaatcgcattgagagaccatctagttaagttgggaactccaggtacttgggaccacatcgtcgagcaatgcggtatgttctctttcacaggcttgaccccagagatggttaagagactggaggtccagcacgctgtctacttggtctccagtggtagagcctctattgccggcctaaactccggcaacgttgagtacaccgcaaaggccatcgacgaagtagtccgtcactactcaacttccaagttgtga

SEQ ID NO: 55001 - protein, 418 aa, Candida glabrata CBS138
MSATIFNNIEELPADALFGIKQRYNQDTRATRVDLGIGAYRDDQGKPWVLPSVRMAERAIQEDPSYNHEYLGINGLPSLSSAAANVIFGEDSPALKEGRTISVQSLSGTGALHIAAKFISKFAADKKIYLSQPTWANHNAIFKAQGLETASYPYWKSSTKSLDLEGFISAIESAPKGSIFLLHACAHNPTGLDPSEKQWPVILDALVKGDHLALFDSAYQGFASGDLDKDAFAVRLGVEKLASTSPIFVCQSFAKNVGMYGERVGCFHLILPKQNANLAPIKSAITSQISSIIRSEVSNSPAYGAKIVSKILNTPELTKQWHEDMVTMSSRIKEMRIALRDHLVKLGTPGTWDHIVEQCGMFSFTGLTPEMVKRLEVQHAVYLVSSGRASIAGLNSGNVEYTAKAIDEVVRHYSTSKL

SEQ ID NO: 55002 - DNA, 1260 bp, Candida glabrata CBS138
  CDS (1)..(1260)
atggtaaaaatttcagctacggtgtacaacgatgtcgaaccgatcaagaccgacatattatttgcaacaaagcaaaggtacttgaaggataccagaggtttcaaagttgatttgggtgttggagcatatcgcgctgacaatggtaagccatggattcttccctcggtacgtaaggctgaaaggttggtacaagaggaagatgattatgaccacgaatatctaaatatttgtggtcttgacagtttaacaaacagcgctgctaaagttatacttggggaggattgtccagcattgagagaaagtagggttatctctgtacaatctctgtcaggtgcaggtgccttacatgtggctgctaaatttattaaaaagtacacacctgaaaagaaaatttacttgtcaaacccaacttggcctattcatcagtcaatatttgaaaatgtggatttagagactgattcctacccatattgggatgctaccaataaaagcttggattttgagggtttcataaaggcaattgatcatgccccaagaggatccatatttgttctgcatgcttgtgcacacaacccaacgggacttgatccaacgcaagagcaatggcatcaaattattgaatccattcagaaaggtgatcacatcccactatttgactctgcttatcaaggctttgcgtccggcgatcttgaaagagatgcatatgctatacgctacaccataaatcaattaagagactgtgcacctatatttgtagcacaatcatttgctaaaaatgttggaatgtatggtgagagagttggttgtctgcacttagttctaccggcgcagaaggaggatattgtaccaataaaggatgctataacctcccaactttcgagaattatcagaagtgaaatttcaactccaccagcatacggtgctaaggttgtatcaaaaatatttactacaccagaactgaaggagcaatggtatcaagatttggtgaccatgtcaagtagaatcatatcggttaggacacgtttacgtgacctattagctgagtacaatacacctggaaactgggatcatattgttcagcagtgtggtatgttctcatttacaggactaactcctgagatgaccaagcgattggaaactgaacatgcagtttatatggtgcctactggtagggcatctgttgcaggcctaaatactgggaatgtacaacatgttgctaaggctataaatgaagtggttaatcactttatgaaagattag

SEQ ID NO: 55003 - protein, 419 aa, Candida glabrata CBS138
MVKISATVYNDVEPIKTDILFATKQRYLKDTRGFKVDLGVGAYRADNGKPWILPSVRKAERLVQEEDDYDHEYLNICGLDSLTNSAAKVILGEDCPALRESRVISVQSLSGAGALHVAAKFIKKYTPEKKIYLSNPTWPIHQSIFENVDLETDSYPYWDATNKSLDFEGFIKAIDHAPRGSIFVLHACAHNPTGLDPTQEQWHQIIESIQKGDHIPLFDSAYQGFASGDLERDAYAIRYTINQLRDCAPIFVAQSFAKNVGMYGERVGCLHLVLPAQKEDIVPIKDAITSQLSRIIRSEISTPPAYGAKVVSKIFTTPELKEQWYQDLVTMSSRIISVRTRLRDLLAEYNTPGNWDHIVQQCGMFSFTGLTPEMTKRLETEHAVYMVPTGRASVAGLNTGNVQHVAKAINEVVNHFMKD

SEQ ID NO: 55004 - DNA, 1362 bp, Candida glabrata CBS138
  CDS (1)..(1362)
atgactctgaactacgcgagtgtgcaatgtgtgctgaggatgcgaagcgccgtgatgttaggccgcaggcggttgtcgcggaaagcattaaaacaaagtactttatttgatatccccatggcgccaccggatggtgttttggggctgacggaaactttcaatgcagacgagaacccaaataagattaatttgacagttggggtatataaagatggatggggtcaggtgacaaccttcccttcagtggctcaagctcaaaagattatagacatggatgtgggaatgaacactgatctatcatatttaccgataagtgggtgtgaggatttcaagaagcatacaattaattttctgtatagggacagctgcccgcaagacggccctgcattgattaagaatgatcgaatcagttttatacaaacgctaagtggaactggtgcattagctgtcgcatctaggcttttatcatcttttatttcgagaaagatatggatacccaaaccgtcttggcctaatcacaccaatatatttacccaaaacggttttaccaatcctagattttatagctactatgacagaggcgatttgacgattggaagatggttacaggaattgaggcatgaagttggtaaagactcaaataccaaaacaccacattgtattgttttacatgcctgctgccataatccgaccggccttgatccgacaaaaaagcaatgggaggatataatggatactatttatgaattaggaatgattccaattatagacatggcataccaaggtttagaatcgggcaagctgatagatgacgcatatttactaagactatgtctggacaccagcaggtacaggtcctgggataacggtctatatctgtgccaatcttttgccaaaaacatgggattgtatggagaaagagttggatctttaagtattgtggcacctgaacatgttcctggtgtgaaagaggtcctggactcacaacttaaacagattatcagaagtatgtattcctcccctcctggatatggttcaagagtcgctaaattagtcttatcgaatgataagctcaagtatcaatggtattctgatgttgagacaatggtgaatagactaaaatcggtgagggaaatgatacatgagaggttacaatgggaagagatagttaattttgagcaacaacatggtatgttctatttcacaaaattaggacctgatattgtaaaaaaactcagggaacaatactctatatatttaacgaacgatggcagaatgtccttaagtggcgttaataagagcaatgttgactacttatgcaattccatcaaggctgtgacatctagtaaaacattactgtaa

SEQ ID NO: 55005 - protein, 453 aa, Candida glabrata CBS138
MTLNYASVQCVLRMRSAVMLGRRRLSRKALKQSTLFDIPMAPPDGVLGLTETFNADENPNKINLTVGVYKDGWGQVTTFPSVAQAQKIIDMDVGMNTDLSYLPISGCEDFKKHTINFLYRDSCPQDGPALIKNDRISFIQTLSGTGALAVASRLLSSFISRKIWIPKPSWPNHTNIFTQNGFTNPRFYSYYDRGDLTIGRWLQELRHEVGKDSNTKTPHCIVLHACCHNPTGLDPTKKQWEDIMDTIYELGMIPIIDMAYQGLESGKLIDDAYLLRLCLDTSRYRSWDNGLYLCQSFAKNMGLYGERVGSLSIVAPEHVPGVKEVLDSQLKQIIRSMYSSPPGYGSRVAKLVLSNDKLKYQWYSDVETMVNRLKSVREMIHERLQWEEIVNFEQQHGMFYFTKLGPDIVKKLREQYSIYLTNDGRMSLSGVNKSNVDYLCNSIKAVTSSKTLL

SEQ ID NO: 55006 - DNA, 1257 bp, Kluyveromyces lactis NRRL Y-1140
  CDS (1)..(1257)
atgagaataccaacgcgaagagggctgtcggccttgtcaagagtaactagggctcctgctgataagattctaggtttaacagagaagtttaacgttgacagacatccaaacaagataaatctgaccgttgggatctataaggacaaccggggccgtgtgaccaccttccctagtgtagcttctgcccaatcattacttgagacgagtctcgatctgaataatgatttatcgtatttgcctatcactgggtcgcaggattaccaaaacaatgtgttaaatttcttgtatcgagagtcaagtgacgggagtgaattattggagaacaacagaatcacgtttgtgcaaactttgagtggtaccggtgcattagctgtagcttcaaaactcttggcaacgtttgtgtcgaaaaccgtatggataccaaatccatcttgggctaatcattcgaacgttttccaatggaacggattcaatcagatcaaatattatacgtactacgaggatgggaaattgagtatcgataaatggctcaaggaactcaaggagagttgtagttctagggaccccgactggcccccctctatagtgttacacgcttgctgtcataatccaacaggagtggaccctacgttggaacaatggcaacagatattgccagtgatccatgatttaggaataactcccataatagacatggcgtaccaaggaatggaatcagggaaccttatacaggatgcttatctattaagaatgtgtctagaatacgaatggcccaacggtctatttgtgtgccaatcgtttgctaagaacatgggcttatacggtgaacgtgtaggttcgttaagtgtcgttgtcccaccaaatcccttggatctcaaatcaaccatcgactctcaactaaagaagattgtaagaggtatatactcttctccaccgggatatgggtctcgtgtagcgaacttggtgctaagcaatccaaaattgaagcagcaatggttcgtagacgttaagaatatgtctgatagactatggaacgttagaattcaaatgcatgagagattgaattggcccaatcttgttgattttaaaacacaacatgggatgttttattacacagggttaaacccatatcaggttcaaattctgcaggagaggtacggtatttatttaactgaagacggcaggatgtcgttatctggagttaacgacggtaatattgattatttatgcgattctttgcgccaagtggttcaataa

SEQ ID NO: 55007 - protein, 418 aa, Kluyveromyces lactis NRRL Y-1140
MRIPTRRGLSALSRVTRAPADKILGLTEKFNVDRHPNKINLTVGIYKDNRGRVTTFPSVASAQSLLETSLDLNNDLSYLPITGSQDYQNNVLNFLYRESSDGSELLENNRITFVQTLSGTGALAVASKLLATFVSKTVWIPNPSWANHSNVFQWNGFNQIKYYTYYEDGKLSIDKWLKELKESCSSRDPDWPPSIVLHACCHNPTGVDPTLEQWQQILPVIHDLGITPIIDMAYQGMESGNLIQDAYLLRMCLEYEWPNGLFVCQSFAKNMGLYGERVGSLSVVVPPNPLDLKSTIDSQLKKIVRGIYSSPPGYGSRVANLVLSNPKLKQQWFVDVKNMSDRLWNVRIQMHERLNWPNLVDFKTQHGMFYYTGLNPYQVQILQERYGIYLTEDGRMSLSGVNDGNIDYLCDSLRQVVQ

SEQ ID NO: 55008 - DNA, 1266 bp, Kluyveromyces lactis NRRL Y-1140
  CDS (1)..(1266)
atgtccagaaccatacttaacaacatccaagaattgccaggcgatgctttattcgctatcaaacaacgtttagctgaagaccctagatctgctaaggtcgatttgggtattggtgcctatagagatgaggatggtaaaccatgggtattaccagctgttcgtaaagctgaaacattgatccattctgacgcatctttcaaccatgaatatttgggtattgccggtttacctgctttgacttcaggtgcagccaaagtgatcttgggcgatgattcatctgctttggctgagaaaagagttgtttctgctcagtctctatccggtactggtgccttacacattgcagctaaattcatccaaaagttcttacctgggaagttgttgtatgtttctgatccaacctgggctaaccatgtctctatctttgagtcacaaggtgtcaaaactgctacgtatccttactgggatgctgctaccaaatctttggatttggaaggatttatcaaggctatagaatcaagtccaagaggctccgtgttcttgcttcatgcttgtgctcataatccaactggtttggatccaaccgaagctcaatgggagaaaattctcagtgcctgtgtgaagaatgatatcatcccattgttcgactctgcctaccagggtttcgcatctggtagtctaacgaatgatgcttttgccgtcagacttggtgtgaagaaattcgctgaatctgctccaattttcatctgtcaatcatttgccaagaatgttggtatgtacggtgaacgttgtggatgcattcatttgattgttccaagacaagaatctaacgttaatgtttccactattaccaaagctgttgcatctcaaatcagtaaaatcaccagatcagaggtttctaaccctcctgcttacggtgccaagatcgttgccaaaattttgaacaatgctgaattgactgaacaatggcataaggatatggttacaatgtctcaaagaatcaccaaaatgagacactccttacgtgacaagttactcgagttacagactccaggtaactgggatcacatcgtcaaccaatgtggtatgttctcttacaccggtttaacaaagccaatggtggaaagattagaaaaagaacatggtgtatacatggttgctagtggtagagcttccattgctgggttgaatgaaaagaacgttgaacatgtggctaaggctattaatgaagtcgttcgtcatttcaatgaatcatccaaattataa

SEQ ID NO: 55009 - protein, 421 aa, Kluyveromyces lactis NRRL Y-1140
MSRTILNNIQELPGDALFAIKQRLAEDPRSAKVDLGIGAYRDEDGKPWVLPAVRKAETLIHSDASFNHEYLGIAGLPALTSGAAKVILGDDSSALAEKRVVSAQSLSGTGALHIAAKFIQKFLPGKLLYVSDPTWANHVSIFESQGVKTATYPYWDAATKSLDLEGFIKAIESSPRGSVFLLHACAHNPTGLDPTEAQWEKILSACVKNDIIPLFDSAYQGFASGSLTNDAFAVRLGVKKFAESAPIFICQSFAKNVGMYGERCGCIHLIVPRQESNVNVSTITKAVASQISKITRSEVSNPPAYGAKIVAKILNNAELTEQWHKDMVTMSQRITKMRHSLRDKLLELQTPGNWDHIVNQCGMFSYTGLTKPMVERLEKEHGVYMVASGRASIAGLNEKNVEHVAKAINEVVRHFNESSKL

SEQ ID NO: 55010 - DNA, 1212 bp, Debaryomyces hansenii CBS767
  CDS (1)..(1212)
atggtacaatacgaatttttcggagatttaactctagctcccaaagatgaaatgaatgatcttaagataaaacttgaaaattgtcaatccagtaaggttgatgtttccgcaggagtatatagaggggagaatggtgagtcgtatacattatcatcagtaaaagcagctaaaggagtattacatgcaaatgatcccgggcatgactataattttaccctaggtatcaaaaacttcaacctgatggctgctgatatcatatttgggaaagatatttctactggtggatatattgctacatgtcaaacaatatctggaaccggtgcttgcagtatagctattaaatttctagtggactgctgcaaacttaccaatttctatattggaacaccaacttggcccaattacgctccaatgattaaagcagccaatgctgaagtcgtggaatatgttcattacaatccgttgacaagaagtcttgattttgaaagcgttttagaagccatttctaaagctaagatgcattcagtattcatcctacaattatgttgtcataatcccaccggtactgatttttcaatagatcagtggaaaattttggctgataaaatgcaagaaaaaaaaatcatgccagtgtttgattctgcctatcaagggtttggttcaggtgacattgcggtggacgcaaaacctattagattatactatgctaaaggattgcaatttttggtctgtcaatcattctccaaaaacttggggttatatagcgaaagggttggtgcacttcacgtcgtagtatgtgaaaaaaaattagctgaaattgtctctgatcaattaagaagtatattcagaagagagtgttcaagtgcgccagcttatggggctaggttggctgtcattatagcaaacgacccaaaattaactgaacaatggagaaacgatttaagaacaatctataagagactagttgataaaagaattgagcttcatgatttattgataaagtatcaaactccaggcagcttcgatcatttgttaaatcagaatggtttattttggttcagtggtttgtctaaggtccaatgtaaattattggttgaagaatatcatatctttattccttcgaatggtcgcgttaatatagccggtttaaataatagtaatattcattactttgcgaaatcattttccgaagtaatcaagatctcagtatag

SEQ ID NO: 55011 - protein, 403 aa, Debaryomyces hansenii CBS767
MVQYEFFGDLTLAPKDEMNDLKIKLENCQSSKVDVSAGVYRGENGESYTLSSVKAAKGVLHANDPGHDYNFTLGIKNFNLMAADIIFGKDISTGGYIATCQTISGTGACSIAIKFLVDCCKLTNFYIGTPTWPNYAPMIKAANAEVVEYVHYNPLTRSLDFESVLEAISKAKMHSVFILQLCCHNPTGTDFSIDQWKILADKMQEKKIMPVFDSAYQGFGSGDIAVDAKPIRLYYAKGLQFLVCQSFSKNLGLYSERVGALHVVVCEKKLAEIVSDQLRSIFRRECSSAPAYGARLAVIIANDPKLTEQWRNDLRTIYKRLVDKRIELHDLLIKYQTPGSFDHLLNQNGLFWFSGLSKVQCKLLVEEYHIFIPSNGRVNIAGLNNSNIHYFAKSFSEVIKISV

SEQ ID NO: 55012 - DNA, 1221 bp, Debaryomyces hansenii CBS767
  CDS (1)..(1221)
ttgaaaatgacaatcaaaagtaatttttctaatttaacgagagaagcaccagatccaatcgtggaaaccatgaccatgtatgcacaagatacttctccagataagattgatgtatcgataggtgtatacaaaggagagaagggagagtcatatgtttttcctgcggtgtctaaggctaagaagcacttatttgaaaatgatccgggacatagctataccaatatggcaggtattccagaatatacgagcggagcacgtaaggttgtgtttggagaaaaatatggtaccgaaggaaagattgcatcgttacagactatttcagggacaggggcttgccatatggcatttcttcttcttcgtgaagcggggctcactaacttctatgttggtacaccatgttggtcgaactatgggccaatgattacgcatgttggctcaaaatactccacatacactcactatgacgaaagtctccgtgggattgattttgatgctgttcttgaggcacttcagaatgcaccatcaaaatctgtattcttatttcaagcgtgttgtcataaccctacaggagcggatttttccaaagatcagtggaagcaaattgcttcaattgttaagtccagagatatcttccctgtttttgatattgcataccaaggattttcaagcggcgataaggatgttgatgcctggcctgtgaggtatttctacgagcaaaatttagaatttttagtttgccaatcattctccaagaacatgggattatacagtgaaagagcaggatgtcttcatgctgtggtacaagatacggattacgttccaaacgtgcaaagtcaacttgtggcactctttagatcggagtgctcttttgctccagcatatggtgcaagaattgccagtattatcatcaacgagcctggattagaaaatcagtggggccaagaagtttccgatgtgaccacaagattgaagaatattagaaagcagattttggataaatttctcgaattaggtactcctggtaagtgggatcatgtagtaaagcagcaagggttgttttggtattctggattatcacccgaacaaaacgataagcttatagaagaccatcatatttattcaacttcaattggcagagttaatattgccgggttaaatgaaagtagtgttgataaatttgttggcgccattgacaaggttgtcagagattctattggttaa

SEQ ID NO: 55013 - protein, 406 aa, Debaryomyces hansenii CBS767
LKMTIKSNFSNLTREAPDPIVETMTMYAQDTSPDKIDVSIGVYKGEKGESYVFPAVSKAKKHLFENDPGHSYTNMAGIPEYTSGARKVVFGEKYGTEGKIASLQTISGTGACHMAFLLLREAGLTNFYVGTPCWSNYGPMITHVGSKYSTYTHYDESLRGIDFDAVLEALQNAPSKSVFLFQACCHNPTGADFSKDQWKQIASIVKSRDIFPVFDIAYQGFSSGDKDVDAWPVRYFYEQNLEFLVCQSFSKNMGLYSERAGCLHAVVQDTDYVPNVQSQLVALFRSECSFAPAYGARIASIIINEPGLENQWGQEVSDVTTRLKNIRKQILDKFLELGTPGKWDHVVKQQGLFWYSGLSPEQNDKLIEDHHIYSTSIGRVNIAGLNESSVDKFVGAIDKVVRDSIG

SEQ ID NO: 55014 - DNA, 1296 bp, Debaryomyces hansenii CBS767
  CDS (1)..(1296)
atgttatcaagggtacaattaaagcgcataccaaattgcagacagttttctgtgatgaacagggcttgcaaatggaacgatattccattagcaccaccggataaaatcttgggtatcagcgaagcatttgttaaggattccaacaccaagaaaatcaatttgggagttggtgcatacagaaacaactctggtaagccaattgtgttcgaatcggtcaaaaatgctgaggccaagttattagaaacagaaaccgaaaaggaatacactggtattatcggtaacaagaacttccaaaaagtggtcagaaactttattttcaacaacagcggtaaggacgccaatggggccagattgattgacgaaaacagaatcgtcaccagtcaaaccatttctggtaccggttctttgagggttattgctgatttcttacacagattcaacacggccaagaaaatatacgtgccaaagccaacctgggccaaccacattgctgttttcactgatgctggtatgagtaccgaatactacgattactacaataaggaaatcaacaacttggactacgataagttgaagcaatcgttgtctaacgccgaagaaggttctgtggtcttgttgcacgcttgttgccacaaccctactggtatggacttgtcatccgaacaatgggacgaagtcttagccatcgtccaacaaaagcaattgttcccattagttgatatggcctaccagggtttcgcgtccggtaacccatacaaggacattggattgattcgtagattgaacgagttagtcgtcaacggtgacatttccacctacgctttatgtcaatctttcgctaagaacatgggtttgtacggtgaaagaactggttctatctccattgtcaccgaatctgctgaacattccactgcgattgagtcccaattgaagaagttaatcagaccaatctactcgtcgcctccaatccacggttccaagattgtggaaaccatcttcgccgacgaatccttgtacaactcttggttaagtgacttggaccaagttgtttccagattaaacaccgtcagaaccaagttatacgagaaattggacaagtccaactacaactgggaccacttattaaaacaaagaggtatgttcgtttacactggtttatcagctgaacaagttattgaattgagagaaaagtactctgtttacgctactgaagacggtagattctccatttctggtatcaacgacaacaacgttgattacttggccgatgccatgaaccaagttgttaacaaataa

SEQ ID NO: 55015 - protein, 431 aa, Debaryomyces hansenii CBS767
MLSRVQLKRIPNCRQFSVMNRACKWNDIPLAPPDKILGISEAFVKDSNTKKINLGVGAYRNNSGKPIVFESVKNAEAKLLETETEKEYTGIIGNKNFQKVVRNFIFNNSGKDANGARLIDENRIVTSQTISGTGSLRVIADFLHRFNTAKKIYVPKPTWANHIAVFTDAGMSTEYYDYYNKEINNLDYDKLKQSLSNAEEGSVVLLHACCHNPTGMDLSSEQWDEVLAIVQQKQLFPLVDMAYQGFASGNPYKDIGLIRRLNELVVNGDISTYALCQSFAKNMGLYGERTGSISIVTESAEHSTAIESQLKKLIRPIYSSPPIHGSKIVETIFADESLYNSWLSDLDQVVSRLNTVRTKLYEKLDKSNYNWDHLLKQRGMFVYTGLSAEQVIELREKYSVYATEDGRFSISGINDNNVDYLADAMNQVVNK

SEQ ID NO: 55016 - DNA, 1263 bp, Debaryomyces hansenii CBS767
  CDS (1)..(1263)
atgtcaaaatatttttcaagtattaaagaattacctccagatccattatttgggttgaaagctagatacacggccgatgaccgttcagataaagtagatttgggaatcggtgcttatagagataataacgggaagccatggatattaccagcggttagaaaggcagaagtgaagttggttaactcggaagaatacaaccacgagtatttatcgatttcggggtatcagccatttttgaccgagagtgctaaagttattttgggaaacaactcagctgccatcaaggaatcaagagtgaccagtcaacaatcgttgtctggtaccggggctttgcacttggctggagcctttttgaaggaatttttcaccactgaatcgaagaaagctccaacggtgtacttatcgaatcctacgtgggccaaccataaccaaattttcactagtttgggtttgcaggtagagaagtatccatactgggacaatgataccaaatcattgaacttgaaggggttcttgtcgactattcaagaagcacctaagaactcgatttttgtgttgcatgcgtgtgcccataatcctactggactcgatgccaccaaggagcaatgggaggaaattctcgaagcattggccaagaatgaacacttagcattatacgactctgcctaccaagggttcgctagtggtaacttggataacgatgggtttgctgtaagattggctgtcgactcgaagaagttgaaaaccccaattgttatctgtcaatcttttgcaaagaattgtggtatgtacggtgaaagagttggtgcaattcacgtcatcccagccgagaatgataagtcgttgaacaacgctataaagtcgcaattgaacaagctcaccaggtcggaaatttctaatcccccagcgtacggagccaaggttgttgcaaccattttgaccgactcagaattgagacagcaatgggaagacgacttggtcaccatgagttcgagaatcaacaaaatgagaaccaggttgagagatttgttgacaaaccaatacagcactcctggcaactgggatcacattgtctcccaatcaggtatgttctcgttcacaggattgaccccagatatggtgtccagattggaaaagaaccacggaatctacttggttagctccggtagagcctccgttgctggtttgaatgatggcaacgtcgaacaggtcgctaaggctatcgacgaagttgttcgtttctactccaagtccaagttataa

SEQ ID NO: 55017 - protein, 420 aa, Debaryomyces hansenii CBS767
MSKYFSSIKELPPDPLFGLKARYTADDRSDKVDLGIGAYRDNNGKPWILPAVRKAEVKLVNSEEYNHEYLSISGYQPFLTESAKVILGNNSAAIKESRVTSQQSLSGTGALHLAGAFLKEFFTTESKKAPTVYLSNPTWANHNQIFTSLGLQVEKYPYWDNDTKSLNLKGFLSTIQEAPKNSIFVLHACAHNPTGLDATKEQWEEILEALAKNEHLALYDSAYQGFASGNLDNDGFAVRLAVDSKKLKTPIVICQSFAKNCGMYGERVGAIHVIPAENDKSLNNAIKSQLNKLTRSEISNPPAYGAKVVATILTDSELRQQWEDDLVTMSSRINKMRTRLRDLLTNQYSTPGNWDHIVSQSGMFSFTGLTPDMVSRLEKNHGIYLVSSGRASVAGLNDGNVEQVAKAIDEVVRFYSKSKL

SEQ ID NO: 55018 - DNA, 1302 bp, Yarrowia lipolytica CLIB99
  CDS (1)..(1302)
atgctccgaaccatcgcccgaacccacgctgtggccgccaccaaggtcgtgcgagcctccactttttctgccacccccgccgcctcttttgtgcgattccagtccgtctgggccaaggtcccccagggtccccccgacgccattctcggaatcaccgaggcgttcaagaaggacgcctttgagcagaagatcaacctcggtgttggcgcctaccgagatgacggcggaaagcccttcgttcttccctccgtccgagaggccgagaaggaggtggtgaacaaggccctcgacaaggagtacgcccccatcaccggagtccccgccttcaccaaggctgctgccgagctcgcttacggcgccgactcccccgccgtcctcgaggaccgaattgccatcacccagaccatctccggtaccggtgctctgcgaatcggagccgagttcctcaacaagttctactcctccaagaagattctgctcccccagccttcttgggctaaccacaaggccgttttcaccgccgccggcctcgagcccgccacctaccggtactacgaccccaagaacattgccctcgactttgagggtctgctcgccgacctggaggctgcccccaacggaaccgccgtccttctgcacgcctgtgcccacaaccccaccggtgttgaccccactcccgagcagtggcgaaagattgaggaggtcgtcaaggccaagggccacttccccttcttcgacatggcctaccagggctttgccaccggtgacgtcaaccgagacgcctaccccatccgatactttgtcgagcagggccacgaggttgctctgtgccagtccttcgccaagaacatgggtctttacggtgagcgagtcggtgctttctctcttgtctgccaggacaccgccgagaagaaccgagttgactctcagctgaagattatcatccgacccttctactccaacccccccgtccacggtgcccgaatcgccgccaccatcctcaacaaccccgagctcaagaagcagtggctcggtgaggtcaagcagatggccgaccgaatgatcaagatgcgagctctgctcaaggagaacctcgagagacttggctcccagcagaactgggaccacgtcacctctcagattggtatgttctgctacaccggtctgtctcctgagcaggttgagcgacttgccaaggagttctccgtctacggaaccaaggacggccgaatctccattgccggaatcacctctcagaacgtcggccgactggcccaggctatctacgaggtgaccaaatag

SEQ ID NO: 55019 - protein, 433 aa, Yarrowia lipolytica CLIB99
MLRTIARTHAVAATKVVRASTFSATPAASFVRFQSVWAKVPQGPPDAILGITEAFKKDAFEQKINLGVGAYRDDGGKPFVLPSVREAEKEVVNKALDKEYAPITGVPAFTKAAAELAYGADSPAVLEDRIAITQTISGTGALRIGAEFLNKFYSSKKILLPQPSWANHKAVFTAAGLEPATYRYYDPKNIALDFEGLLADLEAAPNGTAVLLHACAHNPTGVDPTPEQWRKIEEVVKAKGHFPFFDMAYQGFATGDVNRDAYPIRYFVEQGHEVALCQSFAKNMGLYGERVGAFSLVCQDTAEKNRVDSQLKIIIRPFYSNPPVHGARIAATILNNPELKKQWLGEVKQMADRMIKMRALLKENLERLGSQQNWDHVTSQIGMFCYTGLSPEQVERLAKEFSVYGTKDGRISIAGITSQNVGRLAQAIYEVTK

SEQ ID NO: 55020 - DNA, 1296 bp, Yarrowia lipolytica CLIB99
  CDS (1)..(1296)
atgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccgttaagcagtacccctactgggaccccaagactctaggtctggacctcaagggcatgctcaacgctctggagaatgagacccgacccggagacattgttctgttgcacgcctgcgcacacaaccccaccggtgttgaccctgctcgagaggagtgggagaagattgccgctgtctgcaagtccaagaagctcttccccttcttcgactctgcctaccagggctttgcctccggtgatctcgagcgagacgcctgggcagtccagtactttgtttcccagggcctggagctgctcatctgccagtccttcgcaaagaactttggcctgtacggccagcgggccggatgcctgcacttcatcacccagaccgccaaggcgtcggagaacgtcaagtcacagcttgccttcctgcagcgatcagaaatctccaaccctcccatctacggtgcccgaattgtggcccgagttcttaacaaccccgagctcttcaatgagtggaaggaaaacctgctggagatggccaaccgaatcaagagcatgcgagatgcgctcaagagcgaactcatcaagcttgatactcccggtaactgggaccatatcactaaccagattggtatgttctctttcaccggtctgtcgccccagcaggtggaccgactggttaacgagttccacgtttacctgaccaagaacggccgaatttccatggctggtcttaacacacacaacgtcgcttacgtcgccaaggcctttgatgccgtcgttcgaggttaa

SEQ ID NO: 55021 - protein, 431 aa, Yarrowia lipolytica CLIB99
MSYFASVPAAPADALFGLMAKYKADTFDKKVDLGVGAYRDNTGKPWVLPVVSKVDSLIVADPTANHEYLPITGLPDFTKSAAKLILGPDSPAIKENRVASCQTISGTGANHLGSLFLSRFPSSAAPPKSVFLSRSPPSPGATGDTPPRAAGGRIWISNPTWANHKQIFENVGLTVKQYPYWDPKTLGLDLKGMLNALENETRPGDIVLLHACAHNPTGVDPAREEWEKIAAVCKSKKLFPFFDSAYQGFASGDLERDAWAVQYFVSQGLELLICQSFAKNFGLYGQRAGCLHFITQTAKASENVKSQLAFLQRSEISNPPIYGARIVARVLNNPELFNEWKENLLEMANRIKSMRDALKSELIKLDTPGNWDHITNQIGMFSFTGLSPQQVDRLVNEFHVYLTKNGRISMAGLNTHNVAYVAKAFDAVVRG

SEQ ID NO: 55022 - DNA, 1377 bp, Oryza sativa (japonica cultivar-group)
  CDS (1)..(1377)
atggcttccgcccccttcgccgtctcctcctcaccggcggcttccgccgtggccgcgcgctccaaggtgttgcgaggagggaggagcgaggcgaggactggatgccgcctggggatcacgaggaagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggctgaaactcttatgttggagaaaggagaaaacaaggagtatctgccaattgaaggcttagctgcatttaacaaagcaactgcagaactattgtttggagctgataatccagtactcaagcaaggacgtgttgctactcttcagtctctctcaggaaccgggtcgctgcgccttgctgcagcatttatacaaagatatttccctgaagcaaaagtactgatatcatctcccacttggggcaatcacaagaacattttcaatgatgcaaaggtaccttggtcagagtaccgttattacgaccccaagactgttggcttggattttgagggaatgatagctgacatacaggctgccccagatggatcttttgttctgctgcatggttgcgctcacaacccaactggaatagacccaactccggaacaatgggagaaaattgcagatgtcattcaagagaagaaacacatgcctttctttgatgttgcatatcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcagagtgataatatgaccgacaaatggcacatatacatgacaaaggatgggagaatttcgttggctggattgtccctggctaaatgcgagtacctagctgacgccatcatcgactccttccataacgttagctag

SEQ ID NO: 55023 - protein, 458 aa, Oryza sativa (japonica cultivar-group)
MASAPFAVSSSPAASAVAARSKVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 55024 - DNA, 1677 bp, Pan troglodytes
  CDS (1)..(1677)
atggccctgctgcactccggccgcgtcctccccgggatcgccgccgccttccacccgggcctcgccgccgcggcctctgccagagccaggaaggcgggcaacgcaatccctagggaaaggaagtgtggccctcggcggttcccggactcccattcagtgggaggggtgcggatagtactgaggcagcggcgccgggtaacgaccgtgcccttgatagggtgcccagggggcggcgggcgcacctgtcctggcccccggcccgcccgagtcggtgggccggcggcggctggctgccgcgtgtgtgccctgggcgggaagagcgcgagagggaggtttccggggcgccggcattcgggcctcgctttcctccccgcacctacgaccttggcgtgcggcattctcctgaccttgcgaccccccgaggtccctgtgaccccggggcccgtttggcctttgcttgggaaagggtcgagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacaggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggccgaccgtatcattggcatgcggactcaactggtctccaacctcaagaaggagggttccacccacaactggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaa

SEQ ID NO: 55025 - protein, 558 aa, Pan troglodytes
MALLHSGRVLPGIAAAFHPGLAAAASARARKAGNAIPRERKCGPRRFPDSHSVGGVRIVLRQRRRVTTVPLIGCPGGGGRTCPGPRPARVGGPAAAGCRVCALGGKSARGRFPGRRHSGLAFLPAPTTLACGILLTLRPPEVPVTPGPVWPLLGKGSSSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 55026 - DNA, 1302 bp, Canis familiaris
  CDS (1)..(1302)
atgcccaccctttctgtgttcctggatgtgcccttggcccagaagctagaaggcagcttgttaaagacctacaagcaagacgattgtcctaagaagattttcttggcctatagagtctgcatgaccactgaaggccaaccctgggtttcttccgtggtgcccaagatccggcttcagatatcgcaggacccgtctctgaactacgagtatatgccaatgatgggtatgaaatcattcatggaggcctccttgaaactcctctttggaaagtacaaccaagtcattgtggagaacagggtagggggcgtgcacactgttggtgacaatggtgccttccaacttggggcccagttcctcaaaatctggcgtaaagattctcgaatagtttacatcatttcttctaaaaaagccagtgaccctcagacccattctcttacatgtctgcctccatttcctctgtaccagctgaaggggggctgtgttcctacagaatcacatggactcgtcttccaggacatgggctttacagtttgtgaatactccttgtgggattccaagcagctgtgcatggaccccaatgtgcttctcgatgtggcggagcaggccccgcatggctgtatctttgtgattgggaacattggtgactgcaagttgacacagagtcagtgggcaaggttgatagccagcatgaagagcaagcagatattcccattttttgacattccttatcaaggtttgtccaccgggaacttggaggaagatactggattcttacaatactttgtgtctcaggactttgagttcttctgcagccagtctctgtccaagatttttggcatctatgatgaaggagtgggggtcctggtcgtggtggcactcaacaaccagctcctgctatgcgtcctctcccagctgatgaatctcacccaggccctgtggctaaaccctcctactagaggtgctcgcattatcacctccatcctctgtaaccctgctcttcagggggaatggaagcagagtctgaaagagcttgtagagaacatcatgctgatcaaggaaaaggtgaaggagaagctccggctcctgggaacccctggctcttgggatcacatcacagaccagaacgggccccagagctatcttggactcaactcccaaaaggtggaatacctggtcaagaaaaagcatatctacatccctaagaacggtcggatcaacttcacctgtatcaatgcctggaacatagattatatcactcagagcatcaacgaggctgtcctctcccccgagggctcagagtaa

SEQ ID NO: 55027 - protein, 433 aa, Canis familiaris
MPTLSVFLDVPLAQKLEGSLLKTYKQDDCPKKIFLAYRVCMTTEGQPWVSSVVPKIRLQISQDPSLNYEYMPMMGMKSFMEASLKLLFGKYNQVIVENRVGGVHTVGDNGAFQLGAQFLKIWRKDSRIVYIISSKKASDPQTHSLTCLPPFPLYQLKGGCVPTESHGLVFQDMGFTVCEYSLWDSKQLCMDPNVLLDVAEQAPHGCIFVIGNIGDCKLTQSQWARLIASMKSKQIFPFFDIPYQGLSTGNLEEDTGFLQYFVSQDFEFFCSQSLSKIFGIYDEGVGVLVVVALNNQLLLCVLSQLMNLTQALWLNPPTRGARIITSILCNPALQGEWKQSLKELVENIMLIKEKVKEKLRLLGTPGSWDHITDQNGPQSYLGLNSQKVEYLVKKKHIYIPKNGRINFTCINAWNIDYITQSINEAVLSPEGSE

SEQ ID NO: 55028 - DNA, 1293 bp, Canis familiaris
  CDS (1)..(1293)
atggccctgttgcactccggccgcgtcctgtctggggtcgccgccgccttccacccaggcctcgctggtgcggcttctgcgagagccagttcctggtggacccatgtggaaatggggcctccagaccccatcctgggagtcacagaagcctttaagagagacactaacagcaaaaagatgaatctgggagttggcgcctatcgggatgataatggaaagccttatgtgctccctagtgtccggaaggcagaggcccagattgctgcaaaaaatttggacaaagaatacctgcccattgctggacttgctgaattttgtaaggcatctgcagaactagccctgggtgagaacaatgaagtgttgaaaagtagccggtatgtcaccgtgcagaccatttctggaacaggggcattgaggattggagccagttttctgcaaagattttttaagttcagccaagatgtctttctgcccaaaccatcctggggaaaccatacaccaatcttcagggacgctggcatgcagctacatggttatcgatactatgaccccaagacgtgcggctttgatttcacaggcgctatagaggacatttcgaaaatgccacagcaaagtgttcttctcctgcatgcctgtgcccacaatcccacgggagtagacccccgccctgagcagtggaaggaaatagcaacagtggtgaagaaaaataatctctttgcattctttgacatggcctaccaaggctttgccagtggtgatggtaacaaggatgcctgggctgtacgccacttcatcgaacaaggcattaatgtttgtctctgccaatcctatgccaagaacatgggcttatacggtgagcgtgtaggagccttcactgtggtctgcaaggatgctgatgaagctaaaagggtggagtcacagttgaagatcttgatccgtcccatgtattccaaccctccaatcaatggggcccgaattgcctcaaccatcctgaccagccctgacctgcgaaaacaatggttgcaggaagtaaaaggcatggccgaccgcatcattagcatgcgtactcagctggtctccaacctcaagaaggagggctcctcccacaattggcagcacatcactgaccagattggcatgttttgtttcacaggactaaagcctgaacaggtggagaggctgaccaaggagttctccatctacatgacaaaggatggccgcatctctgtggcaggggtcacctctggcaatgtgggctaccttgcccatgccattcaccaggttaccaagtaa

SEQ ID NO: 55029 - protein, 430 aa, Canis familiaris
MALLHSGRVLSGVAAAFHPGLAGAASARASSWWTHVEMGPPDPILGVTEAFKRDTNSKKMNLGVGAYRDDNGKPYVLPSVRKAEAQIAAKNLDKEYLPIAGLAEFCKASAELALGENNEVLKSSRYVTVQTISGTGALRIGASFLQRFFKFSQDVFLPKPSWGNHTPIFRDAGMQLHGYRYYDPKTCGFDFTGAIEDISKMPQQSVLLLHACAHNPTGVDPRPEQWKEIATVVKKNNLFAFFDMAYQGFASGDGNKDAWAVRHFIEQGINVCLCQSYAKNMGLYGERVGAFTVVCKDADEAKRVESQLKILIRPMYSNPPINGARIASTILTSPDLRKQWLQEVKGMADRIISMRTQLVSNLKKEGSSHNWQHITDQIGMFCFTGLKPEQVERLTKEFSIYMTKDGRISVAGVTSGNVGYLAHAIHQVTK

SEQ ID NO: 55030 - DNA, 1242 bp, Canis familiaris
  CDS (1)..(1242)
atggcgcctccgtccgtgttcgccgaggtgccgcaggcccagccggtgctggtcttcaagctcactgccgacttccgggaggatccggacccgcgcaaggtcaacctgggagtgggagcttatcgcacagacgattgccagccctgggttttgccagttgtgaggaaggtggagcagaagattgccaatgaccatagcctaaaccacgagtacctgccgatccttggcctagcggagttccggacctgtgcttcccgccttgttcttggggatgacagcccagctctccaggagaagcgggttggaggtgtgcagtctttggggggaacaggtgcacttcgaatcggagccgagttcttagcacgatggtacaatggaacgaacaacaaggacacgcctgtctatgtgtcctcaccaacctgggagaatcataatggtgtgttttccgccgctgggtttaaagacatccggtcctatcactattgggatgaagcgaaaagaggacttgatctccagggtttcctgaatgatctggagaatgcccccgagttctccatctttgtcctccatgcttgtgcacacaacccaactgggactgacccaactccggagcagtggaagcagatcgcctctgtcatgaagcgtcggtttctgttccccttctttgactcagcctatcagggctttgcatctggagacctagagaaggacgcctgggctgttcgctattttgtgtctgaaggatttgagctcttctgtgctcagtccttctccaagaactttggactctacaatgagcgtgtgggcaatctgaccgtggttgccaaagatgccgatagcatcctgcgggtcctttcccagatggagaagattgttcgaattacttggtccaacccccctgctcagggagcgcggattgtggcctctaccctctctaaccctgagctctttaaggaatggacaggtaacgtgaagacaatggctgaccggattctgaccatgagatctaaacttagggaacgcttagaagccctcaagactcctggaacctggaaccacatcacggagcaaattggaatgttcagcttcaccgggttgaaccccaagcaggttgagtatctggtcaacgaaaagcacatctatctgctgccaagcggtcggatcaacatgtgtggcttgaccactaaaaatctagagtacgtggccacctccatccatgaggctgtcaccaagatccagtga

SEQ ID NO: 55031 - protein, 413 aa, Canis familiaris
MAPPSVFAEVPQAQPVLVFKLTADFREDPDPRKVNLGVGAYRTDDCQPWVLPVVRKVEQKIANDHSLNHEYLPILGLAEFRTCASRLVLGDDSPALQEKRVGGVQSLGGTGALRIGAEFLARWYNGTNNKDTPVYVSSPTWENHNGVFSAAGFKDIRSYHYWDEAKRGLDLQGFLNDLENAPEFSIFVLHACAHNPTGTDPTPEQWKQIASVMKRRFLFPFFDSAYQGFASGDLEKDAWAVRYFVSEGFELFCAQSFSKNFGLYNERVGNLTVVAKDADSILRVLSQMEKIVRITWSNPPAQGARIVASTLSNPELFKEWTGNVKTMADRILTMRSKLRERLEALKTPGTWNHITEQIGMFSFTGLNPKQVEYLVNEKHIYLLPSGRINMCGLTTKNLEYVATSIHEAVTKIQ

SEQ ID NO: 55032 - DNA, 1221 bp, Parachlamydia sp. UWE25
  CDS (1)..(1221)
atgtcatttgagataagggatcccatgcctttttttaataatatttctcttttgccaccagacccaattttaaatctttctatagacttctctcttgatcaaaatcctcaaaaaattaatttgagtgcaggaacttataaaactgcagatgggcattcgctagttttcaccagtgtccgaaaagcagaaattgatctgcttcaaaaacatctcaataaagattatcaaccgatagagggaaatagtgttttcctaaaaaattctttagagctgttatttggttcagaccacgctttgtttaccaataaaaaattttttgctgttcaaaccgttggaggaacaagcgctttaagattaggaggagagtttttaaataagcttacttgccaaaaaatttttatttctcaaccatcgtggccaaaccacaaacaggtttttgaaaaaacaggtttaaaaattgattcctatccttacttcgattttaatgcatacaaattaaatttttcagggatgtgccaagccatccgccaaatgccaactggaagcgttatccttctgcatggttgctgtcacaatccatcaggggtcgatccaacttttgaacaatggaaagagctttctcagcttattaaaaaacatgaactcattcctttttttgatatcgcttatcaaggatttgggaaagatttagaactcgatgcacaacctattcggtactttgctagtgaaggccatgaaatgttgatcgcttactctttttctaaaaattttggtttatacggggaacgagtaggttttttgactgttgtgacatctcaacaaaaacaaataccatctatagctagtcaattaaaggttttaattcgtgctaattactccaatcctcctcttcaaggagctcgaattgtttctacaatcttgagttcaccagaattaaccgaagaatggaaaatagaattaaaaaatatgcgtgaccgagttgttgaaatgcggaaaacatttattgcttctttgttagtcaaaggagaagataaaaatttaaactacttgcaacaacaaattggtttatttggtttttgtggattaaattattcccaagtcaatcgtttgcggaaagaatttgctatttatattcctagcgacggacgaatcaatattgcaggattaaacactcaaaatattgaatatgtagtcaatgcaatttcatctgttatggagtag

SEQ ID NO: 55033 - protein, 406 aa, Parachlamydia sp. UWE25
MSFEIRDPMPFFNNISLLPPDPILNLSIDFSLDQNPQKINLSAGTYKTADGHSLVFTSVRKAEIDLLQKHLNKDYQPIEGNSVFLKNSLELLFGSDHALFTNKKFFAVQTVGGTSALRLGGEFLNKLTCQKIFISQPSWPNHKQVFEKTGLKIDSYPYFDFNAYKLNFSGMCQAIRQMPTGSVILLHGCCHNPSGVDPTFEQWKELSQLIKKHELIPFFDIAYQGFGKDLELDAQPIRYFASEGHEMLIAYSFSKNFGLYGERVGFLTVVTSQQKQIPSIASQLKVLIRANYSNPPLQGARIVSTILSSPELTEEWKIELKNMRDRVVEMRKTFIASLLVKGEDKNLNYLQQQIGLFGFCGLNYSQVNRLRKEFAIYIPSDGRINIAGLNTQNIEYVVNAISSVME

SEQ ID NO: 55034 - DNA, 1215 bp, Acinetobacter sp. ADP1
  CDS (1)..(1215)
atgtttcaacatatcccaccgtatgcgggcgatccaatcttgtcgcttatggaacaattcaacgccgattcacgcgaagcgaaagttaatttgagcattggtctttattataatgaagacagtattgtgcctcagcttgacagcgtcattgaagcacaaaaacgcattgaaccacgtcaaaacaaggttaagccatacctgccaatggaaggttttaaaccttaccgtgatgcaattcaaaccttgctctttggtcacaatagcccagcagttaaagcagggcgtgccgtgaccattcagacgcttggtggctcaggtgcacttaaagtgggtgcagattttttaaaaaactatttcccagattcagaagtctgggtaagccagccaacctgggataatcatatcgccatttttaatggtgcaggatttaaaacgcatttttatccgtactttgatgcagaaacacgtggtctcgattttgaaggcatgttagcgacattaaaacagcttccaaagcacagcattgtgctactacatccatgctgtcataacccgactggtgttgatctggtaccggcacaatgggatcaggtcattgacgtattaaaagcaggccatctgattcctttcctcgacattgcctatcagggctttggtgatggcatggagcaagatgcttatgcaattcgtgcacttgatcagtctggtcttaattttattgtcagcaattcgttctccaaaatcttttcactgtatggcgaacgtgtaggcgggctcacctttgtttgtgatgatgccgaagcagctcaatgcacttttggccagttaaaagcgactgtacgtcgaatttattctagtccaccgactacaggtgcatggttggtcgatcaggtcttgaatgatgctgaactcagtcaacagtggcaaaatgaagttaaggagatgcgtgaacgtattctcaaaatgcgtatcattttacgtgatgaattgaccaaggctttaccagatcgtgactttaactatctggtcgatcaaaaaggcatgtttagctatacaggtttgactgcagatcaggtcgataccctgcgtgaagattatgccatctatctggttcgtagtggccgtatttgtgttgcgggtttaaacatgaataatgtctatattgtagccaaagcgatggctgaagtattagccaccgaagtgactcctgcttaa

SEQ ID NO: 55035 - protein, 404 aa, Acinetobacter sp. ADP1
MFQHIPPYAGDPILSLMEQFNADSREAKVNLSIGLYYNEDSIVPQLDSVIEAQKRIEPRQNKVKPYLPMEGFKPYRDAIQTLLFGHNSPAVKAGRAVTIQTLGGSGALKVGADFLKNYFPDSEVWVSQPTWDNHIAIFNGAGFKTHFYPYFDAETRGLDFEGMLATLKQLPKHSIVLLHPCCHNPTGVDLVPAQWDQVIDVLKAGHLIPFLDIAYQGFGDGMEQDAYAIRALDQSGLNFIVSNSFSKIFSLYGERVGGLTFVCDDAEAAQCTFGQLKATVRRIYSSPPTTGAWLVDQVLNDAELSQQWQNEVKEMRERILKMRIILRDELTKALPDRDFNYLVDQKGMFSYTGLTADQVDTLREDYAIYLVRSGRICVAGLNMNNVYIVAKAMAEVLATEVTPA

SEQ ID NO: 55036 - DNA, 1191 bp, Erwinia carotovora subsp. atroseptica SCRI1043
  CDS (1)..(1191)
atgtttgaaaatatctctgctgcaccggccgatcctattctcgggctgaccgatcttttccgcgccgatgaccgcgcggataaaatcaatctgggtattggtgtctataaagatgaaaccggcaaaactccggttctgaccagcgtaaaaaaagcagaacactatctgctggaaaatgaaaccaccaaaaactatctgggcattgacggtctgccagcattcggtcagtgcacgcaggaactgctgtttggcaagcagaatgccatcattgccgacaaacgtgctcgtacggcacaaaccccaggcggaaccggtgcgttgcgcgtagccgctgatttcattgcaaatcagacgtcagcaaaacgcatctggatcagtaacccaacctggccaaatcacaataacgtgttctctgctgccggtttggaagtttgccagtatgactattacgatgctgctaaccacgcactggattttgatggtttgctgaatagcctgaacgccgtagaagcgggtgacgtggtgctgtttcacggctgttgtcataacccaaccggtatcgatcctaccgctgagcagtgggctacgctggccgagctgtcggtagcaaaaggctggctgccgctgtttgacttcgcctatcagggctttgcccgtggtatcgaagaagatgcggaaggcctgcgactcttcgctgcgaagcacgctgaactgatcgtatgcagctcgtactctaaaaatttcggtctgtacaatgaacgtgtcggtgcctgtacgctggttgctgctgatgccgcaacagcagacaaggcattcagtcaggtgaaagccgccattcgcgcaaactactctaacccgccgtcacacggcgcgaccattgttgctaccatcttgggcaatgatgcgctgaaggccatttgggagcaggaattgacggcaatgcgggagcgtattcagcgtatgcgtcagctgttcgtgaataccttgcaggaaaaaggcgcacagcaggatttctccttcatcatcaaccagaatgggatgttctcattcagcggcttgaccaaggagcaggttctgcgtctgcgtgacgaattcggcgtttatgcggtgaattctggccgagtcaatgttgcaggaatgacgccagaaaacatggcgccactctgcgaagcgattgttgccgtgctctga

SEQ ID NO: 55037 - protein, 396 aa, Erwinia carotovora subsp. atroseptica SCRI1043
MFENISAAPADPILGLTDLFRADDRADKINLGIGVYKDETGKTPVLTSVKKAEHYLLENETTKNYLGIDGLPAFGQCTQELLFGKQNAIIADKRARTAQTPGGTGALRVAADFIANQTSAKRIWISNPTWPNHNNVFSAAGLEVCQYDYYDAANHALDFDGLLNSLNAVEAGDVVLFHGCCHNPTGIDPTAEQWATLAELSVAKGWLPLFDFAYQGFARGIEEDAEGLRLFAAKHAELIVCSSYSKNFGLYNERVGACTLVAADAATADKAFSQVKAAIRANYSNPPSHGATIVATILGNDALKAIWEQELTAMRERIQRMRQLFVNTLQEKGAQQDFSFIINQNGMFSFSGLTKEQVLRLRDEFGVYAVNSGRVNVAGMTPENMAPLCEAIVAVL

SEQ ID NO: 55038 - DNA, 1194 bp, Erwinia carotovora subsp. atroseptica SCRI1043
  CDS (1)..(1194)
atgtttcaaaacgttgatacctatgccggagatcctatcctgtctctgatggaaaaattcaaacaggatccaagagcagataagatcaatttgagtatcgggctgtactacaacgagcagaatattatcccgcagttgcgatccgtcagcacagcggaaagcagcctacggcagcctgctcagagcgcgaattcctatctgccgatggaagggttacagccttaccgcacggctatccagcatttgttgttcggtgaaagccacgcggcgctggaagcaggtcgcatcgcgaccatccagacgttgggcggttccggtgcgctgaaagtcggtgcagatttcctgaaacgctacttcccagcgtcagaagtgtgggtcagcgatccaacatgggaaaaccatattgcgatcttcgagggcgcgggctttaacgttcacacctacccgtatttcgatagcgaaagtctgggcgtgaaatttgacgccatgctctccaccctgcaaacgctgccaacacgcagcattgtgctgctacatccgtgctgccataacccgactggttccgatctcaccaccgaacagtgggatcgcgtcattgaggttatcatccagcgtgagctgattccgtttatggacatcgcttatcagggctttggcctcggcatcgagcaggatgcgtatgcaattcgcgccgttgccagcgcaggcgttccggcactgatcgccaactcgttctccaagattttctcactgtatagcgagcgcgtcggtggcctttccgtggtgtgtgacgatgccgacagcgcgcagcgcgtattgggtcagttaaaagcgaccgtacgccgcaactactcttccccaccaaatttcggcgctcaggtggtttctaaagtcctgaacgacgtgcagttgaacgccgactggaaagcggaagtcgaagagatgcgcacgcgtattctaagcatgcgtcaggagttggtttccgcattgaaaaacgcactgccgaaccgcaacgtcgactacctgctcacccagcgcggtatgttcagttacacgggtttcagcccggaacaagttgaccgcctgcgtgaagaatttggcgtgtacctgatcgccagcggccgtatgtgtatggcgggactcaaccacagcaacgtccaacgcgtcgctgccgctttcgccgccattcagtaa

SEQ ID NO: 55039 - protein, 397 aa, Erwinia carotovora subsp. atroseptica SCRI1043
MFQNVDTYAGDPILSLMEKFKQDPRADKINLSIGLYYNEQNIIPQLRSVSTAESSLRQPAQSANSYLPMEGLQPYRTAIQHLLFGESHAALEAGRIATIQTLGGSGALKVGADFLKRYFPASEVWVSDPTWENHIAIFEGAGFNVHTYPYFDSESLGVKFDAMLSTLQTLPTRSIVLLHPCCHNPTGSDLTTEQWDRVIEVIIQRELIPFMDIAYQGFGLGIEQDAYAIRAVASAGVPALIANSFSKIFSLYSERVGGLSVVCDDADSAQRVLGQLKATVRRNYSSPPNFGAQVVSKVLNDVQLNADWKAEVEEMRTRILSMRQELVSALKNALPNRNVDYLLTQRGMFSYTGFSPEQVDRLREEFGVYLIASGRMCMAGLNHSNVQRVAAAFAAIQ

SEQ ID NO: 55040 - DNA, 1197 bp, Desulfotalea psychrophila LSv54
  CDS (1)..(1197)
atgtggcagaatattgaggcagcaccagcggattctattttaggtcttaccgaggcctttcgtaatgaccccaatcctgcaaaggtaaatcttggcgttggcatttataaggatgaacagggagcaacccctattttacagtgtgtgaagaatgctgaagctcggttgattgaaaccgaggaaagcaaggtctatctgcctatatccggtgcccccgcctatacagaaaacgtacagaagctgctctttggtgaagagagtgaagttatcagctcaaaacgggcgatcacagcccatgcccccggtggcacaggtgccctgaggatgggggcggggctgttgaagacatttttccctgaggccaaggtatgggtaagcactcccacctgggccaaccatacgggtatcttttccagcacaggttttgagattgctcactatccatactatgatgagactcaccgtagcgttgattttcaggccatgctgatgagtctgcgggcagtacctgagggtgatattgtccttcttcatgcctgctgtcataatcccaccggtgttgatttgacactggagcagtggcatcaggttgtagccattgctcaagagaggaactggattccctttcttgactttgcctatcagggctttggcgtcggcacctccgaggatcgctgtgccatagagctctgtgccgaggcggggattgatttttttgtcgccagctctttttccaagaactttggtatgtataatgagcgtaccggagcaattaccgtggttgctgcaaatcaagcaagtgcggctgtggccctcagtcatctgaagaagaccatccgggttgtctactctaatcctccagcccatggtggcctggtggcagctactattttgagtgaccctgaactctatgatctctggcagcaggagctgcaggatatgcgcgagcgcatcatcgccatgcgcgttgctctggtagagggcttgagttcacgcggggttgatcaggatttcagctttattaccgagcagtctggtatgttctcttttagtggtctctccgatgagattgttgcctggcttcgtaaggagaagagtatctatgtggtgggtggtggtcggattaatcttgctggtcttactgccagcaatatagactatgtctgtgatgccattgccgaggctcttaagtcgtag

SEQ ID NO: 55041 - protein, 398 aa, Desulfotalea psychrophila LSv54
MWQNIEAAPADSILGLTEAFRNDPNPAKVNLGVGIYKDEQGATPILQCVKNAEARLIETEESKVYLPISGAPAYTENVQKLLFGEESEVISSKRAITAHAPGGTGALRMGAGLLKTFFPEAKVWVSTPTWANHTGIFSSTGFEIAHYPYYDETHRSVDFQAMLMSLRAVPEGDIVLLHACCHNPTGVDLTLEQWHQVVAIAQERNWIPFLDFAYQGFGVGTSEDRCAIELCAEAGIDFFVASSFSKNFGMYNERTGAITVVAANQASAAVALSHLKKTIRVVYSNPPAHGGLVAATILSDPELYDLWQQELQDMRERIIAMRVALVEGLSSRGVDQDFSFITEQSGMFSFSGLSDEIVAWLRKEKSIYVVGGGRINLAGLTASNIDYVCDAIAEALKS

SEQ ID NO: 55042 - DNA, 1194 bp, Yersinia pseudotuberculosis IP 32953
  CDS (1)..(1194)
gtgttccagaatgttgacgcctacgcaggtgaccccatcctttcactgatggaaagttttaaagccgataaccgggcacataaggtgaatctgagtattgggctttattacaatgaacaaggtgaaatcccgcaaatgcaggctgtggatgctgccgaagcgcaattgagtgctcaacctcatgggacaccggtttatttaccgatggaaggtctgcaatcttaccgtactgctatccagcaattattatttggtcacgaccatccaatgctggttcagcaacgggtggcgacaatacagacggtgggcggttctggtgcgttgaaagtcggggctgatttccttaatcactatttccctgattcacaggtgtgggtcagcgatcctacctgggaaaaccacgtggctatttttagcggcgcaggttttaaagtgaacacctatccgtatttcgacaatgataagctggcggtgaagtttgacccgatgctggcaaccttgcagcaattgcccgccagaagcatcgtgttgttacatccttgctgccacaatccaaccggttctgatctgaccaatgcccaatgggatcgcctcattgatgtggtaaaagagcgtgaactgatcccgttcctggatatagcgtaccaaggctttggggcagggctgaatgaagatgcttatgctatccgcgctatggccgcagctggattgccatgcctcatcagcaactccttctcaaaaatcttctcgctctataacgagcgggtcggtggtttatctgtggtgtgtgaaagtgacgaggccgcagggcgtgtattgggccaattgaaagcgacagtgcgccgtaactattccagcccgccaaactttggtgcgcaggtcgtttcgaaagtcctaaatgatacggtattgcgcgcgcaatggcaggcagaggtggaacagatgcgcctacggatccttgatatgcgccacacgctggtggaagccttaaaagcctcgttaccagagcgcaattttgattatctgttgcaacaacgcggcatgttcagctacaccggctttagtgaggcacaggtagatcgcttacgtgaagagtttggtgtgtatctgattgcgagcggaagaatgtgtatggcgggagtcaatcaccagaatgttgagcaggttgcggttgcttttgcggcggtacagtaa

SEQ ID NO: 55043 - protein, 397 aa, Yersinia pseudotuberculosis IP 32953
MFQNVDAYAGDPILSLMESFKADNRAHKVNLSIGLYYNEQGEIPQMQAVDAAEAQLSAQPHGTPVYLPMEGLQSYRTAIQQLLFGHDHPMLVQQRVATIQTVGGSGALKVGADFLNHYFPDSQVWVSDPTWENHVAIFSGAGFKVNTYPYFDNDKLAVKFDPMLATLQQLPARSIVLLHPCCHNPTGSDLTNAQWDRLIDVVKERELIPFLDIAYQGFGAGLNEDAYAIRAMAAAGLPCLISNSFSKIFSLYNERVGGLSVVCESDEAAGRVLGQLKATVRRNYSSPPNFGAQVVSKVLNDTVLRAQWQAEVEQMRLRILDMRHTLVEALKASLPERNFDYLLQQRGMFSYTGFSEAQVDRLREEFGVYLIASGRMCMAGVNHQNVEQVAVAFAAVQ

SEQ ID NO: 55044 - DNA, 1263 bp, Mannheimia succiniciproducens MBEL55E
  CDS (1)..(1263)
ttgcaaattacaatccttgtgagtataaaagaaaaactcatatcaaagcacaacatttctaaggaaagccctatgtttaaaaatatcactccggcacctgccgacccgattttaggtttaggtgaagccttcaaagcggaaaccagagaaaataaaatcaatttaggtattggcgtttataaagatgcggacggtgtaacgcctattatgactgcagtaaaaaaagcggaaggccagttatttgaaaacgaaaaagataaaaactacctgcctatagagggtgttgcggaatataacgcttatgcaaaagaattgttattcggtaaagattcggaaattatcgcatcaaaccgagcctgcacggtgcaaaccttaggcggaaccggcgcattgcgtattgccgcagaatttgtgcgtcgccaaactaaagcacaaaacgtatggatcagcaaaccgacctggccgaatcataatgcgatttttaatgccgtcggcgtaactattcgcgaatatcgttggtacaaccctgaaactaaagccttagactgggataatttactggctgatttaaacaatgccaacccgggggatgtggtgttattgcacggctgctgtcacaacccgaccggtattgacccgacaccggaacaatggaaagcattagccgagatgtcagcgaaaaacggctggttgccgctattcgactttgcttaccaaggtctggcaaacggtttggaagaagatgccgtcggtttacgtactttcgcagaaacccatcgcgaattattagttgccagctcgttctctaaaaatttcggtttatacagcgaacgtgtcggtgcctttacattagttgcggataatgcggatgtggcggcggtagctttaacacagataaaatcaattatccgtacgctgtattctaacccgtccgctcatggcgcccgtaccgttgcaaccgtattggcaaatccggaactgcgcaaagaatgggaagacgaattaacgagtatgcgtgatcgcatcaaacaaatgcgtaagcaactggttgaattacttaaagaattcggtgcacaggaagatttcagctacatcattgatcaaaaaggaatgttctcattcagcggattaaccgccgaacaggttgaccgtttgaaagaagaattcgctatttacgccgttcgttccggcagaatcaatgtggcgggaatcactgaagccaatatccgttaccttgccgaaagcattgtaaaagtactttaa

SEQ ID NO: 55045 - protein, 420 aa, Mannheimia succiniciproducens MBEL55E
MQITILVSIKEKLISKHNISKESPMFKNITPAPADPILGLGEAFKAETRENKINLGIGVYKDADGVTPIMTAVKKAEGQLFENEKDKNYLPIEGVAEYNAYAKELLFGKDSEIIASNRACTVQTLGGTGALRIAAEFVRRQTKAQNVWISKPTWPNHNAIFNAVGVTIREYRWYNPETKALDWDNLLADLNNANPGDVVLLHGCCHNPTGIDPTPEQWKALAEMSAKNGWLPLFDFAYQGLANGLEEDAVGLRTFAETHRELLVASSFSKNFGLYSERVGAFTLVADNADVAAVALTQIKSIIRTLYSNPSAHGARTVATVLANPELRKEWEDELTSMRDRIKQMRKQLVELLKEFGAQEDFSYIIDQKGMFSFSGLTAEQVDRLKEEFAIYAVRSGRINVAGITEANIRYLAESIVKVL

SEQ ID NO: 55046 - DNA, 1218 bp, Burkholderia pseudomallei K96243
  CDS (1)..(1218)
atgttcgaacaccttcccgcccaccccggcgacccgatcctgtcgctgttccaggcgtttcagcgcgatcccgagccgcgcaaggtcaatctgagcatcggcctttactacgacgaaaacggcgccgtgccggtgctcgacagcgtgcgcgcggcggcggcgcggctggccgcgcgggacgacgcccacacgtatctgccgatggaaggcatggccgactaccggcgcgcgctgcaggcgctcgtgttcggcgcgaacagccccgcgctgcgcgagcagcggatcgcgaccgtgcagacggtaggcggctccggcgcgctgcgcctcggcgcggatctgctcaagcgctatttccccgacagcgcgatctggatcggcgatccgacgtgggacaaccaccgcgtgctgttcgccgcagcgggactcgacgtgcatacgtatccgtattacgacgcggcgacgaacggcgtgcgcttcgacgcgatgatggcgacgctcgacacgctgcccgcgcgcgcgatcgtgctgctgcagccgtgctgccacaacccgacgggcatcgatctgtcgcgcgagcagtggcgcgagctcgccgcgctgtgcgagcggcgcgcgctgattgcgtttctcgacatcgcgtatcagggcttcggcgacggcctcgacgacgacgcgtggccgatccgcgcgatggccgatgcggggctgcccgtgtttgtcagccattcgttctcgaagaacttctcgctgtacggcgaacgctgcggcgggctgtcgatcgcatgcgcgaacgaacgcgaggccgcacgggtgctgagccagatccaggcgggcgtgcgccgcgtctattcgagcccgccgctgcacggcgcgcgcctcgtctcgaccgtgctgaacgatccggcgctcgcgcggcaatgggaccgcgacgtcgccgcgatgcgcgcgcgaatcaagcggatgcgcaccgcgctcgccgcgcggctcgcggcgcgcgtgcccggcgcgtcgttcgactatctcgtcgagcagcgcgggatgttcagctacacggggctcgcgccccatgaggtcgacgcgctgcgcgagcacgacggcgtctatctgctgcgctccggccgcgcatgcatcgcggggctgagcgatgcgaacgtcgaccatgtcgcgaacgcgatcgccgcggtgttgaaggcgcggcgagcgcgcgccgcggcgtga

SEQ ID NO: 55047 - protein, 405 aa, Burkholderia pseudomallei K96243
MFEHLPAHPGDPILSLFQAFQRDPEPRKVNLSIGLYYDENGAVPVLDSVRAAAARLAARDDAHTYLPMEGMADYRRALQALVFGANSPALREQRIATVQTVGGSGALRLGADLLKRYFPDSAIWIGDPTWDNHRVLFAAAGLDVHTYPYYDAATNGVRFDAMMATLDTLPARAIVLLQPCCHNPTGIDLSREQWRELAALCERRALIAFLDIAYQGFGDGLDDDAWPIRAMADAGLPVFVSHSFSKNFSLYGERCGGLSIACANEREAARVLSQIQAGVRRVYSSPPLHGARLVSTVLNDPALARQWDRDVAAMRARIKRMRTALAARLAARVPGASFDYLVEQRGMFSYTGLAPHEVDALREHDGVYLLRSGRACIAGLSDANVDHVANAIAAVLKARRARAAA

SEQ ID NO: 55048 - DNA, 1191 bp, Photobacterium profundum SS9
  CDS (1)..(1191)
atgtttgaaaaaatcactgcagcgcctgccgaccctattcttggcttaactgatgagtttaaaaatgatactcgcccagagaaaattaacttgggtgtaggtatctataaagacgagtcaggaaacacgccagtacttgctacagtaaaaaaagcagaagctattttgctggaaaaagaaacgactaagtcgtacttaggcattccaggtacagcagagtacggtcttgccgttcagcagttattatttggtgctaacgctactattatttcagacaaacgagctcaaacagcacaagctccaggaggtacaggcgcactacgtgttgctgccgagtttattaaacgccaactaggcgatgtgaaagtatggatcagtaacccaacatgggctaaccacatcggtgtattcgcggctgcaggtttagaaacggcttcttactcttattacaatgcagaaactaaagacatcgattttgatgctgctttagctgatcttgcaaacgcaaatgaaggcgatattgttttgctacacggttgctgccacaacccaacaggtatcgaccctgttgaagctcagtggcaccagctagcggcgctgtgtgtagagaaaaagttactgccaatgttcgactttgcatatcaaggtttcgcagtaggcgttgaagaagatgcacaaggtttacgtattttcgccgagcagtgttctgaactattggtggcgagctctttctctaaaaactttggcctatacaacgaacgtgttggcgcgttcactcttgttggtaagaatgcagagcaagctgcaacagcatttagccaagtgaaaagtattgctcgtgttatttactcgaacccgccagcacacggtgcagcaatcgttaccctgattctaaatgatgaagcattgcgtaatgagtgggaacaagaagtagccgatatgcgcaatcgtattcaagaaatgcgcacacttttcgttcaaacattaaaagactgtggtgttgatgctgacttcagctttattgaacgtcaaaatggtatgttttcgttttctggtctaaacaaagaccaagtaaatcgcctaaaagaagagtttggcatttacattgttggttctggccgcattagtgttgctggtatgacaaagaacaacatgctgccattatgtaaaggtattgcagctgtgctataa

SEQ ID NO: 55049 - protein, 396 aa, Photobacterium profundum SS9
MFEKITAAPADPILGLTDEFKNDTRPEKINLGVGIYKDESGNTPVLATVKKAEAILLEKETTKSYLGIPGTAEYGLAVQQLLFGANATIISDKRAQTAQAPGGTGALRVAAEFIKRQLGDVKVWISNPTWANHIGVFAAAGLETASYSYYNAETKDIDFDAALADLANANEGDIVLLHGCCHNPTGIDPVEAQWHQLAALCVEKKLLPMFDFAYQGFAVGVEEDAQGLRIFAEQCSELLVASSFSKNFGLYNERVGAFTLVGKNAEQAATAFSQVKSIARVIYSNPPAHGAAIVTLILNDEALRNEWEQEVADMRNRIQEMRTLFVQTLKDCGVDADFSFIERQNGMFSFSGLNKDQVNRLKEEFGIYIVGSGRISVAGMTKNNMLPLCKGIAAVL

SEQ ID NO: 55050 - DNA, 1182 bp, Photobacterium profundum SS9
  CDS (1)..(1182)
atgtttaagcagcttacacaagcacaacttgacccaattttgtcgctttctattgcctatcgtgcagatgatcgtgcagataaaatggatttaggtattggcgtatataaaaatagccaaggtgaaacgccaattatgcaagctgttcagcaggcgcaacagcaagtactagcaacacaaacaactaaatcttacgttggtcttgctggaagtgaagtcttcaaccaatcgatgatggatttgctgcttagtggtacatccgctcatagccgtgctgctgcagtccaaacaccaggggcgagtggtgcactgcgtatgttggctgatttgatgcacctcgcgcagccagatactactgtgtggttaacaaacccaagctatgttaaccataaacccgtaatggaagcggctggcttaaccgttaaatactacccgtattttgaccatgcaacgaagcaagtaaatagcgatgcaatgttggctgaattagcaaaagcaggccctaaagatgttgtattacttcatgggtgttgccataaccccacgggtgcagatatttcattttctgattggcaagctattactgcgctagcaaataagaatggttttttaccgtttgttgatattgcttatttaggttttggtgatggtttagagcaggatggtgctggtctaaagtacatggctgacaacgttgaagaaatgattgtagcggcatcatgctctaaaaactttggtttataccgagaacgtactggcgcagctattgttatcagtgattctttgccagaagcacaaaaagcgaaaggacgtatcctacaactggcgcgagcttcttatactatgccgcctgatcacggtgctgcattagttgctacaattttgacagatgatgcgttaaccgcaacatggaagcaagagcttgatcaaatgcataagcgtttacttagcttacgttctggtttaacaaaagctgtacgagcacaaggttcagatgcatttaatttcatcgagcagcataaaggtatgttctctgtaacgggtttaagcccagagcagatcgagcgtcttcgtgctgaatacggcatttatgcggtcggtgatggtcgaatcaatattgcaggcctgcaagagcagcaattagattatttagcaaatgcacttattacggtaacaaagtag

SEQ ID NO: 55051 - protein, 393 aa, Photobacterium profundum SS9
MFKQLTQAQLDPILSLSIAYRADDRADKMDLGIGVYKNSQGETPIMQAVQQAQQQVLATQTTKSYVGLAGSEVFNQSMMDLLLSGTSAHSRAAAVQTPGASGALRMLADLMHLAQPDTTVWLTNPSYVNHKPVMEAAGLTVKYYPYFDHATKQVNSDAMLAELAKAGPKDVVLLHGCCHNPTGADISFSDWQAITALANKNGFLPFVDIAYLGFGDGLEQDGAGLKYMADNVEEMIVAASCSKNFGLYRERTGAAIVISDSLPEAQKAKGRILQLARASYTMPPDHGAALVATILTDDALTATWKQELDQMHKRLLSLRSGLTKAVRAQGSDAFNFIEQHKGMFSVTGLSPEQIERLRAEYGIYAVGDGRINIAGLQEQQLDYLANALITVTK

SEQ ID NO: 55052 - DNA, 1215 bp, Azoarcus sp. EbN1
  CDS (1)..(1215)
atgttcgagcacgtcgacgcctatcccggcgaccccatcctctccctcgtcgaaactttccaccacgacccgcgcccgcggaaggtgaacctcggcatcgggctctactacgacgaagagggccgcatcccgctgctcggttcggtcgagaaggccgaggcagcgctggcggcaaatcccggtccgcggccctacctgccgatggaaggagcggccgactatcgcgccgctgtccagaaactcctgttcggtcccgacagcgcagcgttgcgcgcgggccgcatcgcgacgatccagaccatcggaggctcgggcgcattgaaggtcggcgccgacctgctcaagcggtattttccggcgagcgaagtgtgggtcagcgatccgacctgggacaaccatcgttcgatcttcgagggcgccggcatcgaagtgcacgactacccgtactacgacgcggcgagcggcggcgtgcgctttgacgagatgattgagaccctgcagtcgctgcccgcgcagagcatcgtgctgctgcacccgtgctgccataatccaacgggcgtcgacctgtcgacagcacaatggcaggaagtgatcgcagtggtggcgtcgcgcggactgatcccgttcctcgacatcgcgtaccagggcttcggcgacaacctcgacgacgatgcgtacgcggcccgggcgatggccgacgcaggggtgagtttcttcgtcagcaactcgttttccaagaacctgtcgttctacggcgagcgctgcggcggcctgtcggtcgtgtgccaggatgccgatgaagccgagcgcgtgctaggccagctgaaattcaccgtgcgccgcaactactcgagcccgcccgtgcatggcggccgggtcgctgccgcagtcatgaacgatgccggactgcacgaggaatgggtcggtgaagtgcgtggcatgcgcgagcgcatcaaggcgatgcgcgagaagctccacgaagtactgagcagcaccttgccggggcgggatttcagctatttcgtcaaacagcgcggcatgttcagctataccgggctgactcccgagcaggtcgatcgcctgcgcgaggagttcgccgtgtacgtcgtgcagtccggccgcatgtgcgtcgctggtctcaaccggggcaacgtcgattacgtcgcgaaagcgatggctgccgtgctgcaggaggccggcaccgccgctgcctga

SEQ ID NO: 55053 - protein, 404 aa, Azoarcus sp. EbN1
MFEHVDAYPGDPILSLVETFHHDPRPRKVNLGIGLYYDEEGRIPLLGSVEKAEAALAANPGPRPYLPMEGAADYRAAVQKLLFGPDSAALRAGRIATIQTIGGSGALKVGADLLKRYFPASEVWVSDPTWDNHRSIFEGAGIEVHDYPYYDAASGGVRFDEMIETLQSLPAQSIVLLHPCCHNPTGVDLSTAQWQEVIAVVASRGLIPFLDIAYQGFGDNLDDDAYAARAMADAGVSFFVSNSFSKNLSFYGERCGGLSVVCQDADEAERVLGQLKFTVRRNYSSPPVHGGRVAAAVMNDAGLHEEWVGEVRGMRERIKAMREKLHEVLSSTLPGRDFSYFVKQRGMFSYTGLTPEQVDRLREEFAVYVVQSGRMCVAGLNRGNVDYVAKAMAAVLQEAGTAAA

SEQ ID NO: 55054 - DNA, 1206 bp, Azoarcus sp. EbN1
  CDS (1)..(1206)
atgccttcgatcttcgccgccgtcgagatggcgcctcgtgacccgattctcggcctgaacgaggccttcaacaccgacacccgcaccgacaaggtcaaccttggtgtcggcgtctattacgacgacaacggcaagattccgctgctggccgcagtgaaggctgccgaaaaggcgcgcctcgaggccatgccgccgcgtggctaccagccgatcgaaggcgctccggcctacaacaacgcggtgcagaacctgctgttcggcaaggattccgcactgattgcaaacggtcaggtggtgacgatacaggcgctcggcggcaccggggcgctgaaagtcggcggcgactacctgaagcggctgaatccggctgcaaccgtctacatttccgatcccagctgggaaaaccaccgcgcgatcttcgagtccgccggtttcgcggtcgacacctacccgtactacgatccggcgacgcgcggcgtgaacttcgcgggcatgaaagcgaagctcggcgaactggctgccggcgccgtcgtcgtgctgcacgcgtgctgccataacccgaccggcgccgacctcaccgaagcgcagtggggcgaagtggtcgaggcctgccgcgcgcgcggcctcgtgcccttcctcgacatggcgtatcagggtttcgccgacggcatcgagccggatgcagtcgcggtgcgcctgttctccgccagcggcctgcagttcttcgtctccagttcgttctcgaagtcgttctcgctgtacggcgagcgcgtcggcgcgctgtcgatcgtcactgcggacaaggacgaagccggtcgcgtcctgtcgcaggtcaagcgcgtcatccgcacgaactactcgaacccgcctacccacggcggcgcagtcgtcgctgccgtgctcaacgcccccgaactgcgccagatgtgggaagacgagctcgccggcatgcgcgatcgcatccgcgcgatgcgcgttggcctggtcgagagcctcaaaggcgccggcgtcgcccaggatttctctttcgtcatcgagcagcgcggcatgttctcctacaccggcctgtccgccgctcaggtcgagcagctgaagaacgagttcggcatctacgcggtgtcgacgggacggatctgcctcgcggcgctgaactcgcgcaatatcggctacgtcgcgaaggcgatcgcgtcggtcgcgaaggcgtga

SEQ ID NO: 55055 - protein, 401 aa, Azoarcus sp. EbN1
MPSIFAAVEMAPRDPILGLNEAFNTDTRTDKVNLGVGVYYDDNGKIPLLAAVKAAEKARLEAMPPRGYQPIEGAPAYNNAVQNLLFGKDSALIANGQVVTIQALGGTGALKVGGDYLKRLNPAATVYISDPSWENHRAIFESAGFAVDTYPYYDPATRGVNFAGMKAKLGELAAGAVVVLHACCHNPTGADLTEAQWGEVVEACRARGLVPFLDMAYQGFADGIEPDAVAVRLFSASGLQFFVSSSFSKSFSLYGERVGALSIVTADKDEAGRVLSQVKRVIRTNYSNPPTHGGAVVAAVLNAPELRQMWEDELAGMRDRIRAMRVGLVESLKGAGVAQDFSFVIEQRGMFSYTGLSAAQVEQLKNEFGIYAVSTGRICLAALNSRNIGYVAKAIASVAKA

SEQ ID NO: 55056 - DNA, 1224 bp, Zymomonas mobilis subsp. mobilis ZM4
  CDS (1)..(1224)
atgaccgcctatgccgaaaatataacagaaaggccgagccattctgaaaaaaaatcggttttttcaaacttaaaatctcaaccagcagatgcgcttttggaattgatcgcgctttgtcgtgaagatactcgcgaaaataaaattgatgtcggcgttggggttttttgtgatgatcagggacatacccctgtcatgcgagcggttaaagctgccgagatacagcttatccacgaacagaataccaaatcttatttaggatccgcaggcgatatagaattttttctccgattaattccggtcgtctttgggaatgatttcaaagatcatgaacgcttgtcaggcttacagaccccgggtggcaccggagctttaaggctcgcttttgatctcatccatgcaggcaatccgaatgcagacattcattacggtaatccgacatgggttaaccaccttcagatcattgccaatactggtttaaacagcatcagccatcctttttacaatagagaaaagcgtcaaattgattttgatgcggttcttgacgatctgaaacaggtcaaaaggggggatgtcatcttattgcatggctgttgtcataatccgaccggatgcgactttacttttgatcaatggaaagctctttcagaagtcatcagtcaaaaaggattattgccggtcattgatcttgcctatcaaggcttaggcgatggtttagaagaggatgtcgcaggtcttcgttggttgagccaacaagtagacgaaatgatcgtgacatattcttgtgataaaaatttcgggctttatcgagaaagaaccggcgcgattttcgtgttatcccaaaatgccgaaagtcgtaaaatcgttcagtctaatctgatcgcatcaacacgaacccattggtatatgccacccgatcatggcgcagcggctgttcgtattattcttgaaaatgaagctttatatgattcttggcagacagaattaaatgccatgcaacaacggattagcggtaatcgccaatctttggctaaggctgattcctattttgcgcctttgttacagcaaaaaggtatgttctcgatattaccgctgtcaccagaacagattaaaaagctgcgtatcgaaaacgctatttatatggcgccatcgggtcgcatcaatgtcgccggtttaacgccgacaacgatagatccttttgtgaaggcaatacaaaaggttatctaa

SEQ ID NO: 55057 - protein, 407 aa, Zymomonas mobilis subsp. mobilis ZM4
MTAYAENITERPSHSEKKSVFSNLKSQPADALLELIALCREDTRENKIDVGVGVFCDDQGHTPVMRAVKAAEIQLIHEQNTKSYLGSAGDIEFFLRLIPVVFGNDFKDHERLSGLQTPGGTGALRLAFDLIHAGNPNADIHYGNPTWVNHLQIIANTGLNSISHPFYNREKRQIDFDAVLDDLKQVKRGDVILLHGCCHNPTGCDFTFDQWKALSEVISQKGLLPVIDLAYQGLGDGLEEDVAGLRWLSQQVDEMIVTYSCDKNFGLYRERTGAIFVLSQNAESRKIVQSNLIASTRTHWYMPPDHGAAAVRIILENEALYDSWQTELNAMQQRISGNRQSLAKADSYFAPLLQQKGMFSILPLSPEQIKKLRIENAIYMAPSGRINVAGLTPTTIDPFVKAIQKVI

SEQ ID NO: 55058 - DNA, 1185 bp, Silicibacter pomeroyi DSS-3
  CDS (1)..(1185)
atgttcgaaaacctcaaggcgcagcctgcggacaagatccttgccctgatgcagatgtacaaggacgatccgcgcagcgacaagatcgacctgggcgttggcgtctacaagaacgccgagggcgtgaccccggtgatgcgcgccgtcaaggcggccgaaaagatcgtgtgggagcaacaggagagcaaatcctataccgggctgatcggcgatccggcctattcggatgcgatgatcaagctgatcctgggcgatgcggtgcagcgcgccaatgtcggcgctgcggccacgccgggtggcaccggcgcatgccggcaggcgttcgagctgatcaagatggccagtcccgaggcgcgggttttcgtctcggacccgacctggcccaaccatatctcgatcctgaactacctgggcatgaccatggtgccctatcgctatttcgatgccgacagccgtggcgtcgatttcgagggcatgctggtcgatctgggtcaggcgcgcgcgggcgacgtggtgctgctgcatggctgctgccacaacccgaccggcgccaacctgaacctgagccagtggagagaggtggtgaagctgatcaatgccaagggcctcgtggcgatgatcgacatcgcctatcagggctttggcgacgggctggaggaagatgcgcagggcacccgactggtggcctcgtcggtcaaggaatgcctgatcgcggcgtcctgctccaagaactttggcgtctatcgcgagcgcaccggcctgttgatggcggtcagtcaggacagcggccagaccgcgctgaaccaggcgactttggcgtttctgaaccgtcagaactattccttcccgcccgatcacggcgcgcgggtggtgaccaccatcctgaacgacgacgcgctgcgcgccgactggatggccgagctggaggaaatccgcctgtcgatgctgggtctgcgccagcagctggccgacgagttgcagcgtctgagcggctcggaccggttcagttttatcgcgcagcaccggggcatgttctcgcgtatcggcgcggcgcccgagttggtcgagaagctgcggaccgagttcggcatctacatggtgggcgacagccggatgaatatcgccgggctgaatgcccagacggtgccgatcctggccaaggcgatcatcgacgccgggatctga

SEQ ID NO: 55059 - protein, 394 aa, Silicibacter pomeroyi DSS-3
MFENLKAQPADKILALMQMYKDDPRSDKIDLGVGVYKNAEGVTPVMRAVKAAEKIVWEQQESKSYTGLIGDPAYSDAMIKLILGDAVQRANVGAAATPGGTGACRQAFELIKMASPEARVFVSDPTWPNHISILNYLGMTMVPYRYFDADSRGVDFEGMLVDLGQARAGDVVLLHGCCHNPTGANLNLSQWREVVKLINAKGLVAMIDIAYQGFGDGLEEDAQGTRLVASSVKECLIAASCSKNFGVYRERTGLLMAVSQDSGQTALNQATLAFLNRQNYSFPPDHGARVVTTILNDDALRADWMAELEEIRLSMLGLRQQLADELQRLSGSDRFSFIAQHRGMFSRIGAAPELVEKLRTEFGIYMVGDSRMNIAGLNAQTVPILAKAIIDAGI

SEQ ID NO: 55060 - DNA, 1155 bp, Magnetospirillum magnetotacticum MS-1
  CDS (1)..(1155)
atgagcttcaaggcggccgaacgcggcgccatcgcccccttcatcgtcatggacgtgatgcgggcggccgccgcgcgcgaggcccagggcgccgacatcatccatctggaagtgggccagccctcgggtcaggctccgtccggggttcgggaagcggcggcccgcgccgtcggggccgagcctttgggctataccctggctctgggccgtgattccttgcgcgaggccatcgcccggcattaccggcaggcctatggcaggtcggtggcgcccgagcgcatctgcgtcaccaccgggtcttcggcgggcttcctgttggccttcctggccgccttcgcgcccggcgaccgggtggcggtggccgcgcccggctatcccgcctatcgcaacatccttcaggccttgggcgtggactgcgttctggtgccggtgggccccgacagccgctggcagattaccgcccaagtgctggcacggatcgagggcaaactggacggcgtggtggtggcgtcaccttccaatcccaccggctccatgctgtcggcggcggaagtggcggaactggcggcgtggtgcgagtcgaacggcgtgcggttgatctccgacgagatctatcacggcatcacctatggccgcgccgccgccaccgtggccggaatggccaccagcccccacgccgtggtgatcaacagtttttccaaatactacgccatgaccggctggcgcctgggctggatggtgctgcccgaggatctggcccgttcggtggaatgcctggcccagaatctctatatctcgccccccaccctgtcccaggtggcggccgaggcggtgttcgactgcctggacgaattggaggccagggtcgccgcctaccgcgccaaccgcgacattctgctgaacgcgttgccggaagcgggcttcgatcggctggcgccctcggacggcgctttctatctttacgccgatgtgtcggaacggaccgaggacagccgcgagttctgcgcccgcatgctggccgaaaccggggtggcctgcacgcccggcgtggatttcgaccccctggagggacgccgcacgctgcgcttttcctatgccggatcggccgaacacatggccgaggcggccaaacggcttaaggcgtggaagacgtga

SEQ ID NO: 55061 - protein, 384 aa, Magnetospirillum magnetotacticum MS-1
MSFKAAERGAIAPFIVMDVMRAAAAREAQGADIIHLEVGQPSGQAPSGVREAAARAVGAEPLGYTLALGRDSLREAIARHYRQAYGRSVAPERICVTTGSSAGFLLAFLAAFAPGDRVAVAAPGYPAYRNILQALGVDCVLVPVGPDSRWQITAQVLARIEGKLDGVVVASPSNPTGSMLSAAEVAELAAWCESNGVRLISDEIYHGITYGRAAATVAGMATSPHAVVINSFSKYYAMTGWRLGWMVLPEDLARSVECLAQNLYISPPTLSQVAAEAVFDCLDELEARVAAYRANRDILLNALPEAGFDRLAPSDGAFYLYADVSERTEDSREFCARMLAETGVACTPGVDFDPLEGRRTLRFSYAGSAEHMAEAAKRLKAWKT

SEQ ID NO: 55062 - DNA, 1173 bp, Azotobacter vinelandii
  CDS (1)..(1173)
atggcaccgcgtgacccgatccttggcctcaccgaagcattcaatgccgatatccgtccgaccaaggtcaacctcggcgtcggcgtctactacaacgaagagggtcgaattcccctgctgcgcgccgtcgaggaagccgaaaaggctcgcatcgccgcccatgcaccgcgcggctacctgccgatcgagggcatcggtgcctacgaccaggcggtgcagaggctgctgttcggcaacgactccgccctgctcgccgacggccgtgtggtcaccgctcaggcgctgggcggcaccggcgcgctgaaggtcggcgccgacttcctcaagcgcctgctgccggatgccgtggtcgccatcagcgacccgagctgggagaaccaccgcgccctgttcgagtccgccggcttccgcgtgcagagctaccgctactacgacgccgccggccacggcctgaaccgcgccggcatgctcgaagacatccgggccctgccggccggctccatcgtgctgctgcacgcctgctgccacaacccgaccggcgtcgatctgtccatcgatgactggaagcaggtgctggaggcgatccgcgaacgcggccatgtccccttcctcgacatcgcctaccagggcttcggcgacagcatcgaggaagatgccgcggcggttcgcctgttcgccggctcggacctgcagttcttcgtctccagctccttctccaagtccttctccctctacggcgaacgggtcggcgccctgtccatcgtcgccgcctcgaaggacgaggcggctcgcgtgctgtcgcagatcaagcgggtgatccgcaccaactattcgaacccgccgacccacggcgccagcgtggtgtccagcgtgctcaacagtccggaactgcgcgccctgtgggaaagcgaactggccgagatgcgcggccgcatccagagcatgcgccaggccatggtcgagcaactggccgcccagggcgccaagcgcgacttctccttcgtcgcccggcagcgtggcatgttctcctactccggtctcagcgtcgcgcaggtggaacggctgcgcaccgagttcggcatctacgccgtcgccaccggccgcatctgcgtcgccgccctgaaccagcgcaacatcgccagcgtcacccaggccatcgctcaggtgctctga

SEQ ID NO: 55063 - protein, 390 aa, Azotobacter vinelandii
MAPRDPILGLTEAFNADIRPTKVNLGVGVYYNEEGRIPLLRAVEEAEKARIAAHAPRGYLPIEGIGAYDQAVQRLLFGNDSALLADGRVVTAQALGGTGALKVGADFLKRLLPDAVVAISDPSWENHRALFESAGFRVQSYRYYDAAGHGLNRAGMLEDIRALPAGSIVLLHACCHNPTGVDLSIDDWKQVLEAIRERGHVPFLDIAYQGFGDSIEEDAAAVRLFAGSDLQFFVSSSFSKSFSLYGERVGALSIVAASKDEAARVLSQIKRVIRTNYSNPPTHGASVVSSVLNSPELRALWESELAEMRGRIQSMRQAMVEQLAAQGAKRDFSFVARQRGMFSYSGLSVAQVERLRTEFGIYAVATGRICVAALNQRNIASVTQAIAQVL

SEQ ID NO: 55064 - DNA, 1191 bp, Haemophilus somnus 129PT
  CDS (1)..(1191)
atgttcgagaacattaatgctgcacccgctgatccaattttaggtttaggtgaggcttttaaatctgaaacacgtgccaataaaattaacttgggtattggggtctataaagatgctaatggtaacacccccattatgaaagctgttaaagaagctgaaaatcgtctatttgaattagaaaccactaaaaactatttaactattgatggtattgcagaatttaattcatacactaaagaattattatttggtacaaattctaaaattattaaacaaggacgtgctaaaacagtacaaagtttaggaggaactggtgcgttacgtattgctgccgaatttatcaaacgtcaaaccacatctcaaaacgtttggattagttcaccaacttggccaaaccataatgctattttcaacgctgtaggtatgacaatccgtgaatatcgttactacgatgcagagaaaaaagctttagattgggataatttaattgctgacttaagcaatgccagtgaaggtgatgtggtgttattacatggttgttgtcataacccaacgggtattgatccaacccctgagcaatggaaaatactagcagaaatgtcagaaaaaaatggttggttaccgctctttgattttgcctatcaaggtcttgctaacgggttagaagaagatgctattggtttgcgaacttttgcagaaaatcataaagaattattagtcgcaagttcttattccaaaaactttggtttatacaatgaacgtgttggtgcctttactttagtagcagaaacagaagaaatttcagcaatagcattaacacaagtgaaatcaattattcgtactctctactctaacccagcttctcatggtgctacagctgtttctatcattttaggtgatgacctattacgtcaacaatgggaatccgaattaaccgaaatgcgtaatcgcattaaacgtatgcgttatcaatttgttgaattgctaaaagaatatggtgccaagcaagactttaacttcattattgaacaaaatggtatgttctcttttagtggtctaaatgcagaacaggtggatcgcttaaaagaagaatttgccatttatgctgtgcgttcaggacgtattaatttagccggtgtaactgaagataatattcgttatttatgtgaaagtattgtcaaggtgctttaa

SEQ ID NO: 55065 - protein, 396 aa, Haemophilus somnus 129PT
MFENINAAPADPILGLGEAFKSETRANKINLGIGVYKDANGNTPIMKAVKEAENRLFELETTKNYLTIDGIAEFNSYTKELLFGTNSKIIKQGRAKTVQSLGGTGALRIAAEFIKRQTTSQNVWISSPTWPNHNAIFNAVGMTIREYRYYDAEKKALDWDNLIADLSNASEGDVVLLHGCCHNPTGIDPTPEQWKILAEMSEKNGWLPLFDFAYQGLANGLEEDAIGLRTFAENHKELLVASSYSKNFGLYNERVGAFTLVAETEEISAIALTQVKSIIRTLYSNPASHGATAVSIILGDDLLRQQWESELTEMRNRIKRMRYQFVELLKEYGAKQDFNFIIEQNGMFSFSGLNAEQVDRLKEEFAIYAVRSGRINLAGVTEDNIRYLCESIVKVL

SEQ ID NO: 55066 - DNA, 1197 bp, Actinobacillus pleuropneumoniae serovar 1 str. 4074
  CDS (1)..(1197)
atgtcaatgttcaaccacattcaggctgctccggcagatccgattttaggtttaggcgaagcgtttaaagcggaacaacgtgcagggaaaatcaacctcggtatcggtgtttatatgaatgcggaaggtaaaacacctatcgtgaaagcggtaaaaaaagcggaagcgttattattagaacaagaaacgaataaaaactacctcacgattgacggtgtacaagcatttaacgcttatacgcaagaacttttattcggtaaaggggcggaaattatcgcttcaggtcgtgcaaaaaccgcacaaagcttaggtggtacgggcgcattacgtattgcggcggaatttatcaaacgccaaacgtcagcaaaaaatatctggatttccaacccgacttggccgaaccacaatgcgattgccgaagcggtcggtttaaatgtcaaaggctatcgttattacaaccctgaaacacacggtttagattgggataacttgcttgccgatttaagccaagcggaagccggtgatgtggtgttattacacggttgctgtcataacccgaccggtatcgaccctacaccggaacaatgggacgcattagcgaaactttctgcggaaaaaggttggttaccgttatttgactttgcttaccaaggtttcggtaacggtttaggccaagacgcatacggcttacgtgcgtttgtgaaaaaccacaaagaattattaatcgcaagttcatactcaaaaaacttcggtttatataacgagcgtgtcggtgcatttaccttagtggcggaaaatgcggatgtggcaaataaagcattcacccaaattaaatcaattattcgtgtgctttactctaacccggcagcacacggtgcaaatgcggttgctcgtgtattaggcgatgaaacgttacgtgcggaatgggtcgcggaattagatgaaatgcgtgatcgcattaaaggtatgcgtaaccgtatggtgcaattattaaaagagaaaggagcaaaacaagatttcgattttattgcaaaacaaaacggtatgttctcatttagcggcttaacaccggaacaagtggatcgcctacgtgaagagttcgcaatttatgcggtacgttcaggtcgtatcaatgtggcaggtattaccgaccaaaatattgatgcactttgcgaagcgattgtaaaagtgctttag

SEQ ID NO: 55067 - protein, 398 aa, Actinobacillus pleuropneumoniae serovar 1 str. 4074
MSMFNHIQAAPADPILGLGEAFKAEQRAGKINLGIGVYMNAEGKTPIVKAVKKAEALLLEQETNKNYLTIDGVQAFNAYTQELLFGKGAEIIASGRAKTAQSLGGTGALRIAAEFIKRQTSAKNIWISNPTWPNHNAIAEAVGLNVKGYRYYNPETHGLDWDNLLADLSQAEAGDVVLLHGCCHNPTGIDPTPEQWDALAKLSAEKGWLPLFDFAYQGFGNGLGQDAYGLRAFVKNHKELLIASSYSKNFGLYNERVGAFTLVAENADVANKAFTQIKSIIRVLYSNPAAHGANAVARVLGDETLRAEWVAELDEMRDRIKGMRNRMVQLLKEKGAKQDFDFIAKQNGMFSFSGLTPEQVDRLREEFAIYAVRSGRINVAGITDQNIDALCEAIVKVL

SEQ ID NO: 55068 - DNA, 1182 bp, Pseudomonas aeruginosa UCBPP-PA14
  CDS (1)..(1182)
atgcgctattccgacttcacccaacgtatcgccggcgacggcgccgctgcctgggacatccactatcgcgcgctggcgcgggtcgagcagggcgaggaaatcctcctgctgtcggtcggcgaccccgacttcgataccccggcgcccatcgtccagtcggccatcgacagcctgctggccggcaacacccactacgccgacgtgcgcggcaagcgcgccctgcgccagcgcatcgccgaacgccaccgacagcgcagcggccaggcggtggacgcggagcaggtggtggtgctggccggcgcccagtgcgcgctgtacgcggtggtgcagtgcctgctgaatccgggcgacgaggtgatagtcgccgagccgatgtacgtcacctacgaagcggtgttcggcgcctgtggcgcgcgggtggtgccggtgccggtgcgctccgagaatggcttccgcgtgcaggccgaggaggtcgccgcactgatcaccccgcgcacgcgcgcgatggcgctgaacagcccgcacaacccgtccggcgccagcctgccgcgggccacctgggaagccctggccgagctgtgcacggcccatgacctgtggatgatctccgacgaggtctacagcgaactgctgttcgacggcgagcacgtcagcccggccagcctgccggggatggccgaacgtaccgcgaccctcaacagcctgtcgaaatcccacgccatgaccggctggcgggtcggctgggtggtcggtcccgcggcgctctgcgcgcacctggagaacctcgccctgtgcatgctctatggctcgccggaattcatccaggatgccgcctgcaccgcgctggaggcgccgctgccggagttggaggcgatgcgcgaggcctaccgccgccgccgcgacctggtaatcgagtgcctggccgacagccccggcctgcgtccactgcgcccggacggcggcatgttcgtgatggtcgacatccgtcccaccggactttccgcccaggccttcgccgaccgcctgctggaccgccatggcgtatcggtgctcgccggcgaagccttcggcccgagcgccgccggtcacatccgcctcggcctggtgttgggcgccgaaccgctgcgcgaagcctgtcggcgcatcgcgctgtgcgccgccgagttgctcggccaggcctga

SEQ ID NO: 55069 - protein, 393 aa, Pseudomonas aeruginosa UCBPP-PA14
MRYSDFTQRIAGDGAAAWDIHYRALARVEQGEEILLLSVGDPDFDTPAPIVQSAIDSLLAGNTHYADVRGKRALRQRIAERHRQRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCTAHDLWMISDEVYSELLFDGEHVSPASLPGMAERTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 55070 - DNA, 1248 bp, Fusobacterium nucleatum subsp. vincentii ATCC 49256
  CDS (1)..(1248)
atgctagcaaaaagatacacaggaaaaaaattagtagataatatatttgcaacaagtaaaaaagctaaacaagctattaaagaatttggaaaagaaaatgtaatcaatgcaactattggttctctttataatgaagatgaaaaattagctgtgtatgatgtagttgaaagtgtatatagaaatcttcccccagaagacctatatgcttatgctactaatgtaataggtgaagatgattatcttgaagaagttataaaagttgttttttatgatgattataaagaagcattaaaaggcttacatattgcttctattgcaacaacaggtggaacaggtgctatatctaatactgtcaaaaactatatggatacaggagataaggttctactaccaaattggatgtggggaacatacaaaaatatagttattgaaaatggtggaaaaattgaaacttatcaattatttgataaaaatggagattttaactttgaagattttaaaaataaagttttagaattagcaaaatttcaaaagaatgttgttcttataataaatgagcctagccataatccaacaggttttagaatgacttttgaagaatgggtaaatcttatggacttttttaaaagtataagagatactaatttaattgtaataagagatgtggcatattttgaatatgatgacagaggtgaagaagaaactaaaaaaattagaaagttattagttggtttacctaaaaatgtattatttatgtatgcttttagtctatcaaaatctttatctatatatggaatgagaataggagcacaaattgctgtttcatctgatgagggagttatacaagagtttgaagatgctattccattttcttgtagaacaacttggtctaatataccaaaaggtggaatgagattatttgctactattatgaaaaatcctgagttaaaagctaattttttaaatgaaaaacaaggctatatgaatttgctaaatgaaagagctaatatatttttaacagaagctaaggaagaaaatttagaaattttaccatatagaagtggtttctttgtaactgttccagtaggagaaactgtggataaagttatagaagatttagaaagtaaaaatatatttgttataaaatttgatactggtataagaataggattatgcagtgttccaaagaaaaaaataaagggacttgcaaaaaaaataaaagaatctattagtaaatttaaaaaataa

SEQ ID NO: 55071 - protein, 415 aa, Fusobacterium nucleatum subsp. vincentii ATCC 49256
MLAKRYTGKKLVDNIFATSKKAKQAIKEFGKENVINATIGSLYNEDEKLAVYDVVESVYRNLPPEDLYAYATNVIGEDDYLEEVIKVVFYDDYKEALKGLHIASIATTGGTGAISNTVKNYMDTGDKVLLPNWMWGTYKNIVIENGGKIETYQLFDKNGDFNFEDFKNKVLELAKFQKNVVLIINEPSHNPTGFRMTFEEWVNLMDFFKSIRDTNLIVIRDVAYFEYDDRGEEETKKIRKLLVGLPKNVLFMYAFSLSKSLSIYGMRIGAQIAVSSDEGVIQEFEDAIPFSCRTTWSNIPKGGMRLFATIMKNPELKANFLNEKQGYMNLLNERANIFLTEAKEENLEILPYRSGFFVTVPVGETVDKVIEDLESKNIFVIKFDTGIRIGLCSVPKKKIKGLAKKIKESISKFKK

SEQ ID NO: 55072 - DNA, 1209 bp, Dechloromonas aromatica RCB
  CDS (1)..(1209)
atgtcctcttcgatcttcgctgcggtggaaatggccccgcgcgatcctatcctgggtctgaatgaagctttcaatgctgatgcgcgcactaccaaggttaaccttggcgtcggcgtgtatttcgacgacaacggcaagattccgctgctggccgccgtcaaggccgctgaggacgtccgcgtcaaggccgcactgccgcgcggctatcagccgatcgaaggcaatccggcctacaacacggctgtccagaacctgttgctcggcaaggactccgcactgatcgccaacggccaggtcatcaccgctcaggccctcggtggcacaggcgccctgaaaattggcgccgactacctgaagcgcctgaatccaaacgccaaggtatacatcagcgacccatcctgggaaaaccatcgcgccctgttcgaatccgccggcttcgtcgtagaaaactatccgtattacgacgccgccacgcgtggcgttaacttcgagggaatgaaggcctgcctgaagggtctggatgcaggctcggtcatcatccttcacgcttgctgccacaacccgaccggcgccgatttgtcggatgcccaatggagcgaagttgtcgcaatctgccaggagcgcggtttggtacccttcctcgacatggcctaccagggctttgccgatggtatcgatgccgacgccgtcgctgttcgtgctttctccgcttccggcctgcaattcttcgcttccagctcgttctccaagaacttctcgctttatggcgagcgcgtcggcgccctgtccatcgtcacggccggcaaggaagaatctgctcgcgtcatgtcgcaggtcaagcgcgtcatccgcaccaattactccaacccgccgacccatggcggtgcgctagtggctggtgttctggcgtccgcggaactacgccagatgtgggaaaccgagctggccggcatgcgtgaccgcatccgcgccatgcgcaccggtctggtcgatgccatcaaggcacaaggcgtggcgcaggatttctccttcgttgcccagcagcgcggtatgttctcctataccggcctgacggctgcccaggtcgaacgcatgcgtgaagaattcggcatctacgccgtgtcgaccggccgtatctgcctggctgcgctgaataccaagaatctggattacgtggccaaggcgattgccgcagttaccaagccctga

SEQ ID NO: 55073 - protein, 402 aa, Dechloromonas aromatica RCB
MSSSIFAAVEMAPRDPILGLNEAFNADARTTKVNLGVGVYFDDNGKIPLLAAVKAAEDVRVKAALPRGYQPIEGNPAYNTAVQNLLLGKDSALIANGQVITAQALGGTGALKIGADYLKRLNPNAKVYISDPSWENHRALFESAGFVVENYPYYDAATRGVNFEGMKACLKGLDAGSVIILHACCHNPTGADLSDAQWSEVVAICQERGLVPFLDMAYQGFADGIDADAVAVRAFSASGLQFFASSSFSKNFSLYGERVGALSIVTAGKEESARVMSQVKRVIRTNYSNPPTHGGALVAGVLASAELRQMWETELAGMRDRIRAMRTGLVDAIKAQGVAQDFSFVAQQRGMFSYTGLTAAQVERMREEFGIYAVSTGRICLAALNTKNLDYVAKAIAAVTKP

SEQ ID NO: 55074 - DNA, 1200 bp, Ralstonia eutropha JMP134
  CDS (1)..(1200)
atgtttgcacatatcgaggcctttcctggcgacccgatcctttcgctcaacgaagacttccagaaggacccgcgcaccgacaaggtcaacctgagcatcggcatctatttcgacgacgaaggccggctgccggtcatggaagctgtcgaaaaggccgaggccgcgctgctggccgacatgggcccgcgcccctacctgccgatgtcgggcctggtggcctaccgcaatgccgtgcaggcgctggtgttcggcgaggacagcgcggcccgcgcgaccggccgcgtcgccacgctgcagacgctgggcggctcgggcgcgctgcgcgtgggtgccgattttctgaagcgctacttcccgcagtcgcaggtgtggatcagcgacccgagctgggaaaaccaccgcgtggtgttcgagcgcgcgggcttcaccgtcaacacgtatccgtactacgacgatgccaccggcggcctgaagttcgacgccatggtcgatgcgatcagcaagctgcccaagcagagcatcgtgctgctgcacgtgtgttgccacaacccgaccggcgtggacctgaaccaggaccagtggcgccagctgatcggcgtgctgaaggccaaggaactgctgccgttcgtcgatatggcctaccagggctttggcgaaggcctggacgaagacgcgttcgccatccgcgagctggaccgccagggcgtgccgtgcctggtcgcgaactcgttctcgaagaacttctcgctgtatggcgagcgttgcggcggcctgagcgtggtgtgcaacagcgcggccgaagcggccaatgtgctgggccagctgaccggtgccgtgcgcgccaactatagcaacccgccgacgcacggcgcgcgcgtggtggccaaggtgctgaccacgcccgaactgcgcacgctgtggcagcaggagctggccgcgatgtgcaaccgcatcacccgcatgcgcgaggccatccaccaccacctgcgcgaccacgtcagcggcgaagcgctgtcgcgctacctgacccagcgcggtatgttcacgtacacgggccttaccgcggagcaggccgaccgcctgcgcgaagaccacggtgtgtacctgttgcgctcgggccgcatgtgcgtcgccggtctcaatgaacgcaatgtgaccgtggtggccaaggccatcgccgcggtgctcggcggcaagtaa

SEQ ID NO: 55075 - protein, 399 aa, Ralstonia eutropha JMP134
MFAHIEAFPGDPILSLNEDFQKDPRTDKVNLSIGIYFDDEGRLPVMEAVEKAEAALLADMGPRPYLPMSGLVAYRNAVQALVFGEDSAARATGRVATLQTLGGSGALRVGADFLKRYFPQSQVWISDPSWENHRVVFERAGFTVNTYPYYDDATGGLKFDAMVDAISKLPKQSIVLLHVCCHNPTGVDLNQDQWRQLIGVLKAKELLPFVDMAYQGFGEGLDEDAFAIRELDRQGVPCLVANSFSKNFSLYGERCGGLSVVCNSAAEAANVLGQLTGAVRANYSNPPTHGARVVAKVLTTPELRTLWQQELAAMCNRITRMREAIHHHLRDHVSGEALSRYLTQRGMFTYTGLTAEQADRLREDHGVYLLRSGRMCVAGLNERNVTVVAKAIAAVLGGK

SEQ ID NO: 55076 - DNA, 1173 bp, Ralstonia eutropha JMP134
  CDS (1)..(1173)
atggccccgcgcgacccgatcctgggcctgaatgaagctttcaatgccgacacccgcgccaccaaggtgaacctgggcgttggcgtttacttcaccgacgaagggaaaattccgctgctgcgcgccgtgcaggaagcggaaaaggcgcgcctgaccaccgccacgccgcgcggctacctgccgatcgaaggcattgccgcctatgaccaggccgtgcagtcgctgctgttcggcaaggaatcgccgctgatcacggaaggccgtgttgtgacggctcaggcactgggcggtaccggcgcgctgaagatcggcgccgacttcctgaagcgcctctacccgacttcgaaggtcgcgatcagcgacccgagctgggaaaaccaccgcgcgctgttcgaagccgccggctttgaggtcgtgaactacgcctactacgacgccccgacccacggcctgaacttcgccggcatggtggaatcgctgaagtcgtatccggccaacaccatcgtcgtgctgcacgcttgctgccacaacccgaccggcgtcgacctgtcggccgaccagtggaaggaagtggtcgcgctgatcaaggaacgcaacctgatcccgttcctcgacatggcctaccagggctttgccgacggcatcgacccggacggcgcagccgtgcgcctgttcgcggattcggggctgccgttcttcgtgtcgagctcgttctcgaagagcttctcgctgtacggcgaacgcgtgggcgccctgtcgatcgtcacgaccggcaaggaagaagcgcagcgcgtgctgtcgcaggtcaagcgcgtcattcgcaccaactactcgaacccgccgacgcacggcggcaccgtggtagctaccgtgctgaacagcccggaactgcgcgccatgtgggaagaggaactggccgaaatgcgcgaccgcatcaagctgatgcgccacgcgctggtcgacaagctggccgccaagggcgtgaagacggacttttcgttcgtgaaggcgcagcgcggcatgttctcgtactcgggcctgacctcggcgcaagtcgaccgcctgcgtaacgagcatggcatctacgccgtcggcaccggccgcatctgcgtggccgcgctgaacagccgcaatatcgacgccgtcgtcgacgctatcgcggcagtgctgtaa

SEQ ID NO: 55077 - protein, 390 aa, Ralstonia eutropha JMP134
MAPRDPILGLNEAFNADTRATKVNLGVGVYFTDEGKIPLLRAVQEAEKARLTTATPRGYLPIEGIAAYDQAVQSLLFGKESPLITEGRVVTAQALGGTGALKIGADFLKRLYPTSKVAISDPSWENHRALFEAAGFEVVNYAYYDAPTHGLNFAGMVESLKSYPANTIVVLHACCHNPTGVDLSADQWKEVVALIKERNLIPFLDMAYQGFADGIDPDGAAVRLFADSGLPFFVSSSFSKSFSLYGERVGALSIVTTGKEEAQRVLSQVKRVIRTNYSNPPTHGGTVVATVLNSPELRAMWEEELAEMRDRIKLMRHALVDKLAAKGVKTDFSFVKAQRGMFSYSGLTSAQVDRLRNEHGIYAVGTGRICVAALNSRNIDAVVDAIAAVL

SEQ ID NO: 55078 - DNA, 1185 bp, Rhodobacter sphaeroides 2.4.1
  CDS (1)..(1185)
atgctgaccgccctgaagccgcagcccgcggacaagatcctgcaactgatccagatgttccgcgaggatgcgcgcgcggacaagatcgatctgggcgtgggcgtctacaaggacccgaccgggctcaccccggtcatgcgggccgtgaaggcggccgagaagcggctctgggaggtcgagaccaccaagacctacaccggccttgccgacgagccggcctacaatgccgcgatggcgaagctgatcctcgcgggcgcggtcccggccgaccgggtggcctcggtcgccacccccggcggcacgggcgcggtgcgtcaggcgctcgagctgatccgcatggcctcgcccgaggccaccgtctggatctcgaacccgacctggccgaaccatctgtcgatcgtgaaatatctcggcatcccgatgcgggaataccgctatttcgacgccgagaccggcgccgtcgatgccgagggcatgatggaggatctggcccaggtgaaggcgggcgacgtggtgctgctgcacggctgctgccacaacccgaccggcgccaacccgaacccggtgcagtggctggccatctgcgagagcctggcccggacaggcgcggtgccgctgatcgacctcgcctatcagggcttcggcgacgggctcgagatggatgcggcggcgacgcggcttctggccaccagactgcccgaggtgctgatcgcggcctcctgctcgaagaacttcggcatctaccgcgagcgcacgggcatcctgatcgccatcggcgaggcggcgggccggggcacggtgcaggccaacctcaacttcctgaaccggcagaactactccttcccgccggaccatggcgcgcggctcgtgaccatgatcctcgaggacgagacgctgagcgccgactggaaggcggaactcgaggaggtgcggctcaacatgctgacactgcgccgccagcttgccgatgcgctgcaggccgagaccggctcgaaccgcttcggcttcgtggccgagcatcgcggcatgttctcgcgcctcgggatcacgcccgccgaggtggagcggctgcggaccgagcacggggtctacatggtgggcgattcgcggctgaacatcgcggggctgaaccggacgaccgtgccggtgctggcgcgcgcggtggccaaggtgctgcgcggctga

SEQ ID NO: 55079 - protein, 394 aa, Rhodobacter sphaeroides 2.4.1
MLTALKPQPADKILQLIQMFREDARADKIDLGVGVYKDPTGLTPVMRAVKAAEKRLWEVETTKTYTGLADEPAYNAAMAKLILAGAVPADRVASVATPGGTGAVRQALELIRMASPEATVWISNPTWPNHLSIVKYLGIPMREYRYFDAETGAVDAEGMMEDLAQVKAGDVVLLHGCCHNPTGANPNPVQWLAICESLARTGAVPLIDLAYQGFGDGLEMDAAATRLLATRLPEVLIAASCSKNFGIYRERTGILIAIGEAAGRGTVQANLNFLNRQNYSFPPDHGARLVTMILEDETLSADWKAELEEVRLNMLTLRRQLADALQAETGSNRFGFVAEHRGMFSRLGITPAEVERLRTEHGVYMVGDSRLNIAGLNRTTVPVLARAVAKVLRG

SEQ ID NO: 55080 - DNA, 1203 bp, Burkholderia cepacia R18194
  CDS (1)..(1203)
atgttcgaacacatcgacgcgtacccgggcgacccgatcctgacgctcaacgagaacttccagaaagatccgcgcgaccagaaggtcaacctgagcatcggcatctacttcgacgccgaaggccggattccggtgatgggcgccgtgcgcgaagccgaaaccgcgctgcagcgcgacagcggcgcgaagccgtacctgccgatggttggcctgcccgcgtatcgcgacgccgtgcaggcgctcgtgttcggcgccgatcacccggcccgcgcggccggccgcatcgcgacgctgcagacgctcggcggctccggcgcgctgaaggtgggcgccgatttcctgaagcgctacttcccggactcgcaggtgtggctcagcgatccgagctgggaaaaccaccgcttcatcttcgagcgcgccggcttcacggtgaacacgtatccgtactacgacgaagcgacgggcggcctgaagttcgacgcgatgctcgcggcgatcgacgcgctgccggcgcgcagcatcgtgctgctgcacgcgtgctgccataacccgaccggtgtcgacctcgacgaaggccagtgggagaagctgatcgacgtgatcgaggcgcgcgggctgctgccgttcgtcgacatggcgtaccagggcttcggcgcgggcctcgacgcagatgctttcgcggtgcgcgaactggctcgccgcggcgtgccggcgctggtcgcgaactcgttctcgaagaacttctcgctgtacggcgagcgcgtgggcggcctgagcgtcgtctgcgaggatgcggccgcagccgaccgcgtgctcggccagctggccggcgccgtgcgctcgaactacagcaacccgcaaacctacggcgcgaaggtcgtggcggccgtgctcggcacgcccgcgctgcgcaagcagtgggaagaggaactggcggcgatgtgccgccgcatcgcgcggatgcgccagtcgatccatgacggcctgcgcgaccacgtcagcggcgaggcactcacgcgctatgtgaagcagcgcgggatgtttacgtacacgggcctgaccgaatcgcaggtcgacgcgctgcgcgaagtgcacggcgtgtacgtgctgcgttcgggccggatgtgcgtcgcgggcctgaacgactcgaacgtcgccatcgtcgcggatgccatcggcaaggtgctgaagagcggcgtctga

SEQ ID NO: 55081 - protein, 400 aa, Burkholderia cepacia R18194
MFEHIDAYPGDPILTLNENFQKDPRDQKVNLSIGIYFDAEGRIPVMGAVREAETALQRDSGAKPYLPMVGLPAYRDAVQALVFGADHPARAAGRIATLQTLGGSGALKVGADFLKRYFPDSQVWLSDPSWENHRFIFERAGFTVNTYPYYDEATGGLKFDAMLAAIDALPARSIVLLHACCHNPTGVDLDEGQWEKLIDVIEARGLLPFVDMAYQGFGAGLDADAFAVRELARRGVPALVANSFSKNFSLYGERVGGLSVVCEDAAAADRVLGQLAGAVRSNYSNPQTYGAKVVAAVLGTPALRKQWEEELAAMCRRIARMRQSIHDGLRDHVSGEALTRYVKQRGMFTYTGLTESQVDALREVHGVYVLRSGRMCVAGLNDSNVAIVADAIGKVLKSGV

SEQ ID NO: 55082 - DNA, 1197 bp, Burkholderia cepacia R18194
  CDS (1)..(1197)
atgaataccgccaccgattcgctcgtcagactcgccgcacgtgtcgacgcgatccagcccttctacgtgatggaattgatgaaggaggcacagcgtctcgagtcctccgggcgcgatgttatccacatgggcatcggcgagccggatttcaccgcgccggagccggtcgtcgaagcggccgcggctgcactgcgccgcggcgtcacccaatatacgagcgcgctcggcattgcgccgctgcgcgaggcgatcgccgcgcactacgcgcgcgcgtacggcctcacgatcagtccggaacggatcgtcgtgacggccggcgcgtctgccgcgctgctgctcgcgtgcctcgcgctcgtcgggcgtgacgacgaggtgctgatgcccgacccgtcgtatccgtgcaaccggcacttcgtcgcggcggccgaaggccgtgcggtgctcgtgccgagcggcccggacgcgcgcttccagctcaccgaggatgacgtccgtacgcgctggggcgaccgcacgcgcggcgtgctgctcgcgtcgccgtcgaacccgaccggcacgtcgctcgaacccgacgaactgaaacggatcgtcgaagccgtgcgcgcacgcggcggcttcacgatcgtcgacgagatctaccaggggctcagctacgacgcggcgcccgtgtcggcgctgtcgttcggcgacgacgtcgtcaccgtgaacagcttctccaagtatttcagcatgacgggctggcggctcggctggctggtcgtgccgcccgcgctggtcggcacgttcgagaagctggcgcagaacctgttcatctgcccgtccgcgctcgcgcagcacgcggcgctcgcgtgcttcgagccggccgcgctcgatatctacgaagcgcgccgcctcgaattcaagcgccgccgcgacttcatcgcaccggcgctcgagcggctcggcttcacggtgcccgtgatgccggacggcgcgttctatgtctatgcgcactgcggcggcgtcgcccacccggcagccggcgacagcgccgcactcacgacggcgatgctgcacgacgcgggcgtcgtgctggtgcccggcatggacttcggcgtccatgcgccacgcgactatatccgcctgtcctatgcgaccgcctactcgcggctcgaggaagcggtcgaccgactcgcgacgctgttcgggcagcactga

SEQ ID NO: 55083 - protein, 398 aa, Burkholderia cepacia R18194
MNTATDSLVRLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRAVLVPSGPDARFQLTEDDVRTRWGDRTRGVLLASPSNPTGTSLEPDELKRIVEAVRARGGFTIVDEIYQGLSYDAAPVSALSFGDDVVTVNSFSKYFSMTGWRLGWLVVPPALVGTFEKLAQNLFICPSALAQHAALACFEPAALDIYEARRLEFKRRRDFIAPALERLGFTVPVMPDGAFYVYAHCGGVAHPAAGDSAALTTAMLHDAGVVLVPGMDFGVHAPRDYIRLSYATAYSRLEEAVDRLATLFGQH

SEQ ID NO: 55084 - DNA, 1191 bp, Rubrivivax gelatinosus PM1
  CDS (1)..(1191)
atgtctctgtttgcatccgtcgagctcgctccgcgcgacccgatcctcggcctgaacgagcagttcaacgccgacccgaacccggccaaggtcaacctcggtgtcggcgtgtactacgacgagaacggcaagctgccgctgctgaagtgcgtggccgcggccgaacaccagatgctcgaggcgccgaaggcgcgcggctacctgccgatcgacggcatcgcggcctatgacaaggcggtgcagggcctggtgttcggcgacgccgccaccgccagcggtcgcatcgccaccgtgcagggcctgggcggcaccggcggcctgaaggtcggggccgatttcctgaagcgcctgaacccgaacgcgcaggtgctgatcagcgacccgagctgggagaaccaccgtgcgctgttcaccaacgccggcttcacggtcggcacctatccctattacgacgccgcgcagcgcggcatcgcgatcgacgggttgctcggcgcgctgaacaccgccgccgccggcacgatcgtcgtgctgcacgcctgctgccacaacccgaccggctacgacctctccgcggcgcaatgggagcaggtgatcgccgcggtgaaggcgcgcggtctggtgcccttcctcgacatggcctaccagggcttcggtcagggcatcgcggaggacggcgcagtggtgcagcagttcctggcctcgggcctggacttcttcgtctccaccagcttcagcaagagcttctcgctgtacggcgagcgcgtcggtgcgctgagcgtggtgtgcgcgagcaaggaagaggcctctcgcgtgttgagccagctgaagatcgtgatccgcaccaactactccaacccgccgacgcacggcgcctcggtggtcgccacggtgctcaccaccccggcgctgcgcgcgcagtgggagcaagaactggccggcatgcgccagcgcatcaaggccatgcgcgtcgcgctggtcgagaagctgcaggccgccggcgtgaagggtgacctgagctacatcaccacgcagcagggcatgttcagctactccgggctgaacgcggcgcagatgcagcgcctgcgcagcgagttcggcatctacggcgtcgactcgggccgcatctgcgtggcggcgctgaaccagcacaacctcgacgcggtggccaaggcgattgccgcggtgatctga

SEQ ID NO: 55085 - protein, 396 aa, Rubrivivax gelatinosus PM1
MSLFASVELAPRDPILGLNEQFNADPNPAKVNLGVGVYYDENGKLPLLKCVAAAEHQMLEAPKARGYLPIDGIAAYDKAVQGLVFGDAATASGRIATVQGLGGTGGLKVGADFLKRLNPNAQVLISDPSWENHRALFTNAGFTVGTYPYYDAAQRGIAIDGLLGALNTAAAGTIVVLHACCHNPTGYDLSAAQWEQVIAAVKARGLVPFLDMAYQGFGQGIAEDGAVVQQFLASGLDFFVSTSFSKSFSLYGERVGALSVVCASKEEASRVLSQLKIVIRTNYSNPPTHGASVVATVLTTPALRAQWEQELAGMRQRIKAMRVALVEKLQAAGVKGDLSYITTQQGMFSYSGLNAAQMQRLRSEFGIYGVDSGRICVAALNQHNLDAVAKAIAAVI

SEQ ID NO: 55086 - DNA, 1197 bp, Rubrivivax gelatinosus PM1
  CDS (1)..(1197)
atgttccagcacgtcgaagcctatcccggcgacccgatcctgagcctcaacgaagacttccagaaggatccgcgcgcgggcaaggtcaacctcagcatcggcatctacttcgacgatgccggccgcatcccggtgctgggttcggtgcagcgcgccgaggccgaactgctggcgcgcggcggcaccaagtcctacctgccgatcgagggcgctgccaatctgcgcaacgccgtgcaggccctgctgttcggcgccggccacgaggcggtgaccggccggcgcatcgcgacgatccagtcggtcggctccagcggcgggctcaaggtcggcgccgacttcctcgtgcgctacttccccggcagcgcggtctgggtcagcgatccgacctgggacaaccaccgcgcgatgttcgagggcgcaggcctgacggtgaacacctacccctactacgacccggcgacgggggggctgaagttcgacgccatgctcgccgcgctacgcgggctgccgccccggagcatcgtgctgttgcatgcctgctgccacaacccgaccggcgtcgacctgagcgccgcgcaatgggaggcgttgatcccggtgctgcgcgagcggcagctgctgccttatctggacctggcctaccagggcttcggcgacggcatcgaggccgatgcccacgcggtgcgcgcgctggcttcggccggcctgagcttcttcgtcgccaactccttcagcaagagcatgagcctgtatggggagcgggtcggcgcattgagcgtcgtctgccccgatgccgcgcaggccgacaacgtgctcgggcagctccgcgccacggtacgccgcaactattccagcccgccgatccacggcggccagctggccgcgctggtgctcggcgagccggcgctgcgggcccagtgggaaggcgagctcgccgcgatgcgcgaccgcatcctggcgatgcgccgcgcgctgcacgctgccctcaccgcccgcctgccgggtcgggacttcggctacttcctcagccagcgcggcatgttcagctacaccggcctgagcgcggcccaggtcgacctgctgcgcgaacggcatgccgtctacctggtgcgctccggccgcatgtgcgtggccgggctcaacaccggcaacgtgcagacggtcgccgaggcgatggccgcagtgctgggcggctga

SEQ ID NO: 55087 - protein, 398 aa, Rubrivivax gelatinosus PM1
MFQHVEAYPGDPILSLNEDFQKDPRAGKVNLSIGIYFDDAGRIPVLGSVQRAEAELLARGGTKSYLPIEGAANLRNAVQALLFGAGHEAVTGRRIATIQSVGSSGGLKVGADFLVRYFPGSAVWVSDPTWDNHRAMFEGAGLTVNTYPYYDPATGGLKFDAMLAALRGLPPRSIVLLHACCHNPTGVDLSAAQWEALIPVLRERQLLPYLDLAYQGFGDGIEADAHAVRALASAGLSFFVANSFSKSMSLYGERVGALSVVCPDAAQADNVLGQLRATVRRNYSSPPIHGGQLAALVLGEPALRAQWEGELAAMRDRILAMRRALHAALTARLPGRDFGYFLSQRGMFSYTGLSAAQVDLLRERHAVYLVRSGRMCVAGLNTGNVQTVAEAMAAVLGG

SEQ ID NO: 55088 - DNA, 1167 bp, Rubrivivax gelatinosus PM1
  CDS (1)..(1167)
atgcgcgagctcatccggcagctgcccggctccaagatccgcgaggtggccaatgccgggttggaccgcagcgacgtgctggcgttctggttcggcgagggcgacgaagtgacgcccggtttcgtgcgcgacgcggccgtcgcgtcgctgaagcagggcgaaaccttctactcgcacaacctgggtctgcatgaactgcgcgaagcgctggccggctatgtcggtgcgctccaccggccgctcgggccggagcggatcgccgtcacttcctcgggcgtgaacgcgctgatgatcgcgatgcaggtcctggtcggggccggcgacgaggtcgtggcggtcgtgccggtctggcccaacctgactgcgcagccggtcattctgggcgcgcaggtgactcgcgtgccgctgcggccgcagtccggcgcctggcggctggatctggacgaactgctggcggcggtcacgccacgtacccgcgtgctgctggtgaatgcgccgaacaaccccaccggttggacgctgagccgggacgagcaggcggcgatcctggcgcactgtcgtcgcaccggcacctggatcgttgccgatgaggtttacgagcggctctacttcgggggcggcgcgagggccggggggccgccggcggcgccgtccttcctcgacgtcgccgacgccgacgaccgcttgctggtggcgcacagcttttccaagagcttcctgatgaccggttggcggctcggctggctggtgctgccaccggccttgctggacgcagtgggcaagctgatcgagttcaacacctcgtgcgcgccggtcttcgtgcaacgggccggactggtggcggtggagggggcggcggcaacgctgccgagcctggtcggacacctgcgaacctgtcgcgacaccttgctgccggcgctgcaggcgctacccggcttggaggtggcggtgcccgagggcggcatgtacgccttcttccgcgtggtgggcgagacggactcgctggcgttcgcgaagcgcctcgtggccgaggctggcctgggccttgcaccgggcgcggccttcgggccggaggccgaaggctggctgcgctggtgcttcgcgtcgcgcgacccgggccgcctgacgcaaggggtcgaacgcctgcggcagggactgcggctataa

SEQ ID NO: 55089 - protein, 388 aa, Rubrivivax gelatinosus PM1
MRELIRQLPGSKIREVANAGLDRSDVLAFWFGEGDEVTPGFVRDAAVASLKQGETFYSHNLGLHELREALAGYVGALHRPLGPERIAVTSSGVNALMIAMQVLVGAGDEVVAVVPVWPNLTAQPVILGAQVTRVPLRPQSGAWRLDLDELLAAVTPRTRVLLVNAPNNPTGWTLSRDEQAAILAHCRRTGTWIVADEVYERLYFGGGARAGGPPAAPSFLDVADADDRLLVAHSFSKSFLMTGWRLGWLVLPPALLDAVGKLIEFNTSCAPVFVQRAGLVAVEGAAATLPSLVGHLRTCRDTLLPALQALPGLEVAVPEGGMYAFFRVVGETDSLAFAKRLVAEAGLGLAPGAAFGPEAEGWLRWCFASRDPGRLTQGVERLRQGLRL

SEQ ID NO: 55090 - DNA, 1194 bp, Pseudomonas fluorescens PfO-1
  CDS (1)..(1194)
atgcacttcgacgccatcggccgagtgcccggcgacccgatcctcggtctgatggaggcctacgcgcaggattccaacccgcgcaagttcgaccttggcgtgggcgtctacaaggatgcccagggcctgacgccgatccccgaggcggtgaaaatcgccgaggcgcgtctggtcgagagccaggacaccaagacctacatcggtggccacggcaatccgctgttcggcaaggtcatcaatgagctggtgcttggcgtcgattcgaagctgatcgccgagcaacgcgccggcgccacccaaacgccgggcggtactggcgccctgcgtctggcggcggacttcatcgcccaatgcctgccgggcaagggtgtatggctgagcaacccgacctggccgatccacgaaacgattttcgcggccgccggggtcaagatcagccattacccgtacgtcggcagcgacaaccgcctcgacgtcgatgcgatgctcgccgtgctcaacgaagtgccgaaaggtgatgtggtgctgctgcacgcgtgctgccacaacccgaccggtttcgacctgagccacgacgactggcagcgagtgctggaggtagtacgccgccgtgacctgctgccgctgatcgactttgcctaccagggctttggcgacggtctggagcaggatgcatggtcgacccggctgttcgccgccgagttgcccgagctgctgatcaccagctcctgctcgaagaacttcggtttatatcgcgaccgcaccggtgcgttgatcgtcagcgcgaaaaccgctgacaagctgatcgacatccgcagccagttggcgcacatcgcccgcaacctgtggtcaacgccaccggatcacggcgcggctgtggtcgccacgatcctcgccgacccggagctgaaacgccgctgggccgacgaagtggaagccatgcgtctgcgcatcgcccagttgcgcagcggactggtggaagcgctggaaccgcacggcctgcgcgagcgttttgcgcacatcggcgtgcaacgcgggatgttctcctacaccggactgtcgccggaacaggtgaagaacctgcgtgagcatcacagcgtgtacatggtcagctcgggccgggccaacgttgccgggattgatgcgacgcgtctcgacctgctggccgaagcgatcgccaacgtctgcaaatag

SEQ ID NO: 55091 - protein, 397 aa, Pseudomonas fluorescens PfO-1
MHFDAIGRVPGDPILGLMEAYAQDSNPRKFDLGVGVYKDAQGLTPIPEAVKIAEARLVESQDTKTYIGGHGNPLFGKVINELVLGVDSKLIAEQRAGATQTPGGTGALRLAADFIAQCLPGKGVWLSNPTWPIHETIFAAAGVKISHYPYVGSDNRLDVDAMLAVLNEVPKGDVVLLHACCHNPTGFDLSHDDWQRVLEVVRRRDLLPLIDFAYQGFGDGLEQDAWSTRLFAAELPELLITSSCSKNFGLYRDRTGALIVSAKTADKLIDIRSQLAHIARNLWSTPPDHGAAVVATILADPELKRRWADEVEAMRLRIAQLRSGLVEALEPHGLRERFAHIGVQRGMFSYTGLSPEQVKNLREHHSVYMVSSGRANVAGIDATRLDLLAEAIANVCK

SEQ ID NO: 55092 - DNA, 1200 bp, Burkholderia fungorum LB400
  CDS (1)..(1200)
atgtctctgttctccgccgtcgaacttgctccccgcgacccgattctgggcctgaacgaagccttcaatgccgatacgcgcaccaccaaggtcaaccttggcgtcggcgtgtacttcaatgaagaaggcaagattccgttgctgcgcgccgtgcgcgacgcagaaaaggcccgcgtcgatgccgcgctgccgcgcggctacctgccgatcgaaggcatcgccgcttacgatgccgctgtgcagaagctgctgctcggcaacgactcgccgctgatcgcggcgggccgcgtcgtgacggcgcaggcgctgggcggcacgggcgcgctgaaaattggcgcggacttcctgaagcgcctgaacccgaacgccaaggtcgcgatcagcgatccgagctgggaaaaccaccgcgcattgttcgaaggcgcaggtttcgaagtcgtgtcgtacccgtactacgacgcgcacacccacggcgtgaatttcgacgccatgctgagcgcgctgaacagctatgccgccggcacgatcgtcgtgctgcacgcgtgctgccacaacccgaccggcgtggacctcaacatcgagcaatggaagcaggttgtcgaagtggtcaaggcgcgcaatctggtgccgttcctcgacatcgcctaccagggtttcggcgacaacatcgaagcagacgcagcggccgtccgtctgttcgccgcggcggaactgaacgtgttcgtgtcgtcgtcgttctcgaagtcgttctcgctgtacggcgagcgcgtcggcgcgctgtcgatcatcacggcaagcaaggaagaagccgctcgcgtgctgtcgcaactcaagcgcgtgatccgcacgaactattcgaacccgccgacgcacggcggctcggtggtcgcggccgtgctcgcgtcgccggagctgcgcgccacgtgggaaacggaactggccgaaatgcgcgatcgcatccgcgccatgcgcaatggtctggtcgaacgcctgaaggcgagcggcgtggatcgcgacttcagcttcgtgaacgcgcagcgcggcatgttctcgtactcgggtctgacggcgccgcaggtggaccgtctgcgcgaagaattcggcatctacgccgtgagcacgggtcgcatctgcgtggccgcgctgaatacgcgcaacctcgacgcggtggccaacgcgatcgctcacgtattgaagtaa

SEQ ID NO: 55093 - protein, 399 aa, Burkholderia fungorum LB400
MSLFSAVELAPRDPILGLNEAFNADTRTTKVNLGVGVYFNEEGKIPLLRAVRDAEKARVDAALPRGYLPIEGIAAYDAAVQKLLLGNDSPLIAAGRVVTAQALGGTGALKIGADFLKRLNPNAKVAISDPSWENHRALFEGAGFEVVSYPYYDAHTHGVNFDAMLSALNSYAAGTIVVLHACCHNPTGVDLNIEQWKQVVEVVKARNLVPFLDIAYQGFGDNIEADAAAVRLFAAAELNVFVSSSFSKSFSLYGERVGALSIITASKEEAARVLSQLKRVIRTNYSNPPTHGGSVVAAVLASPELRATWETELAEMRDRIRAMRNGLVERLKASGVDRDFSFVNAQRGMFSYSGLTAPQVDRLREEFGIYAVSTGRICVAALNTRNLDAVANAIAHVLK

SEQ ID NO: 55094 - DNA, 1170 bp, Novosphingobium aromaticivorans DSM 12444
  CDS (1)..(1170)
atgctcgaaaatcttgccgcccagcccgccgacgcgctgctggcgctgatcaagcttcacaacgccgatccgcgcgaagacaagattgaccttggcgtcggtgtctatcgcacgtccgagggcgctacccctgttttcaaggcgatcaaggcggccgaggccaagctgctcgaaagccaggattccaaggcctacctcggccccgaaggcgacatgggcttcgtccacgcgctgatcccctatgtcttcggcaaggacttcgatcgttcgaaggttgagggcatgcaggcccccggcggcaccggcgcggtgcgcctcgccatcgaggtggccaagcgttcgggcgtcaagcgggtctggatgggcacgccttcgtggcccaaccacgcgcagatcatcgctgctgccggcatggagctgaagaccttcagccacatgaccgccgacggccttgccgatctcgaagcattgaagaccgccctggccggtgccgaagcgggcgatgccgtcctgctccacggttgctgccacaaccccacaggcgtcgactataccgaagcccagtgggacgagatcgccccgcttctggtcgagcgccaggtcctgccaatcctcgaccttgcctaccaggggcttggcgcgggcatggaagccgacgcctatggcctgcgcaaggtgctcagcctcgctccggaagcgctggtcgcctattcgtgcgacaagaacttcggcctctatcgtgaccgcgtcggcgctttctatgccgtcacgtccgacgccaccgccctggcaaacgccatgggcaacggcgcgacgatcgcgcgcgcctcgtggtcgatgccgcccgatcatggcgccgccgccgtccgcctgatcctcgacgatgccgagctgaccgcaatgtggctggccgagctcgacgagatgcgtgatcgcatgcgctgggttcgcgatcgccttgccgccgcgcagcacgtcggcccgatcaacatggcgccgctcggcgtgcagaacggcctgttctcgatgcttccgctcagggccgaccagattctcgccatccgcgagaagcacggcgtctacatggccggttcgggacgcatcaacattgccggcctcaccaccggtaacatcgacaagttcgtcgaagccctgcgcgacgtcgcgtaa

SEQ ID NO: 55095 - protein, 389 aa, Novosphingobium aromaticivorans DSM 12444
MLENLAAQPADALLALIKLHNADPREDKIDLGVGVYRTSEGATPVFKAIKAAEAKLLESQDSKAYLGPEGDMGFVHALIPYVFGKDFDRSKVEGMQAPGGTGAVRLAIEVAKRSGVKRVWMGTPSWPNHAQIIAAAGMELKTFSHMTADGLADLEALKTALAGAEAGDAVLLHGCCHNPTGVDYTEAQWDEIAPLLVERQVLPILDLAYQGLGAGMEADAYGLRKVLSLAPEALVAYSCDKNFGLYRDRVGAFYAVTSDATALANAMGNGATIARASWSMPPDHGAAAVRLILDDAELTAMWLAELDEMRDRMRWVRDRLAAAQHVGPINMAPLGVQNGLFSMLPLRADQILAIREKHGVYMAGSGRINIAGLTTGNIDKFVEALRDVA

SEQ ID NO: 55096 - DNA, 1194 bp, Microbulbifer degradans 2-40
  CDS (1)..(1194)
atgtttgatcgtttatcgctgttgtctgcagaccccattcttgggttaattggccaatttacggccgattcaaatcccaacaaaatcgatttgggggtgggggtatatcgagatgcccaaggtcatacgcctatattggcaacggtaaaaaaagccgaatctattttgtgggaagccgaacaaactaaatcttacattggccctgccggcaaccaacaatttaaccgcttggtgcttgagcttattctaggggatgagcacacagcattggcagacaaccgcgctatagctatgcaaacccctgggggctgtggagccttacgtgtcgctgccgagctaatagtggccgccaacccgaaagcaaaaatttgggtaagtgaccccacgtggggtaaccacgttccactgcttggtgattctggtatggagatagccacatacccatactacgactatgagagccacggtattcgctttgccgatatgctaaccacgctgcgtgagtctgcggtggccggcgaccttgtattagtgcatgcatgttgccataacccaagtggggcggacctcagtttggcccagtggttacagcttactaatttatgtgcagaaaaagggcttatcccgtttgtagatatggcctatcaaggttttggggatggtttagatcaagatgcagcgggtttgcgcatgatggccgatcagttacccgaagtgatatttgcctatagctgctctaaaaactttggtttgtatcgcgaacgaattggtgcagtaggcgttgttgccgcaaacaccgagcgcgccactgccgttgccagtcaaattatgcgcatagtgcgaggtatttattccatgcccccatcgcacggcgcggcaattgtagaaactattctcgccgaccctgtgctttgccaagcttgggtggatgagctggcgttgatgcgcaatcgcattcaaaccatgcgccaagcattattagatgcgatgaccgcgcaaggatacggcgataggtttcattttattaccggcgaaaaaggcatgttctcgtttttaggcttaacgcccgagcaggtgcagcggcttattaaagagcacagtgtttacatggtggacagcagccgcattaacgttgctgggcttacgccaacgaatatagatccgctggtgaaagccctaactgccgtgctgtag

SEQ ID NO: 55097 - protein, 397 aa, Microbulbifer degradans 2-40
MFDRLSLLSADPILGLIGQFTADSNPNKIDLGVGVYRDAQGHTPILATVKKAESILWEAEQTKSYIGPAGNQQFNRLVLELILGDEHTALADNRAIAMQTPGGCGALRVAAELIVAANPKAKIWVSDPTWGNHVPLLGDSGMEIATYPYYDYESHGIRFADMLTTLRESAVAGDLVLVHACCHNPSGADLSLAQWLQLTNLCAEKGLIPFVDMAYQGFGDGLDQDAAGLRMMADQLPEVIFAYSCSKNFGLYRERIGAVGVVAANTERATAVASQIMRIVRGIYSMPPSHGAAIVETILADPVLCQAWVDELALMRNRIQTMRQALLDAMTAQGYGDRFHFITGEKGMFSFLGLTPEQVQRLIKEHSVYMVDSSRINVAGLTPTNIDPLVKALTAVL

SEQ ID NO: 55098 - DNA, 1191 bp, Haemophilus influenzae 86-028NP
  CDS (1)..(1191)
atgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaa

SEQ ID NO: 55099 - protein, 396 aa, Haemophilus influenzae 86-028NP
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 55100 - DNA, 1191 bp, Moorella thermoacetica ATCC 39073
  CDS (1)..(1191)
atgcaacttgcccagcgggctgccggtatcagtccttcacccaccctggccattgacgcccaggccaaagccatgaaggctaaaggggtgaaggtaataaacttcagcgccggcgagcctgatttcggtacaccggagcatatcaaacaggcagccatcgacgccctggcagccggctttacccgttacacgccggtagccgggattcctgaactgcgccaggcaatatgcgccagcctggctgcccggggagtgacctatgaaccggcagatatcgtcgtctcctgcggcgccaagcattccctctataatgccatgcaggttttacttaacgctggtgatgaggtgatccttagcgccccctactgggtaagctattacgaacaggttaaactcgccggcggtgtcccggtggtagtcaccaccggccccgacaccggctttaagttgacgccagggttgctggaagcggccattaccccacggacaaggctcttaatcctcaattcgccatgtaacccaaccggcgctgtctacagccgggaggaactggcagccctggctgaagtaattgttgcccgggacctgatagtcatttccgatgaaatttatgccgccctcctctacgacggcctgacccacaccagcatcgcctccctggcgccggaggtaaaagaacggaccatcctcattgacggggtgtccaagacctacgccatgaccggctggcggattggctatgccgctgcgccgcggcccgtggccaaagccatgacggatctccagagccactcgacttccaatcccacctccatcgcccagaaggcggccgtggctgccctgaccggcagccaggaagccgtggaaatgatgcgtcgcgagtttgaacaacgccgcaaccgcatcctggcgggcctgcgggagttaccgggcatcgaatgcaaccagcccggcggcgctttctacgttttcccctatatcggcaagttgttcggccgcaaattccggggtcgggtcctgggcaactccaccgatgtcgctacagccctgctgaatgaattccaggtggcagtggtaccgggcgtcgccttcggcgccgaaccttacctgcgcctctcctatgccacctccatggaccagatcgaagccggcctggaaagactccgggcctttgtaaccgaactggaatag

SEQ ID NO: 55101 - protein, 396 aa, Moorella thermoacetica ATCC 39073
MQLAQRAAGISPSPTLAIDAQAKAMKAKGVKVINFSAGEPDFGTPEHIKQAAIDALAAGFTRYTPVAGIPELRQAICASLAARGVTYEPADIVVSCGAKHSLYNAMQVLLNAGDEVILSAPYWVSYYEQVKLAGGVPVVVTTGPDTGFKLTPGLLEAAITPRTRLLILNSPCNPTGAVYSREELAALAEVIVARDLIVISDEIYAALLYDGLTHTSIASLAPEVKERTILIDGVSKTYAMTGWRIGYAAAPRPVAKAMTDLQSHSTSNPTSIAQKAAVAALTGSQEAVEMMRREFEQRRNRILAGLRELPGIECNQPGGAFYVFPYIGKLFGRKFRGRVLGNSTDVATALLNEFQVAVVPGVAFGAEPYLRLSYATSMDQIEAGLERLRAFVTELE

SEQ ID NO: 55102 - DNA, 1185 bp, Silicibacter sp. TM1040
  CDS (1)..(1185)
atgttcgagaacctcaaaccccagcctgccgacaagattctggcgctgatgcagatgtaccgcgaagatccgcgggaccagaaggtcgatctgggtgtaggtgtctacaagaacgccgagggtgtgaccccggtgatgcgcgccgtgaaggccgcagaacagcgcatcatcgacgagcagaccaccaaggcctacaccggcctcgcgggtgatcccgcctacgccgacgcgatgatcgacctcatcctcggtacctcggtcgagcgcagcaagatcgccgccgtcgcgacccccggtggcaccggtgccgtgcgtcaggcctttgaactgatcaagatggccaaccccgaggcacgcgtttttgtgtccgaccccacctggcccaaccacgtgtcgatcctgaaatacgtcggcatcgaaaccgtggtttaccgctactttgacaccgagacccgtgccgtgaacttcgacggtatgatcgaagacctcaaaggcgccaagacaggcgacgtggttctgctgcacggctgctgccacaacccgaccggtgccaacctcaacatcagccagtggcaagccgtggtcgagctgctcaacgaacgcggcctgatcccgatgatcgacatcgcctatcagggctttggcgacggtctcgaagaagacgccgccggcgtgcgccttgtggcctcctcggtgccagaatgcctgatcgcggcgagctgctccaagaactttggcatctaccgcgagcgcaccggccttctgatggcgatcagccagaagggcgacgaagccggtctcaaccaaaagaccctcgcctatctgaaccgccagaactactccttccctcctgatcacggcgcacgcgttgtgaccacgatcctgaacgatcccgagctgcgcgcggattggcagaaagagctggaagaaacccgcctgggcatgctcgccctgcgccagcagctcgcggatgagctgcagcgcctctccgggtcggatcgctttggctttattgcagagcaccgcggcatgttctccctgctcggcaccacgcccgaactcgtcgagaaaatgcgtgtagacgcagggatttacatggtcggggacagccgtctcaatattgcggggctcaacgcccagaccgtgccgatccttgccaaggcgatcatcgacgccggcgtctga

SEQ ID NO: 55103 - protein, 394 aa, Silicibacter sp. TM1040
MFENLKPQPADKILALMQMYREDPRDQKVDLGVGVYKNAEGVTPVMRAVKAAEQRIIDEQTTKAYTGLAGDPAYADAMIDLILGTSVERSKIAAVATPGGTGAVRQAFELIKMANPEARVFVSDPTWPNHVSILKYVGIETVVYRYFDTETRAVNFDGMIEDLKGAKTGDVVLLHGCCHNPTGANLNISQWQAVVELLNERGLIPMIDIAYQGFGDGLEEDAAGVRLVASSVPECLIAASCSKNFGIYRERTGLLMAISQKGDEAGLNQKTLAYLNRQNYSFPPDHGARVVTTILNDPELRADWQKELEETRLGMLALRQQLADELQRLSGSDRFGFIAEHRGMFSLLGTTPELVEKMRVDAGIYMVGDSRLNIAGLNAQTVPILAKAIIDAGV

SEQ ID NO: 55104 - DNA, 1197 bp, Psychrobacter sp. 273-4
  CDS (1)..(1197)
atgtttgaacgtatcgattactatgccggcgacccaatcttaggattgatggacaaatttgcagcagataacaacccagataaagtcaatttgggtgtcggtgtgtactatgacgaagatggcaaaatgccagtacttgagtgtgtaaaaacagctgaacagcgtattgcagacccaatctctcctcgtccgtatttgccaatggcaggtttaccaggacatcgcaaaggctgtcaagaattgctgtttggtaaagatgctcaggttttacaagatggcttggttgctactatcgcaaccatcggcggttctggtgcattaaaagtcggcgcagaatttatccacgaatggttcccgcagtctaagtgctatgtcagtgacccaacgtggggcaaccacattgctatttttgaaggctctgacgtcgaagtcggtaaatacccatactacgacaccgctactggtggcatcaaatttgatgagatgatcgcgttttttgagacgttgaataaagatgacgttcttttgcttcacccttgctgtcacaacccaacgggcgttgatttgactcgcgagcaatgggatcaagtactaaacgtcattcaagcgcgtgagctgattccgtttatggatatcgcttatcaaggctttggtgaagatatggacagcgatgcttacgcaattcgtaaagcggttgatatgggtctgccattgtttgttagcaactcattctctaaaaacttatcgctatatggcgagcgtgtcggtggtctatcagtcgtgtgcccaacagtcgatgaaactaaccgtgtttttggtcagctaaactctatggtacgtcgtatctactcaagcccgccatcacatggtggtcgcgtggtcgatatcgtgatgaacgacgaagccttgcatgagcaatgggttggcgaagtatatgcgatgcgtgaccgtatcaaatctatgcgcaccaagctcaaatcagtattagaagaaaaaatctcaggtcgtaactttgattacttgaccgcacaaaacggcatgtttagcttcacaggtctgacgcctgaacaagttgcacagctacaaagcaagtatggtatctatatggtatcgaactcacgtatgtgtgttgccggcttaaacagcagtaatatcgactatattgccaatgccatggttgacgtcttaaaagactaa

SEQ ID NO: 55105 - protein, 398 aa, Psychrobacter sp. 273-4
MFERIDYYAGDPILGLMDKFAADNNPDKVNLGVGVYYDEDGKMPVLECVKTAEQRIADPISPRPYLPMAGLPGHRKGCQELLFGKDAQVLQDGLVATIATIGGSGALKVGAEFIHEWFPQSKCYVSDPTWGNHIAIFEGSDVEVGKYPYYDTATGGIKFDEMIAFFETLNKDDVLLLHPCCHNPTGVDLTREQWDQVLNVIQARELIPFMDIAYQGFGEDMDSDAYAIRKAVDMGLPLFVSNSFSKNLSLYGERVGGLSVVCPTVDETNRVFGQLNSMVRRIYSSPPSHGGRVVDIVMNDEALHEQWVGEVYAMRDRIKSMRTKLKSVLEEKISGRNFDYLTAQNGMFSFTGLTPEQVAQLQSKYGIYMVSNSRMCVAGLNSSNIDYIANAMVDVLKD

SEQ ID NO: 55106 - DNA, 1122 bp, Pseudomonas aeruginosa UCBPP-PA14
  CDS (1)..(1122)
atggccctgctggcgcgggccaacgagttgcaggccgccggccacgatgtgatccacctggagatcggcgagccggacttcaccacggccgagccgatcgtcgaggccgggcgcgccgccctggccgccgggcatacccgctacaccgccgcccgcggcctgccggcgctgcgcgaggcgatcgcgaaattctacggcgaacgctacggggtcgacctcgacccgcagcgcgtgctggtcactccgggcggctccggcgccctgctgctggccagcagcttgctggtcgaccccggccgccactggttgctcgccgacccgggctacccgtgcaacaggcatttcctgcgcctggtggaaggcgccgcgcaactggtgccggtggggccggacagccgttaccaactgacgccggatctcatcgagcgacactgggattcagacagtgtaggcgctctggtggcgacgccggcgaatccgaccgggaccctgctcgatcgcgacgaactggccggcctgtcgggcgccttgaaggcccgcggcgggcacctggtggtggacgagatctatcacggcctgacctatggcgtggacgccgcctcggtgctggaagtcgacgacgacgctttcgtcctgaatagtttttccaagtatttcggcatgaccggctggcgcctgggctggctggtggcgccggcagcggcggtgcctgagctggagaagctggcgcagaacctctacatcagcgcgccgagcatggcccagcaggccgcgctggcctgtttcgagccgaccaccatcgccattctcgaagagcgtcgcgaagagttcgcccgccgtcgcgacttcctcctgccggccctgcgcgagctgggtttcggaatcgccgtggagccggaaggcgccttctatctctacgccgatatcagtgcgttcggcggcgatgcctacgccttctgcaagcacttcatcgagaccgagcacgtggccttcaccccggggctggatttcggccgccaccaggccggccaccacgtgcgtttcgcctatacccagaacctgtcgcgcctgcaggaagcggtggagcggatcgcccgcggcctgaagaactggcggccctga

SEQ ID NO: 55107 - protein, 373 aa, Pseudomonas aeruginosa UCBPP-PA14
MALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPAAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLSRLQEAVERIARGLKNWRP

SEQ ID NO: 55108 - DNA, 1200 bp, Pseudomonas aeruginosa UCBPP-PA14
  CDS (1)..(1200)
atgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagacgctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgtcgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggcgcgctgatcgtctgcgcgcagaacgccgagaagctcaccgacgtgcgtagccaactggccttcctcgcccgcaacctctggtcgaccccgccggcgcatggcgccgaggtggtcgcggcgatcctcggcgacagcgagttgaagggactctggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtctccagcggccgggccaacgtcgccggtctcgacgcgcgccgcctcgaccgcctggcgcaagccatcgcccaggtctgcgcggactga

SEQ ID NO: 55109 - protein, 399 aa, Pseudomonas aeruginosa UCBPP-PA14
MSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDVRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGLDARRLDRLAQAIAQVCAD

SEQ ID NO: 55110 - DNA, 1173 bp, Polaromonas sp. JS666
  CDS (1)..(1173)
atggccccgcgcgatccgattctgggtctgaacgagcagttcaatgccgacaccaacccggccaaagtcaacctcggcgtgggcgtttattttgacgataacggcaagctgcccctgttgcaatgcgtgcaggccgctgaaaaaaccatgatggccacgccctcgccgcgtggttacctgccgattgacggaattgccgcctatgacgcggctgtcaagggcctggtgtttggcgctgacagcgaacccgtcacttccggccgcattgccaccgtccagggcattggcggcaccggtggcctgaagataggcgcagacttcctcaaacacctcaaccccaacgccaaggtgctgatcagcgacccgagctgggaaaaccaccgtgccctgttcaccaatgcaggcttcacggtcgacagctacgcctactacgatgcagccaaacgtggcgtgaactttgacggcatgctggccagcctgaacgccgccgagcccggcaccatcgtcgtgctgcacgcctgctgccacaacccgaccggctacgacatcaccgccgcccagtgggaccaggtgattgccgccgtcaaggccaaagacctcgtcgccttcctcgacatggcctaccagggctttggccatggaattgccgaagacggcgcggtcatcggcaaatttgtggctgcgggcctggacttctttgtctcgacctcgttctccaagagcttcagcctgtacggcgaacgcgtgggcgccttgagcgtgctgtgcgagagcaaggaagaagcagcccgcgtgctgagccagctcaagatcgtgatccgcaccaattattccaacccgcccatccatggcggtgcggtggtcgctgcggtgctgaacaaccccgagctgcacgccctgtgggaacaggaactgggcgagatgcgtgtgcgcatcaaggccatgcgccagaaactggtcgatggcctgaaggccgccggtgtcaagcaggacatgagctttatcaccacccagatcggcatgttcagctactcgggcctgtccaaagaccagatggtgcgcctgcgcaacgagtttggcgtgtacggcaccgacaccggccgcatgtgcgtggcggcgctgaacagcaaaaacatcgactacgtctgcgcctccatcgcgaaggtgatgtaa

SEQ ID NO: 55111 - protein, 390 aa, Polaromonas sp. JS666
MAPRDPILGLNEQFNADTNPAKVNLGVGVYFDDNGKLPLLQCVQAAEKTMMATPSPRGYLPIDGIAAYDAAVKGLVFGADSEPVTSGRIATVQGIGGTGGLKIGADFLKHLNPNAKVLISDPSWENHRALFTNAGFTVDSYAYYDAAKRGVNFDGMLASLNAAEPGTIVVLHACCHNPTGYDITAAQWDQVIAAVKAKDLVAFLDMAYQGFGHGIAEDGAVIGKFVAAGLDFFVSTSFSKSFSLYGERVGALSVLCESKEEAARVLSQLKIVIRTNYSNPPIHGGAVVAAVLNNPELHALWEQELGEMRVRIKAMRQKLVDGLKAAGVKQDMSFITTQIGMFSYSGLSKDQMVRLRNEFGVYGTDTGRMCVAALNSKNIDYVCASIAKVM

SEQ ID NO: 55112 - DNA, 1260 bp, Caenorhabditis elegans
  CDS (1)..(1260)
atgctggcattcttcagaaggttcatgtcaacgactactgtaactgctcaaccagtgctcccgtggttcagaaatgtgccgctagcgcctgctgatccaattctaggagttactgaagcattcaagaaggatacgaatccgaataagattaatttaggagttggagcatatcgtgatgatcagggaaaaccattcgtgctccgagcggtccgcgaagctgagcagcaaattatagatgctaaaatggacaaagagtactcaacaatcactggagttccagaatttgcgccattggctgcgaaactcgctttcggcgacaattccgaagtgattcgcgatggaagagtcttcacaactcaatcgatatccggaactggtgctttgagaattggaggacaatttgtggaaaagtttattccatccaagactttgttttatccaacaccaacttgggctaatcatttgccagtttttagaaattctggtctttcgattcaaccataccgttactacaatcaagaaactcttggatttgatgttgaaggagctctcgaagatatttcaaagatgccagaaggatctgttatacttttgcatgcttgtgcacataacccaactggtgttgatcctactaaggagcaatggaaaaagctgagccaagtgctgaaagaacgaaaaattcttccattcttcgatatggcttatcaaggatttgcatcaggagacgttgacgatgacgcatttgctcttcgtcatttcatagaacaaggacacaatgttctcgttgctcaatcatttgcaaaaaatatgggattgtacggagaacgtgttggtgcattttcgattgtttgtgattctgctgaagaagcgattcgtgttggatctcaaatgagaattatcattcgtccaatgatctcaatgccaccacttcatggagcaagaattgcttcacggattttgagtaatccagagttgaagaaatcttggctggaagatgtgaaactaatggctgaccgtatcaaatcaatgcgtacggctctaaaagacggcctgaaagctgaaggatctactctcaactgggatcatattaccaatcaaattggaatgttttgtttcactggaatcaatgagaaacaagttcaaaagctcatcaaagagcactcagtgtacttgacaaatgatggacgtatttctatttctggtattaatactggaaatgttgcatatttggctaaagctctccatgacgtcaccaagtaa

SEQ ID NO: 55113 - protein, 419 aa, Caenorhabditis elegans
MLAFFRRFMSTTTVTAQPVLPWFRNVPLAPADPILGVTEAFKKDTNPNKINLGVGAYRDDQGKPFVLRAVREAEQQIIDAKMDKEYSTITGVPEFAPLAAKLAFGDNSEVIRDGRVFTTQSISGTGALRIGGQFVEKFIPSKTLFYPTPTWANHLPVFRNSGLSIQPYRYYNQETLGFDVEGALEDISKMPEGSVILLHACAHNPTGVDPTKEQWKKLSQVLKERKILPFFDMAYQGFASGDVDDDAFALRHFIEQGHNVLVAQSFAKNMGLYGERVGAFSIVCDSAEEAIRVGSQMRIIIRPMISMPPLHGARIASRILSNPELKKSWLEDVKLMADRIKSMRTALKDGLKAEGSTLNWDHITNQIGMFCFTGINEKQVQKLIKEHSVYLTNDGRISISGINTGNVAYLAKALHDVTK

SEQ ID NO: 55114 - DNA, 1398 bp, Canavalia lineata
  CDS (1)..(1398)
atggcttcttcagtcctttccggggccaaccagtcttccccttcgtcgaccgttctcaacacccaccttaagggaaagcctcggctaggtgacaatgctctcagattctctggaaacaaaggaggatccaatgccttctcctcaaggtctcgaggtcgtatctccatggctgttgctgataatgtttctcggtttgaaggcatacctatggctcctcctgatccaattctcggagtttcagaggcgtttagagcagacaatagtgatgtgaagctcaatcttggagttggggcatacagaacagaagaattacagccatacgtgcttaatgttgttaaaaaggcagaaaatcttatgctggagagagggcaaaacaaagagtatgtccctattgagggtttggcagcatttaacaaggcaactgcagagttgctactcggagcagacaatccagcaatcaaacagcaaagagttgccactgtccaaggtctttcaggaactggttctctgcgactaggtgcagctgttatagaacgatattttcctggggcaaaagttttgatatcaagtcctacctggggtaatcacaagaatattttcaatgatgctagggtcccatggtccgagtaccgatattatgatcccaagacagttggtttggattttgagggcatgatagaagatataaagtcggctccggaaggtacttttgtcctacttcatggatgtgctcataaccctactggtattgatccaacacctgaacagtgggaaaaaatagctgatgtaattgaagaaaaaaaccaccggcccttttttgatgttgcttaccaggggtttgctagtggaagccttgatgaagacgcagcatccgtccgactgttagtggcacgtggcatcgaattattcattgcagactcttatccaaaagatgtgggtctttatgctcaaaggattggagcaatcaatgtcatttcctcatcaccagaatctgcagctagggatacgagccaactgaaaaggattgcacgaccaatgtactctaatccaccggttcacggggctaggattgttgccgatcttgtttcgaaaccacagctctttgatgaatggaaagctgagatggaaatgatggctggaaggataaagaatgttagacagcttctgtatgatccgatttcttcaaaagacaaaagtggaaaggattggtcattcatacttaagcagataggcatgttctcattcacaggcttgaacaaggaacagagtgacaacatgacaaataagtggcatgtactaatgacaaaggatggaaggatttccccggcaggattgtcgttggctaaatgtgaataccttgcggatgctattatcgattcatatcataatgtcagctga

SEQ ID NO: 55115 - protein, 465 aa, Canavalia lineata
MASSVLSGANQSSPSSTVLNTHLKGKPRLGDNALRFSGNKGGSNAFSSRSRGRISMAVADNVSRFEGIPMAPPDPILGVSEAFRADNSDVKLNLGVGAYRTEELQPYVLNVVKKAENLMLERGQNKEYVPIEGLAAFNKATAELLLGADNPAIKQQRVATVQGLSGTGSLRLGAAVIERYFPGAKVLISSPTWGNHKNIFNDARVPWSEYRYYDPKTVGLDFEGMIEDIKSAPEGTFVLLHGCAHNPTGIDPTPEQWEKIADVIEEKNHRPFFDVAYQGFASGSLDEDAASVRLLVARGIELFIADSYPKDVGLYAQRIGAINVISSSPESAARDTSQLKRIARPMYSNPPVHGARIVADLVSKPQLFDEWKAEMEMMAGRIKNVRQLLYDPISSKDKSGKDWSFILKQIGMFSFTGLNKEQSDNMTNKWHVLMTKDGRISPAGLSLAKCEYLADAIIDSYHNVS

SEQ ID NO: 55116 - DNA, 1374 bp, Lotus corniculatus
  CDS (1)..(1374)
atggcggcgtcttcagtgttctctgtagcttcacactctgtttcgccttcgaatcaccatgctcacaagggaaaaaccaagattggaggtagcggtttgagattggcaaattcaaggtcttttggtagtggccggatctctatggctgttgctgttaatgcttctcgatttgagggaataccgatggctccacctgatccaattctcggagtttctgaagcatttaaagcggacaaatgcgatctcaagctcaatcttggagtcggggcctacagaactgaagaattacagccatatgtgcttaatgttgttaagaaggcagagaatcttatgctgaatagaggggaaaacaaagagtatctacctattgagggttgggctgcatttaataaggcaactgcagagttgttactcggagctgacaacccagcaatcaaagaacaaagagttgccactgtccaaggtctttctggaactggttctctgcgacatgctgctgctctgatagagcgatattttccaggggcaaaagttttgatatcatcccctacctggggtaatcacaagaatattttcaatgatgctagagtcccatggtcagagtaccgatattatgatcctaagacagttggattggattttgagggcatgttagaagatataaagtcagctcctgaaggatctttcgtgctacttcatggatgtgctcataaccctaccggtattgatcccacaccagaacagtgggtgaaaatagctgatctaattcaacaaaagaaccacattccattttttgatgtcgcttaccaggggtttgctagtggaagcctggatgaagatgctgcttctgtgcgattgtttgtgtcacgtggcatggaggttctagtagctcagtcatacagtaaaaatcttggtctctatgctgaaaggattggagcaatcaatgtcatttcctcatcaccagaatctgctgcaagggtaaagagccaattgaaaaggattgccaggccaatgtactctaatccaccggttcacggggctaggattgttgctgatatagttggaaatccagatctcttcaatgaatggaaagcagagatggaaatgatggcaggaaggataaagaatgttagacagaagctatatgatagtatttcttcaaaagacaagagtggaaaggattggtcattcatacttaagcagataggcatgttctcattcacaggcttgaacaagaatcagagtgacaatatgacaaataagtggcatgtatacatgacaaaagatggaaggatttccctggcaggattgtcactggccaaatgtgaataccttgcagatgctattattgactcctatcataatgtcagctga

SEQ ID NO: 55117 - protein, 457 aa, Lotus corniculatus
MAASSVFSVASHSVSPSNHHAHKGKTKIGGSGLRLANSRSFGSGRISMAVAVNASRFEGIPMAPPDPILGVSEAFKADKCDLKLNLGVGAYRTEELQPYVLNVVKKAENLMLNRGENKEYLPIEGWAAFNKATAELLLGADNPAIKEQRVATVQGLSGTGSLRHAAALIERYFPGAKVLISSPTWGNHKNIFNDARVPWSEYRYYDPKTVGLDFEGMLEDIKSAPEGSFVLLHGCAHNPTGIDPTPEQWVKIADLIQQKNHIPFFDVAYQGFASGSLDEDAASVRLFVSRGMEVLVAQSYSKNLGLYAERIGAINVISSSPESAARVKSQLKRIARPMYSNPPVHGARIVADIVGNPDLFNEWKAEMEMMAGRIKNVRQKLYDSISSKDKSGKDWSFILKQIGMFSFTGLNKNQSDNMTNKWHVYMTKDGRISLAGLSLAKCEYLADAIIDSYHNVS

SEQ ID NO: 55118 - DNA, 1293 bp, Oryza sativa
  CDS (1)..(1293)
atggcgatgtcacgagcggccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcgggacggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaagaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctttgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtga

SEQ ID NO: 55119 - protein, 430 aa, Oryza sativa
MAMSRAAAAAAGTPVARRRLMGAVAARSMASWFGHVEPAAKDPILGVTEAFLADPSPDKVNVGVGAYRDDSGKPVVLECVREAGRRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 55120 - DNA, 1194 bp, Moraxella sp
  CDS (1)..(1194)
atgttctcagtattaaaaccattacccacagatcctattcttggccttatggcggcctataagcaagatactaaccctaataaaattgatttaggtgtgggtgtctataaagatgagctaggcaatacaccggtacttaaagcggtaaaaaaagcagaagcgtttcgtttagaaaatgaaaccagcaaatcttatattggtttagcgggtaatttagattactgtcaaaaaatggaaagcttactattaggtgagcacaaaacattactagctaaccgtgtacgtacggcgcaagcgccaggtggtactggggcattacgtgttgctgctgaatttattatgcgttgtaatccaaaagcaacagtgtgggtaactacgccaacatgggctaatcatattagcttatttgaagcagcgggcttaacagtaaaagaatacccttattacgattacgaaaataaagacttattatttgatgagatgatcaacacacttaagcaagtgcctaaaggcgatgtggttttactacatgcgtgttgtcataacccaagtggtatggatttaaacgaagcacagtggaaggtagttgctgagcttgcaaaagaagtgggctttacgccgcttgttgatattgcataccaaggttttggctcttcactagaagaagatgcacgtggtttacgtattttagctgacgcagttgaagagttaattatttgttcttcatgttctaaaaactttggtctttaccgcgaacgtattggtgcgtgttcactaattgcaaaagacagcgcaactgctgatatttcaaactcagtattacttagtgttgtacgtagtatttattcaatgccgccagcgcatggtgctgacattgtaaatacaattttaagcagcactgagcttacgcaaatgtggcatcaagagcttgatgaaatgcgtagccgtataaatggtttacgtacacaaattaaagaaacactagcgactaaagacatagcgcaagacttctcgtttattgagcgtcagcacggtatgttttctttcttaggaattaataaagagcaaattactcgcctacaaaaagagtacggcatttatattgttggctcaagtcgtgtaaacgtagcgggcgtgagtgatgcaaatattgaatactttgcaaatgcagttgccgacgtatgtaaatcataa

SEQ ID NO: 55121 - protein, 397 aa, Moraxella sp
MFSVLKPLPTDPILGLMAAYKQDTNPNKIDLGVGVYKDELGNTPVLKAVKKAEAFRLENETSKSYIGLAGNLDYCQKMESLLLGEHKTLLANRVRTAQAPGGTGALRVAAEFIMRCNPKATVWVTTPTWANHISLFEAAGLTVKEYPYYDYENKDLLFDEMINTLKQVPKGDVVLLHACCHNPSGMDLNEAQWKVVAELAKEVGFTPLVDIAYQGFGSSLEEDARGLRILADAVEELIICSSCSKNFGLYRERIGACSLIAKDSATADISNSVLLSVVRSIYSMPPAHGADIVNTILSSTELTQMWHQELDEMRSRINGLRTQIKETLATKDIAQDFSFIERQHGMFSFLGINKEQITRLQKEYGIYIVGSSRVNVAGVSDANIEYFANAVADVCKS

SEQ ID NO: 55122 - DNA, 1194 bp, Klebsiella pneumoniae
  CDS (1)..(1194)
atgtttcaaaaagttgacgcctacgccggcgaccctattctttctctgatggaacgcttcaaagaagacccgcgaagcgacaaagtcaacctgagtatcgggctgtactacaacgatgacggcattatcccgcagctgcaggcggtggcggaagcggaagcacgcctgaacgccgagccgcatggcgcctccctgtatctgccaatggaagggtttagcggctaccgtcaggcgattgcgccgctgctgtttggcgcagaacataccgcgcttaagcaaaatcgcattgcctccattcagacggtcggcggttccggcgcgttgaaggtcggggccgacttcctcaaacgttactttcctgagtctcatgtctgggtcagcgatccgacctgggaaaaccacatcgccatttttgaaggggctggcttcgaagtaagtacttacccctggtttgataaagccaccaacggcgtgcgctttgagaacctgctggcgatgctgcaaacgctgccggcccgcgatattgtgctgctgcacccttgctgccacaacccgaccggcgccgacctgacgccagcccagtgggaccgcgtggttgaggtattgaaagcgcgtcagctgatccccttcctcgacatcgcctaccagggctttggcggggggctggaagaggatgcctacgccattcgcgccatcgccagcgccgggatgccgatgttggtcagcaattcgttctccaaaattttctcgctgtacggggagcgcgtcggcggtctgtccgtggtctgtgaagacagcgaaaccgcgggccgcgtgctgggtcagctgaaggccaccgtgcgccgcaactactccagcccgccaagctttggcgcgcaggtggtggcgacggtgctgaacgatgcagctctgaaagccacctggcaggcggaggtggacgccatgcgcgcgcacatcctgaccatgcgccaggcgctggtcgacgcgctgcagcaggttgccccgggcagcaaagtggattacctgctcaagcagcgcgggatgttcagctataccggatttagcgcggcgcaggtggatcgtctgcgcgatgagtttggcgtctacctgattgccagcggacgcatgcgcgtggcggggttaaactcacgtaatgttcagcaggtagcgaaggcgtttgttgcggtgatgtaa

SEQ ID NO: 55123 - protein, 397 aa, Klebsiella pneumoniae
MFQKVDAYAGDPILSLMERFKEDPRSDKVNLSIGLYYNDDGIIPQLQAVAEAEARLNAEPHGASLYLPMEGFSGYRQAIAPLLFGAEHTALKQNRIASIQTVGGSGALKVGADFLKRYFPESHVWVSDPTWENHIAIFEGAGFEVSTYPWFDKATNGVRFENLLAMLQTLPARDIVLLHPCCHNPTGADLTPAQWDRVVEVLKARQLIPFLDIAYQGFGGGLEEDAYAIRAIASAGMPMLVSNSFSKIFSLYGERVGGLSVVCEDSETAGRVLGQLKATVRRNYSSPPSFGAQVVATVLNDAALKATWQAEVDAMRAHILTMRQALVDALQQVAPGSKVDYLLKQRGMFSYTGFSAAQVDRLRDEFGVYLIASGRMRVAGLNSRNVQQVAKAFVAVM

SEQ ID NO: 55124 - DNA, 1398 bp, Canavalia lineata
  CDS (1)..(1398)
atggcttcttcagtcctttccggggccaaccagtcttccccttcgtcgaccgttctcaacacccaccttaagggaaagcctcggctaggtgacaatgctctcagattctctggaaacaaaggaggatccaatgccttctcctcaaggtctcgaggtcgtatctccatggctgttgctgataatgtttctcggtttgaaggcatacctatggctcctcctgatccaattctcggagtttcagaggcgtttaaggcagacaatagtgatgtgaagctcaatcttggagttggggcatacagaacagaagaattacagccatacgtgcttaatgttgttaaaaaggcagaaaatcttatgctggagagagggcaaaacaaagagtatcttcctattgagggtttggcagcatttaacaaggcaactgcagagttgctactcggagcagacaatccagcaatcaaacagcaaagagttgccactgtccaaggtctttcaggactggtatctctgcgactaggtgcagctctgatagaacgatattttcctggggcaaaagttttgatatcaagtcctacctggggtaatcacaagaatattttcaatgatgctagggtcccatggtccgagtaccgatattatgatcccaagacagttggtttggattttgagggcatgatagaagatataaagtcggctccggaaggtacttttgtcctacttcatggatgtgctcataaccctactggtattgatccaacacctgaacagtgggaaaaaatagctgatgtaattgaagaaaaaaaccaccggcccttttttgatgttgcttaccaggggtttgctagtggaagccttgatgaagacgcagcatccgtccgactgttagtggcacgtggcatcgaattattcattgcacagtcttattccaaaaacctgggtctttatgctcaaaggattggagcaatcaatgtcatttcctcatcaccagaatctgcagctaggctgacgagccaactgaaaaggattgcacgaccaatgtactctaatccaccggttcacggggctaggattgttgccgatcttgttggcaatccattgctctttgaagaatggaaagctttcatggaaatgatggctggaaggataaagaatgttagacagcttctgtatgattccatttcttcaaaagacaaaagtggaaaggattggtcattcatacttaagcagataggcatgttctcattcacaggcttgaacaaggaacagagtgacaacatgacaaataagtggcatgtatacatgacaaaggatggaaggatttccctggcaggattgtcgttggctaaatgtgaataccttgcggatgctattatcgattcatatcataatgtcagctga

SEQ ID NO: 55125 - protein, 465 aa, Canavalia lineata
MASSVLSGANQSSPSSTVLNTHLKGKPRLGDNALRFSGNKGGSNAFSSRSRGRISMAVADNVSRFEGIPMAPPDPILGVSEAFKADNSDVKLNLGVGAYRTEELQPYVLNVVKKAENLMLERGQNKEYLPIEGLAAFNKATAELLLGADNPAIKQQRVATVQGLSGLVSLRLGAALIERYFPGAKVLISSPTWGNHKNIFNDARVPWSEYRYYDPKTVGLDFEGMIEDIKSAPEGTFVLLHGCAHNPTGIDPTPEQWEKIADVIEEKNHRPFFDVAYQGFASGSLDEDAASVRLLVARGIELFIAQSYSKNLGLYAQRIGAINVISSSPESAARLTSQLKRIARPMYSNPPVHGARIVADLVGNPLLFEEWKAFMEMMAGRIKNVRQLLYDSISSKDKSGKDWSFILKQIGMFSFTGLNKEQSDNMTNKWHVYMTKDGRISLAGLSLAKCEYLADAIIDSYHNVS

SEQ ID NO: 55126 - DNA, 1263 bp, Lupinus angustifolius
  CDS (1)..(1263)
atggcttccgttaatcaatccgtttccgtttctccaaccgcttcttctgattccgttttcgctcatcttcttcctgctcctgaagatcctattctcggggtgactgtggcttataacaaagatccaagcccagttaagctcaatttaggtgttggtgcttaccgaactgaggaaggaaaacctcttgttctgaatgtagtgaggcgtgttgaacagcaacttgtgaatgaagcgtcacgcaacaaggagtatcttccaattgttggggtcgccgatttcaacaaattgagtgctaggctcatttttggtgctgacagccctgctattcaagagaacagggtgaccactgttcaatgcttgtctggtactggttcattaagagttgggggtgaatttctagctagacactatcaccagaggactatatatattcctcaaccaacatggggtaatcacccaaagattttcaccttagctgggttatctgtcaaaacatatcgctattatgctccggcaacaagagggcttgactttgaaggacttctagaagatcttggttctgccccatctggatccattgttttgctacatgcatgcgcacataaccctactggtgttgatccaaccactgagcaatgggagcagattaggaagctgttgagatcaaaagctttgttacctttctttgacagtgcttatcaaggctttgctagtggaagtctagatatagatgcacaggctgttcgcttgtttgttgctgatgggggtgaattgctgcttgcccagagttatgctaagaacatgggtctatatggagaacgtgttggcgccctaagcattgtctccaagtcagctgatgttgcaagcagggttgagagccaggtgaaacttgtggttaggccaatgtactcaaaccctcccattcatggtgcatccattgtggctgccattctcagggaccgggatttgtacaatgagtggactattgagctgaaggcaatggctgatcgcattatcaaaatgcgccaacaactttttgatgctttgcaatccagaggcacacctggtgattggagtcacattatcaagcagattggaatgtttactttcacaggattgaatgctgagcaagtttccttcttaactaaggagtaccatatatacttgacatctgatgggaggattagcatggctggtctgagttccaaaacagttcctcatttggctgatgcaatacatgcagctgtaaccagagttgtctaa

SEQ ID NO: 55127 - protein, 420 aa, Lupinus angustifolius
MASVNQSVSVSPTASSDSVFAHLLPAPEDPILGVTVAYNKDPSPVKLNLGVGAYRTEEGKPLVLNVVRRVEQQLVNEASRNKEYLPIVGVADFNKLSARLIFGADSPAIQENRVTTVQCLSGTGSLRVGGEFLARHYHQRTIYIPQPTWGNHPKIFTLAGLSVKTYRYYAPATRGLDFEGLLEDLGSAPSGSIVLLHACAHNPTGVDPTTEQWEQIRKLLRSKALLPFFDSAYQGFASGSLDIDAQAVRLFVADGGELLLAQSYAKNMGLYGERVGALSIVSKSADVASRVESQVKLVVRPMYSNPPIHGASIVAAILRDRDLYNEWTIELKAMADRIIKMRQQLFDALQSRGTPGDWSHIIKQIGMFTFTGLNAEQVSFLTKEYHIYLTSDGRISMAGLSSKTVPHLADAIHAAVTRVV

SEQ ID NO: 55128 - DNA, 1368 bp, Medicago sativa
  CDS (1)..(1368)
atggcatcatcttcattactctcctctgtaccttcacactctgcttcactttcgatcctcgacaccaacatcaagggaaagcttaagcttggaatcaacaacttctccaatttaaggtcatctggtcggatctgcatggctgttgcgactaatgtttctcggtttgagggtataccgatggctcctcctgatccaattcttggagtttctgaagcatttaaagcagacacgaatgatgtcaagctcaatcttggagttggggcctacagaacggaagaactacaaccatatgtgcttaatgttgtgaaaaaggcagaaaatcttatgctggagagaggggaaaacaaagagtatctccccattgagggtttggctgcatttaacaaggcaactgcagagttgttgctcggagcagacaatccagcaatcaaacagcaaagagttgccactgtccaaggtctttcaggaactggttctctgcgactaggtgcagctctgatagaacgatattttcctggagcaaaagttttgatatcaaatcctacgtggggtaatcacaagaatattttcaacgatgctcgagtaccatggtctgagtaccgatactatgaccccaagacagttggcttggattttgagggcatgatagaagatataaagtcggctccggaaggaacttttgtgctacttcatggatgtgcacataaccctactggtattgatccaacaccagaacagtgggaaaaaatagctgatgtaattcaacaaaagaaccactttccattttttgatgttgcttaccagggttttgctagtggaagccttgatgaagatgcggcttctgtgagattgtttgagtcacgtggcatggaagttcttgtagctcagtcatacagtaaaaacctcggcctttatgctgaaagggttggagctattaatgtcatttcctcatcaccggaatctgcaacaagggtaaagagccaattgaaaaggcttgctcgaccaatgtactctaatccaccagttcacggggctaggattgttgctaatattgttgggactccagctctctttgatgaatggaaagcagaaatggaaatgatggctggaaggataaaaactgttaggcaggcgctgtatgatagtatttcttcaaaagacaaaagtggaaaggattggtcattcatactcaagcagataggcatgttctcattcacaggcttgaacaagagccagagtgacaatatgacaaataagtggcatatatacatgacaaaggatggaaggatttccctggcaggattgtccctggccaaatgtgaatacctggcagatgctattatcgattcatatcataatgtcagctga

SEQ ID NO: 55129 - protein, 455 aa, Medicago sativa
MASSSLLSSVPSHSASLSILDTNIKGKLKLGINNFSNLRSSGRICMAVATNVSRFEGIPMAPPDPILGVSEAFKADTNDVKLNLGVGAYRTEELQPYVLNVVKKAENLMLERGENKEYLPIEGLAAFNKATAELLLGADNPAIKQQRVATVQGLSGTGSLRLGAALIERYFPGAKVLISNPTWGNHKNIFNDARVPWSEYRYYDPKTVGLDFEGMIEDIKSAPEGTFVLLHGCAHNPTGIDPTPEQWEKIADVIQQKNHFPFFDVAYQGFASGSLDEDAASVRLFESRGMEVLVAQSYSKNLGLYAERVGAINVISSSPESATRVKSQLKRLARPMYSNPPVHGARIVANIVGTPALFDEWKAEMEMMAGRIKTVRQALYDSISSKDKSGKDWSFILKQIGMFSFTGLNKSQSDNMTNKWHIYMTKDGRISLAGLSLAKCEYLADAIIDSYHNVS

SEQ ID NO: 55130 - DNA, 1392 bp, Glycine max
  CDS (1)..(1392)
atggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctcaaaggattggagcaatcaatgtgatttcatcgtcaccagaatctgcagcaagggaaacgagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttcctcggcaggattgtcgttggctaaatgcgaataccttgcggatgctattattgattcatatcataatgtcagctga

SEQ ID NO: 55131 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAQRIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISSAGLSLAKCEYLADAIIDSYHNVS

SEQ ID NO: 55132 - DNA, 1230 bp, Panicum miliaceum
  CDS (1)..(1230)
atggcgtcgcaggtggcctccgtcttcgcaggcatcgcgcaggccccggaggaccccatcctcggggtgacggttgcgttcaacaaggatcccagccccgtgaagatcaacctcggcgtcggcgcctaccggaccgaggaagggaagcccctcgtgctgaatgtggtcaggcgcgccgagcagatgctgatcaatgacccgtctcgtgtgaaggagtacctaccaatcactggtttggctgaatataataagctgagcgctaagcttatcttcggtgctgacagccctgctattcaggagaatagggttgctacagtgcagtgcctatcaggaactggttctttaagagtgggaggtgaatttcttgcaaagcactaccatgagcgcactatctacatcccagtaccaacctggggaaaccacccaaaagtcttcaccctagctggattgactgtcaggagctaccgctactatgatcctgcaactcgtggtcttgacttcaacgggctcttagaagacctcagttctgctcctttaggatcaattgtactgctgcatgcttgcgcccataaccctaccggggtagatcctaccattgatcagtgggaacagattaggcagctgatgagatcaaaatcattgcttccgttctttgacagtgcttatcaaggctttgcgagtggaagtcttgacaaagatgcccagccagtgcgcatgtttattgctgatggtggtgaattgctcatggctcagagctacgctaagaacatgggaatgtatggagagcgtgttggtgctttgagcattgtatgtggaagtgctgatgtagctgctagggttgaaagtcaactcaagcttgtgattaggcctatgtattcaagccctcctcttcatggtccctctgtcgtggcaaccatactcaaggacagtgagatgttccacgaatggactgtggaactgaaggccatggctgataggataattagcatgaggcaacagctatttgatgcgctaaaatccagaggaactcctggagattggagccacatcattaagcaaattggtatgtttactttcactgggctcaatagcgagcaagtggccttcatgaggcaagaataccacatttacatgacatccgacgggaggatcagtatggctggtttgaacatgaagaatgtgccccatcttgcagatgccatacacgctgcagttactcaactgaagtga

SEQ ID NO: 55133 - protein, 409 aa, Panicum miliaceum
MASQVASVFAGIAQAPEDPILGVTVAFNKDPSPVKINLGVGAYRTEEGKPLVLNVVRRAEQMLINDPSRVKEYLPITGLAEYNKLSAKLIFGADSPAIQENRVATVQCLSGTGSLRVGGEFLAKHYHERTIYIPVPTWGNHPKVFTLAGLTVRSYRYYDPATRGLDFNGLLEDLSSAPLGSIVLLHACAHNPTGVDPTIDQWEQIRQLMRSKSLLPFFDSAYQGFASGSLDKDAQPVRMFIADGGELLMAQSYAKNMGMYGERVGALSIVCGSADVAARVESQLKLVIRPMYSSPPLHGPSVVATILKDSEMFHEWTVELKAMADRIISMRQQLFDALKSRGTPGDWSHIIKQIGMFTFTGLNSEQVAFMRQEYHIYMTSDGRISMAGLNMKNVPHLADAIHAAVTQLK

SEQ ID NO: 55134 - DNA, 1374 bp, Panicum miliaceum
  CDS (1)..(1374)
atggcttccgccgccttcgccctcacctcgccggcggcccccgccatcgccgcccggtccaaggtgcttggatgggggaagaatcaggggagaaatggctgccgcgtggggatcacgaggaagaactttggccgtgttttgatggcccttgcagtggatgtttctcgttttgagggagtgccaatggctcctccagacccaattcttggggtttcagaggcctttaaagcagataaaaatgacctgaagctcaatcttggtgttggtgcctatagaacagaagagttgcagccttatgtcctcaatgtagtcaagaaggctgaaaatcttatgttggagaaaggagaaaacaaagagtatcttcctattgaaggcttagctgcatttaacaaagcaactgcagagctactgcttggagctgacaaccctgtcatcaagcaaggactggttgctacacttcaatctctctcaggcactggatcgctacgacttgccgcagcgtttatacaaagatacttccctgaagccaaagtactcatatcatcgcccacgtgggggaaccacaagaacatcttcaatgatgctagggtaccttggtcagagtaccggtactatgaccccaaaactgttgggttagattttgagggaatgatagctgacattgaggctgctcctgaaggatcttttgttctgctacatggttgcgctcacaacccaactggaatagacccaactcctgaacaatgggagaaaattgcagatgttattcaagagaaaaagcatatgcctttcttcgatgttgcgtatcagggttttgccagtggaagccttgatgaagatgcattttcagttaggctttttgttaagcgtggcatggaagtgtttgttgcacaatcttacagcaagaaccttggtctatatgcagaaaggattggggcaataaatgttgtttgctcagcaccagaagttgcagatagggtaaagagccagctgaaacgtctggcacgtcccatgtactcgaacccccctattcacggtgctaggatagttgccaatattgttggtgatccaactatgtttggtgaatggaagcaggagatggaacaaatggcagggcggatcaagaatgtaaggcagaagctctacgatagtttgtctgcaaaggacaagagtggcaaggactggtctttcattctgagacagattggcatgttctcctacactggcttgaacaaagcacagagtgataacatgacagataaatggcatgtttatatgaccaaggatgggcggatttcgttagctggactttccctggctaagtgcgattatcttgccgacgccatcatcgattccttccacaatgtcagctag

SEQ ID NO: 55135 - protein, 457 aa, Panicum miliaceum
MASAAFALTSPAAPAIAARSKVLGWGKNQGRNGCRVGITRKNFGRVLMALAVDVSRFEGVPMAPPDPILGVSEAFKADKNDLKLNLGVGAYRTEELQPYVLNVVKKAENLMLEKGENKEYLPIEGLAAFNKATAELLLGADNPVIKQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYAERIGAINVVCSAPEVADRVKSQLKRLARPMYSNPPIHGARIVANIVGDPTMFGEWKQEMEQMAGRIKNVRQKLYDSLSAKDKSGKDWSFILRQIGMFSYTGLNKAQSDNMTDKWHVYMTKDGRISLAGLSLAKCDYLADAIIDSFHNVS

SEQ ID NO: 55136 - DNA, 1392 bp, Glycine max
  CDS (1)..(1392)
atggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggaaacgagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcaggattgtcgttggctaaatgcgaataccttgcggatgctattattgattcatatcataatgtcagctga

SEQ ID NO: 55137 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 55138 - DNA, 1284 bp, Glycine max
  CDS (1)..(1284)
atggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccaacggaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttgtgcttactgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgtcttggacgctatccatgaggttacaaaatcattctag

SEQ ID NO: 55139 - protein, 427 aa, Glycine max
MAIRNSLTGQFLRRSSVAGARLMSSSSSWFRSIEPAPKDPILGVTEAFLADQSPNKVNVGVGAYRDDQRKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLVLTAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVLDAIHEVTKSF

SEQ ID NO: 55140 - DNA, 1287 bp, Panicum miliaceum
  CDS (1)..(1287)
atggcggcgctgtcccgcgcggcctcctgcttgacccggcggccgcagatgcagccgtcgaggctgcaggcggcgagggcgatggcgtcgtcgctgttcggccacgtcgagccggcgcccaaggaccccatcctcggcgtcaccgaggcctacctcgccgacccctcgcccgacaaggtcaacgtcggcgtcggcgcctaccgggacgacaacggcaaacccctcgtgctcgactgcgtgcgcgaggccgagcgccggattgccggcaacctcaacatggagtacctcccaatgggaggcagtgtaaagatgatcgaagaatcgctgaagctggcatacggagaggattccgaactcatcaaagacaagaggatcgcggcagtgcaggcgctttcgggcactggtgcctgtcggctctttgctgatttccaaaagcgattcttgcccgattcgcaaatctatatacctacacccacgtggtccaaccatcacaatatttggagggatgctcaagtgccacagaaggcatacacatactaccatccagagtcaagagggcttgattttgcaggattaatgaatgacatcaagaatgctccagatggttcgttctttatgctccatgcatgtgctcataatcctactggagtagatcctacagaggaacaatggagagaaatatcccatcagttcaaggtgaaaaaacattttccattctttgacatggcataccaagggtttgccagcggtgatccagagagagatgctaaggcaatccgaattttccttgaagatggacaccaaattggatgtgctcagtcatacgcaaagaacatgggactttatggacagagagtaggatgcctgagtattttgtgtgaggatgagatgcaagcagttgctgtcaagagccaactgcaacagattgcaagaccaatgtacagcaacccacctgttcatggtgcacttgttgtttctataatcctcaatgatccagaattgaagagtttatggttaaaagaggtcaagggtatggctgatcgtatcattggaatgcggacggcacttaaggaaaatcttgaaaagctaggttcatctttgtcatgggagcacatcactaatcagattggaatgttctgctacagtgggatgacacctgaacaagttgaccggttgacaaatgaattccatatttacatgacccgcaacgggaggataagcatggctggtgtaacgacacgaaatgttggttacttggcaaatgctattcacgaggttaccaaatag

SEQ ID NO: 55141 - protein, 428 aa, Panicum miliaceum
MAALSRAASCLTRRPQMQPSRLQAARAMASSLFGHVEPAPKDPILGVTEAYLADPSPDKVNVGVGAYRDDNGKPLVLDCVREAERRIAGNLNMEYLPMGGSVKMIEESLKLAYGEDSELIKDKRIAAVQALSGTGACRLFADFQKRFLPDSQIYIPTPTWSNHHNIWRDAQVPQKAYTYYHPESRGLDFAGLMNDIKNAPDGSFFMLHACAHNPTGVDPTEEQWREISHQFKVKKHFPFFDMAYQGFASGDPERDAKAIRIFLEDGHQIGCAQSYAKNMGLYGQRVGCLSILCEDEMQAVAVKSQLQQIARPMYSNPPVHGALVVSIILNDPELKSLWLKEVKGMADRIIGMRTALKENLEKLGSSLSWEHITNQIGMFCYSGMTPEQVDRLTNEFHIYMTRNGRISMAGVTTRNVGYLANAIHEVTK

SEQ ID NO: 55142 - DNA, 1287 bp, Panicum miliaceum
  CDS (1)..(1287)
atggcggcgctgtcccgcgcggcctcctgcttgacccggcggccgcagatgcagccgtcgaggctccaggcggcgagggcgatggcgtcgtcgctgttcggccacgtcgagccggcgcccaaggaccctatcctcggcgtcaccgaggccttcctcgccgacccctcgcccgacaaggtcaacgtcggcgtcggcgcctaccgggacgacaacggcaagcccctcgtgctcgactgcgtgcgcgaggccgagcgccggattgccggcaacctcaacatggagtacctcccaatgggaggcagtataaagacgatcgaagaatcgctgaagctggcgtatggagaggattccgaacacatcaaagacaagaggatcgcagcagtgcaggcgctttcgggcactggtgcctgtcggctctttgctgatttccaaaagcgattcttgcccgattcgcaaatctacatacctacaccaacgtggtccaaccatcacaatatttggagggatgctcaagtgccacagaagacattcacatactaccatccggagacgagagggcttgattttgcaggattaatgaatgacatcaagaatgctccagatggttcattctttttgctccatgcatgtgctcataatcctactggagtagatcctacagaggaacaatggagagaaatatcccatcagttcaaggtgaaaaaacattttccattctttgacatggcataccaagggtttgccagcggtgatccagagagagatgctaaggcaatccgaattttccttgaagatgggcaccaaattggatgtgctcagtcgtacgcaaagaacatgggactttatggacaaagagtaggatgcctgagtattttgtgtgaggatgagatgcaagcagtttctgtcaagagccaactgcaacagattgcaagaccaatgtacagcaacccacctgttcatggtgcacttgttgtttctataatcctcagtgatccagaattaaagagtttatggttaaaagaggtcaagggtatggctgatcgtatcattggaatgcggacggcacttaaggaaaatcttgaaaagctaggttcatctttgtcatgggagcacatcactaatcagattggaatgttctgctacagtgggatgacacctgaacaagttgaccggttgaccaatgaattccatatttacatgacccgcaacgggaggataagcatggctggtgtaacgacaggaaatgttgcttacttggcaaatgctattcacgaggttaccaaataa

SEQ ID NO: 55143 - protein, 428 aa, Panicum miliaceum
MAALSRAASCLTRRPQMQPSRLQAARAMASSLFGHVEPAPKDPILGVTEAFLADPSPDKVNVGVGAYRDDNGKPLVLDCVREAERRIAGNLNMEYLPMGGSIKTIEESLKLAYGEDSEHIKDKRIAAVQALSGTGACRLFADFQKRFLPDSQIYIPTPTWSNHHNIWRDAQVPQKTFTYYHPETRGLDFAGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRVGCLSILCEDEMQAVSVKSQLQQIARPMYSNPPVHGALVVSIILSDPELKSLWLKEVKGMADRIIGMRTALKENLEKLGSSLSWEHITNQIGMFCYSGMTPEQVDRLTNEFHIYMTRNGRISMAGVTTGNVAYLANAIHEVTK

SEQ ID NO: 55144 - DNA, 1257 bp, Lotus japonicus
  CDS (1)..(1257)
atggattctcagaacatctctccttctccaaccgcctcttctggttccgtcttcgctcatctcgttcgtgctcccgaagatcctattctcggggtgactgtcgctttcaacaaagatcctagccctgttaagctcaacttgggtgttggtgcttaccgaactgaggaaggaaaacctcttgttttgaatgtggtcaggaaagctcaacaccaaatcgtgaatgatccgtcacgcaacaaggagtatcttccaattgtggggctcgctgattttaataaattgagtgccaagcttatttttggtgctgacagccctgctattcaagagaacaggattaccactgttcagtgcttgtctggtactggttcattaagagttgggggtgaatttttggctaaacactatcaccaacggattatatacttgccaaaaccaacttggggcaatcacacaaaggttttcaccttggcagggttatctgtcaaaacatatcgctactatgctccagcaacacgaggccttgactttcaaggacttctagaagatcttggttctgccccatctggatccattgttttgctacatgcatgcgctcataaccctactggtgttgatccaacccctgagcaatgggagcagattaggcagctgataagatcaaaggctttattacctttctttgacagtgcttatcagggttttgctagtggaaatctagatgcagatgcacattctgttcgttcatttgttgctgatgggggtgaattgctggcagcccagagttatgcaaagaacatgggtctttatggagaacgtgttggtgccttaagcattgtctccaagtcagctgatgttgcaagtttggttgagagtcagctgaagcttgtcatcaggcccatgtactcaaatcctccccttcatggtgcatccattgtagctacgattcttaaggaccgggatttgtacaatgagtggactattgagttgaagggaatggctgatcgtattatcagtatgcgccaacaactttttgatgctttacgttccagaggcacgcctggtgactggagtcacattatcaagagtatcggtatgttcactttcacaggattgaatcctgagcaggtttccttcatgactaaagagtaccatatatacctgacatccgatgggcggattagcatggctggtttgagttccaaaaccgtcccacatctggcggatgctatacatgcggctgtaacccgagcttcctga

SEQ ID NO: 55145 - protein, 418 aa, Lotus japonicus
MDSQNISPSPTASSGSVFAHLVRAPEDPILGVTVAFNKDPSPVKLNLGVGAYRTEEGKPLVLNVVRKAQHQIVNDPSRNKEYLPIVGLADFNKLSAKLIFGADSPAIQENRITTVQCLSGTGSLRVGGEFLAKHYHQRIIYLPKPTWGNHTKVFTLAGLSVKTYRYYAPATRGLDFQGLLEDLGSAPSGSIVLLHACAHNPTGVDPTPEQWEQIRQLIRSKALLPFFDSAYQGFASGNLDADAHSVRSFVADGGELLAAQSYAKNMGLYGERVGALSIVSKSADVASLVESQLKLVIRPMYSNPPLHGASIVATILKDRDLYNEWTIELKGMADRIISMRQQLFDALRSRGTPGDWSHIIKSIGMFTFTGLNPEQVSFMTKEYHIYLTSDGRISMAGLSSKTVPHLADAIHAAVTRAS

SEQ ID NO: 55146 - DNA, 1888 bp, Oryza sativa
  CDS (284)..(1666)
gacggcaccaccatcgaacaaagaatagcgcgcacgcattcgcctcgacgccgcatactcgcgtccacgagccccgcgagaaacagctatccacgtcatccgcggcggccgcccgccgttttcccttttccaggcgcgactcggcggccgcacccggttgcgcacgccgctcccccccccccccccccccacgccacgctcccccgcctcgtttcccccgcgcggccgcgccagaaaggggagaaacgcttcacgcgcgcggcgcaccctagcttgggccacgatgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtgacggtcgcgtacaacaaggatcccagccccgtgaaggtcaatctcggcgtcggcgcctaccggaccgaggaagggaagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtgcaatgttcaatgaatggactgtggagctgaagggcatggctgataggattattagcatgaggcaacagctttttgatgctctgaaaacgagagaaactcctggagactggagtcacatcattaagcagatcggaatgttcactttcactgggctcaacagtgatcaagtggctttcatgaggcaggaataccacatttacatgacatctgatgggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctgaggattcagacagtgatgtttgctggctgagcacatcctggaagtttccttgtaatagactcgtgtgacttgcttttgggagcagttttgtaccagtggattcagaaaaagtggtgatttcgaatcacctaataagctccatcggtgatgcttttacc

SEQ ID NO: 55147 - protein, 460 aa, Oryza sativa
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 55148 - DNA, 1290 bp, Aedes aegypti
  CDS (1)..(1290)
atggcctgctccaaaacgttccagggcacagcagtactgctgagaaactcggccgtcttcaatggctgcatcagtaaaagggccagctcatggtggggcgcggtgcagatgggtcccccggacgtgatcctcggtgtgaccgaagcctacaaaaaggacaccaacccgaagaagatcaatctgggcgtgggtgcctatcgggacgacaatggaaaaccattcgtgcttcccagcgtccgaaaagccgagcaacgcatgatggaaaaacagctggacaaggagtactcgcccattagcggaacggccgaattctgcaagcacagtattacacttgccctgggcgacgacagccaacacgtggccaacggacagaacgccaccgtgcaggccatcagtggaaccggtgccctgcgtgttggaggagccttcctgaatgggttcttcccgggtacgaaggacatttatctgccgactccatcctggggcaaccacggtccgatcttccggcattcggggctgaatgtgaaagcctacagatattacgacccaagcacctgtggattcgacttcaagggagctctggaggatctatcgaaaatcccagagcgatccatcgtccttctgcacgcctgcgctcacaacccaaccggtgttgatccccggccggagcagtgggctgaaatgtccgccgtcttcaagaaacgcaacctgttccccttcttcgacatggcctaccagggctttgccagcggagatgtcgccaaggatgcgcttgccgtccgtgccttcctgaaggatggtcaccagattgcgctggctcagagtttcgccaagaacatgggtctttacggtgaacgagccggagccttttcgttgatctgctccgacaaggaggaagccgctcgcaccatgtctcagatcaagatcctgattcgtccgatgtacagcaacccgccgattcatggcgcccgcttggtttcggaaatcttgggtgatgcaaacctgaaacaggaatggctcggcgatgtcaaactgatggccgatcgaatcatctcggtgcgcaccaaactgcaggacaatctgaaaaagttgggctcttcgcgcaactggcaacacatcaccgaacagatcggcatgttctgcttcaccggaatggatcagaagcagtgcgagcgactgaccaaggagtttagcgtgtacttgaccaaggacggccgcatctcgatggccggagtaacgaccaagaacgttgattacttggccgaggccatccatgccgtcaccaagtga

SEQ ID NO: 55149 - protein, 429 aa, Aedes aegypti
MACSKTFQGTAVLLRNSAVFNGCISKRASSWWGAVQMGPPDVILGVTEAYKKDTNPKKINLGVGAYRDDNGKPFVLPSVRKAEQRMMEKQLDKEYSPISGTAEFCKHSITLALGDDSQHVANGQNATVQAISGTGALRVGGAFLNGFFPGTKDIYLPTPSWGNHGPIFRHSGLNVKAYRYYDPSTCGFDFKGALEDLSKIPERSIVLLHACAHNPTGVDPRPEQWAEMSAVFKKRNLFPFFDMAYQGFASGDVAKDALAVRAFLKDGHQIALAQSFAKNMGLYGERAGAFSLICSDKEEAARTMSQIKILIRPMYSNPPIHGARLVSEILGDANLKQEWLGDVKLMADRIISVRTKLQDNLKKLGSSRNWQHITEQIGMFCFTGMDQKQCERLTKEFSVYLTKDGRISMAGVTTKNVDYLAEAIHAVTK

SEQ ID NO: 55150 - DNA, 1227 bp, Aedes aegypti
  CDS (1)..(1227)
atgagcatattctccggtgtcgaagttggaccccccgtggaggtgttcgcgctgaaccaggcctgcttgaaggatcctaacccgaacaaggtcaacctgggagtcggagcttaccgtacaaacgagggcaaaccatggatcctccctgtcgtgaaaaaagccgaagcggccatcgtggccgacggtagcctcaaccacgagtacctcccggtgctgggaatggaaaacgtgaccaacgctgccaccacccttctactcggtgacgactccgaagccatcaagagcaaacgtgccttcggtgtccagtgcctgtccggaacgggagccctgcgggtcggtgccgagttcctctgtcgcatcctgaagcgcaccacgttctattactcatcgcccacgtgggaaaaccaccacaaggtgttcgtgtatgccggatttgccgaaccgcgcacctatcgctactggcaccaggaccggcgcggaatcgacttcgagggcatgatcgaagacctgaagggtgcccccgagggtgcggtcatcattctgcacgcttgtgcgcacaatcccaccggagtggatcccacacaggaccagtggaagcagatcgccgatgtttgcgaggagaagaagctgttcccgttcttcgattcggcttatcagggattcgccagcggtgatcccaacaaggatgcctttgccgtgcgctactttgtggagcggggatttgagttgctctgtgcgcagagcttcgccaagaactttggattgtacaatgaacgtattggcaacctgaccatcgtacagaaggacgagtccaccaaggcggccgttgcctcacagatcacgctgctgatccgtggaatgtactcgaacccaccggcgttcggtagccgcatcgtgaacttggtgctgaacgatgccaccttgagggccgaatggatggaatgcatccagacgatgagctcgcgaatcatcaccatgcggaaggcactctacgacgaactagtggccctgaagacgcccggaacctgggagcacatcacccagcaaatcggaatgttttcgtatactggactcaatgagaaacaggtggacatcctcatcaaggagttcagcatctacctgctgaagaccggccgaatcagcatgtgcggcttgaccgagaacaacgtcaagtacgtggcgaaggcgatccatgaggcggttacgcgcgcgtcttccaaaatctag

SEQ ID NO: 55151 - protein, 408 aa, Aedes aegypti
MSIFSGVEVGPPVEVFALNQACLKDPNPNKVNLGVGAYRTNEGKPWILPVVKKAEAAIVADGSLNHEYLPVLGMENVTNAATTLLLGDDSEAIKSKRAFGVQCLSGTGALRVGAEFLCRILKRTTFYYSSPTWENHHKVFVYAGFAEPRTYRYWHQDRRGIDFEGMIEDLKGAPEGAVIILHACAHNPTGVDPTQDQWKQIADVCEEKKLFPFFDSAYQGFASGDPNKDAFAVRYFVERGFELLCAQSFAKNFGLYNERIGNLTIVQKDESTKAAVASQITLLIRGMYSNPPAFGSRIVNLVLNDATLRAEWMECIQTMSSRIITMRKALYDELVALKTPGTWEHITQQIGMFSYTGLNEKQVDILIKEFSIYLLKTGRISMCGLTENNVKYVAKAIHEAVTRASSKI

SEQ ID NO: 55152 - DNA, 1242 bp, Pongo pygmaeus
  CDS (1)..(1242)
atggcacctccgtcagtctttgccgaggttccgcaggcccagcctgtcctggtcttcaagctcactgccgacttcagggaggatccggacccccgcaaggtcaacctgggagtgggagcgtatcgcacggatgactgccatccctgggttttgccagtagtgaagaaagtggagcagaagattgctaatgacaatagcctaaatcatgagtatctgccaatcctgggcctggcggagttccggagctgtgcttctcgtcttgctcttggggatgacagcccagctctcaaggagaagcgggtaggaggtgtgcagtctttggggggaacaggtgcacttcgaattggagctgatttcttagcacgttggtacaatggaacaaacaacaagaacacacccgtctatgtgtcctcaccaacctgggagaatcacaatgctgtgttttccgctgctggttttaaagacattcggtcctatcgctactgggatgcagagaagagaggactggacctccagggcctactgaatgacctggagaacgctcctgagttctccattgttgtcctccacgcctgtgcacacaacccaactgggaccgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagttgggaatctgactgtggttggaaaagaacctgagggcatcctgcgagtcctttcccagatggagaaaattgtgcggattacttggtccgatccccctgcccagggagcacgaatcgtggccagcaccctctctaaccctgagctctttgaggaatggacaggtaatgtgaagacaatggctgaccggattctgaccatgagatctgaactcagggcacgactggaagccctcaaaacccctgggacctggaaccacatcactgatcaaattggcatgttcagcttcaccgggttgaaccccaagcaggttgagtatctgatcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 55153 - protein, 413 aa, Pongo pygmaeus
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGLLNDLENAPEFSIVVLHACAHNPTGTDPTPEQWKQIASVMKHRFLFPFFDSAYQGFASGNLERDAWAIRYFVSEGFEFFCAQSFSKNFGLYNERVGNLTVVGKEPEGILRVLSQMEKIVRITWSDPPAQGARIVASTLSNPELFEEWTGNVKTMADRILTMRSELRARLEALKTPGTWNHITDQIGMFSFTGLNPKQVEYLINEKHIYLLPSGRINVSGLTTKNLDYVATSIHEAVTKIQ

SEQ ID NO: 55154 - DNA, 1242 bp, Pongo pygmaeus
  CDS (1)..(1242)
atggcacctccgtcagtctttgccgaggttccgcaggcccagcctgtcctggtcttcaagctcactgccgacttcagggaggatccggacccccgcaaggtcaacctgggagtgggagcgtatcgcacggatgactgccatccctgggttttgccagtagtgaagaaagtggagcagaagattgctaatgacaatagcctaaatcatgagtatctgccaatcctgggcctggcggagttccggagctgtgcttctcgtcttgctcttggggatgacagcccagctctcaaggagaagcgggtaggaggtgtgcagtctttggggggaacaggtgcacttcgaattggagctgatttcttagcacgttggtacaatggaacaaacaacaagaacacacccgtctatgtgtcctcaccaacctgggagaatcacaatgctgtgttttccgctgctggttttaaagacattcggtcctatcgctactgggatgcagagaagagaggactggacctccagggcctactgaatgatctggagaacgctcctgagttctccattgttgtcctccacgcctgtgcacacaacccaactgggaccgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagttgggaatctgactgtggttggaaaagaacctgagggcatcctgcgagtcctttcccagatggagaaaattgtgcggattacttggtccaatccccctgcccagggagcacgaatcgtggccagcaccctctctaaccctgagctctttgaggaatggacaggtaatgtgaagacaatggctgaccggattctgaccatgagatctgaactcagggcacgactggaagccctcaaaacccctgggacctggaaccacatcactgatcaaattggcatgttcagcttcaccgggttgaaccccaagcaggttgagtatctgatcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 55155 - protein, 413 aa, Pongo pygmaeus
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGLLNDLENAPEFSIVVLHACAHNPTGTDPTPEQWKQIASVMKHRFLFPFFDSAYQGFASGNLERDAWAIRYFVSEGFEFFCAQSFSKNFGLYNERVGNLTVVGKEPEGILRVLSQMEKIVRITWSNPPAQGARIVASTLSNPELFEEWTGNVKTMADRILTMRSELRARLEALKTPGTWNHITDQIGMFSFTGLNPKQVEYLINEKHIYLLPSGRINVSGLTTKNLDYVATSIHEAVTKIQ

SEQ ID NO: 55156 - DNA, 1293 bp, Pongo pygmaeus
  CDS (1)..(1293)
atggccctgctgcactctggccgcgccctccccgggatcgccgccgccttccacccgggactcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccatcctggggaaaccacacacccatcttcagggatgctggcatgcagctacaaggttatcggtattatgaccccaagacttgcggttttgacttcacaggtgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggccgaccgcatcattggcatgcggactcaactggtctccaacctcaagaaggagggttccacccacaactggcaacacatcaccgaccaaattggcatgttctgtttcacagggctaaagcctgaacaggtggagcggctgatcaaggagttctccatctacatgacaaaggatggccgcatctctgtggcaggggtcacctccagcaacgtgggctaccttgcccatgccattcaccaggtcaccaagtaa

SEQ ID NO: 55157 - protein, 430 aa, Pongo pygmaeus
MALLHSGRALPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPSWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 55158 - DNA, 1293 bp, Oryza sativa
  CDS (1)..(1293)
atggcgatgtcacgagccgccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcggagcggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaagaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctttgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtga

SEQ ID NO: 55159 - protein, 430 aa, Oryza sativa
MAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 55160 - DNA, 1095 bp, uncultured marine group II euryarchaeote DeepAnt
  CDS (1)..(1095)
atgtttgacatggccggcgatgacgctgtgcaattcggtcttggcgagccggacttccaaccaccagacatcgccatcgaggcattcagcaaggcgatgaaagatggtcataacaaatacacgaccaccgcggggctaccagccctgcgcctgaagattgccgaaggctggcagcatctggttccctccctcgacgcttcgagcgtctgcatgacgatgagtggaaccaacgctctcctcgacatcttcctcgctttggtcgaccctgccgacgaggttcttctgcccgagccgtattttccactctatcctaccgatgtggtgatctgtggaggcgagcctatcctctacccctgcctctttgaacgcggtttcgtgccgacagttgaggatctggagtcgagagtgactgacaagacggtggcgatcctctacaatttccctagcaaccccacaggcgggaacgtcactaccgaggagcgggatgaattggttgatttcgctcgcagacatgatctgtgggtcatcaccgatgaggtctacgaccgaatcgtctacgataccgagcatgtatctttcatcggcgctggctatgacaaagtcatcatgatcaattcattctcgaagaccttcgccatgaccggctggagaatcggctacattctctctgagaatgccgaggcgatggagcaaattgccaagatgcagtattatgtcaccgcgtgcagcaatgatgcgatgcaatacgcggtgctcgaggccttgaacgaggcctcggattatcctgaacacatgcgtgatgaattccaggcgcgcagggatttgatttgcgatcgcttgaacgccatgcctggcgtttcctgccacattccgaccggcgctttctacgtctttccgaaggtcgaagctgctggtttgaacagcgaggaaatcgcgttggcgctgcttgaaggtggtgttttgtgcagtccaggctcggctttcggcgccgctggcgaagggcatctccgcttcgcttacacgattggacgcgaggggatttcacgcggcatggatcgagtcgagaaggtgctggccgagttgcgtggagaatga

SEQ ID NO: 55161 - protein, 364 aa, uncultured marine group II euryarchaeote DeepAnt
MFDMAGDDAVQFGLGEPDFQPPDIAIEAFSKAMKDGHNKYTTTAGLPALRLKIAEGWQHLVPSLDASSVCMTMSGTNALLDIFLALVDPADEVLLPEPYFPLYPTDVVICGGEPILYPCLFERGFVPTVEDLESRVTDKTVAILYNFPSNPTGGNVTTEERDELVDFARRHDLWVITDEVYDRIVYDTEHVSFIGAGYDKVIMINSFSKTFAMTGWRIGYILSENAEAMEQIAKMQYYVTACSNDAMQYAVLEALNEASDYPEHMRDEFQARRDLICDRLNAMPGVSCHIPTGAFYVFPKVEAAGLNSEEIALALLEGGVLCSPGSAFGAAGEGHLRFAYTIGREGISRGMDRVEKVLAELRGE

SEQ ID NO: 55162 - DNA, 1299 bp, Oryza sativa
  CDS (1)..(1299)
atggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatga

SEQ ID NO: 55163 - protein, 432 aa, Oryza sativa
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 55164 - DNA, 1242 bp, Rattus norvegicus
  CDS (1)..(1242)
atggcccctccatcattctttgcccaggttccacaggccccgccggttctggtctttaagctcattgcggacttccgggatgatcccgatccccgcaaggttaacctcggcgtgggagcgtaccgcacagatgactctcagccctgggttttgccagtagtgaggaaggtcgaacagaagattgctaacgaccacagtctcaaccacgagtacttgcccatcctgggcctggcggagttccggagctgtgcttctcagctagtacttggggacaacagcccagctctcagggagaatcgggttgggggtgtgcagtctttgggagggaccggtgcacttcgaattggagctgacttcttagggcgatggtacaatggcacagacaacaagaacacgcccgtctacgtatcatcgccgacctgggagaaccataatggcgtgttttctgccgctggttttaaagacattcggtcctatcgctactgggatgcagagaagagaggacttgatctccagggtttcctgaatgatctggagaatgctcctgagttctccatctttgtcctccacgcctgtgcacacaacccaacggggaccgacccaactgaagaggagtggaagcagatcgccgccgtcatgaagcgccgttttctgttccccttctttgactcagcctatcagggctttgcatctggagacctagagaaagatgcctgggctattcgctattttgtgtctgaaggcttcgagctcttctgtgcccagtccttctccaagaacttcgggctctacaatgagagagtggggaatctgaccgtggtcggaaaagagcatgacagcgtcctgcgggtcctttcccagatggagaagattgtacgaatcacctggtccaatccccctgcccagggagctcggatcgtggccaccaccctctccaaccctgagctctttaaggagtggaaaggaaacgtgaagacaatggctgaccggattctgaccatgagatccgaactcagggcgcgactagaagctctcaagactcccgggacttggtctcacatcactgagcagattggaatgttcagctttactgggttgaaccccaagcaggtcgagtatttggtcaacgagaagcacatctatctgatgccgagcggtcggatcaacatgtgcggcttgaccaccaagaacctagattatgtggctacctccatcaatgaagctgtcaccaaattccagtga

SEQ ID NO: 55165 - protein, 413 aa, Rattus norvegicus [sequence omitted]

SEQ ID NO: 55166 - DNA, 1260 bp, Glycine max
  CDS (1)..(1260)
atggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaa

SEQ ID NO: 55167 - protein, 419 aa, Glycine max
MASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 55168 - DNA, 1284 bp, Xenopus laevis
  CDS (1)..(1284)
atggcactgctgaagtctcggctccttgttggagtggctcgttgccagccctgcttggctgtggtacagggcagagcaagctcctggtggtctcatgttgagatgggcccacctgatccaattctgggtgtgacagaggcttttaaacgtgacactaaccccaagaagatgaacttgggtgtgggagcttatcgggatgacaatggcaaaccttatgtcctaagcagtgtgcgtaaggctgaagctcagttggcatccaaaaatctggataaggaatatctgcctattggaggcttggcagagtttgcccgggcatccgcacagttggcacttggtgaaaattgtgaagctgttaagaatggacagtttattactgtacagaccatttctggaacaggatcacttcggattggagccaactttttgcaaagattctacaagtacagccgtgatgtttacctgccaaaaccatcctggggcaatcacacaccaatattccgggatgctgggttggaggtgaagggttaccggtattacgatcccaagacttgtgggtttgattttgctggtgcactggatgacctctctaaaatcccagaacagagcatcatcttgttccatgcctgtgctcataatcctacaggtgtagatcctaagcaagagcagtggaaagagctggcagccttatgcaagagtcgacgcctcttcccattctttgacatggcttaccaaggatttgccagtggagacactgatagagatgcctgggctgtccgccacttcatccaggagggaatcaatttagtgctgtctcaatcctatgccaagaacatgggattgtatggtgaacgtgttggtgcattcactgtagtttgcagtgatgctgaggaggcaaagcgagtggagtcccagataaagattttgatccgcccaatgtattccaaccctccactgaatggagcacggatagcagcatctattttgacgcagcctgacctgcgtaaggaatggctccaggaggtcaagggaatggctaacagaataattagcatgcgagaacagctggtttccaaccttaaaaaagaaggatccatccacaactggcagcacataagtgaccagattggcatgttctgctttacaggccttcggccagagcaggtcgaacgtctcatcaaggaattctccatctacatgacgaaggatggacgtatttcggttgcaggagtaacatcagcaaataatggttaccttgctcatgctattcaccaggtgaccaaatga

SEQ ID NO: 55169 - protein, 427 aa, Xenopus laevis
MALLKSRLLVGVARCQPCLAVVQGRASSWWSHVEMGPPDPILGVTEAFKRDTNPKKMNLGVGAYRDDNGKPYVLSSVRKAEAQLASKNLDKEYLPIGGLAEFARASAQLALGENCEAVKNGQFITVQTISGTGSLRIGANFLQRFYKYSRDVYLPKPSWGNHTPIFRDAGLEVKGYRYYDPKTCGFDFAGALDDLSKIPEQSIILFHACAHNPTGVDPKQEQWKELAALCKSRRLFPFFDMAYQGFASGDTDRDAWAVRHFIQEGINLVLSQSYAKNMGLYGERVGAFTVVCSDAEEAKRVESQIKILIRPMYSNPPLNGARIAASILTQPDLRKEWLQEVKGMANRIISMREQLVSNLKKEGSIHNWQHISDQIGMFCFTGLRPEQVERLIKEFSIYMTKDGRISVAGVTSANNGYLAHAIHQVTK

SEQ ID NO: 55170 - DNA, 1251 bp, Drosophila melanogaster
  CDS (1)..(1251)
atgtccatctacgccgacgttccaaaaggacccgccatcgaggtcttcgccctgacgcaggccttcaaggacgacagcaatcccaacaaggtcaatttgtcggtgggcgcttacaggacagatgctggagttccttgggttttgcctgtggtgcgcaagacggaaatcagcattgccagcgatgagcaggttaaccacgagtatttgccagtgactggactcgaaacattcaccaatgcggccactgaattggttctgggtgccgattccccagccatcaaggagaatcgcgcctttggagtgcagaccatttcgggcacgggtgccctgcgcgttgccgccgatttcctgcacacacaactgaatcgcaatgtggtttactactcgaaccccacctgggagaatcaccacaagatcttttgcgatgccggctttacgaccgttaaatcgtaccgctactgggaccaaaataaacgcgagttggacttcaagaacatgctggccgatctgaacgatgctccgcccggtgctgtgatcattctgcacgcctgtgcccacaatcccaccggcattgatcccacccaggagcagtggactgagctggccgatctgatggagaagaagaagttgttcccgctgttcgactcggcttaccagggctttgccagtggtgatcccgatcgcgatgcctgggccgctaggtacttcgtgcagcgtggcttcgagctcttcatctgccagtcgttcgccaagaactttggcctctactgcgaacgtaccggcaatctgactgtggtgcaaaagaatggtgctaccaaggcagcggttcactctcagctgacgctgctcattcgtggacagtactcgaatccgcccgcgtatggagctcgcatcgtttccaaagtcctaaacacaccggagttgcgcaaggagtggatggcctccatccaggcaatgtcgagccgcatccgcgagatgcgtacagctttgcgggacaagctggttgccttgggcacccccggcacctgggatcacattgtcaaccagatcggcatgttctcctacaccggtctgaacgagagccatgttcgtgtgctgatcgaccagtaccacatttacctgctgaagacgggacgcatcagcatgagtggcctgaataagggcaacgttgaatatgtggccaaggcgatccatgccgctgtcaccggatcaggagaaagtgcatcatgtccttgcgaaaacaaattgtaa

SEQ ID NO: 55171 - protein, 416 aa, Drosophila melanogaster
MSIYADVPKGPAIEVFALTQAFKDDSNPNKVNLSVGAYRTDAGVPWVLPVVRKTEISIASDEQVNHEYLPVTGLETFTNAATELVLGADSPAIKENRAFGVQTISGTGALRVAADFLHTQLNRNVVYYSNPTWENHHKIFCDAGFTTVKSYRYWDQNKRELDFKNMLADLNDAPPGAVIILHACAHNPTGIDPTQEQWTELADLMEKKKLFPLFDSAYQGFASGDPDRDAWAARYFVQRGFELFICQSFAKNFGLYCERTGNLTVVQKNGATKAAVHSQLTLLIRGQYSNPPAYGARIVSKVLNTPELRKEWMASIQAMSSRIREMRTALRDKLVALGTPGTWDHIVNQIGMFSYTGLNESHVRVLIDQYHIYLLKTGRISMSGLNKGNVEYVAKAIHAAVTGSGESASCPCENKL

SEQ ID NO: 55172 - DNA, 1236 bp, Xenopus laevis
  CDS (1)..(1236)
atggcttccatcttctgctccgttcctcaggctcccccggtggctgtcttcaagcttactgcagatttccgcgccgactctgacgccaggaaggtcaaccttggagtgggagcatatcgtactgatgactcccagccatgggtcctgccagtggtgaaaaaggtagagcagatgattgcaaatgacaactctctgaaccatgaatatctgccaattttgggtctgcctgaattccgctctagtgcttccagaattgctttgggggatgacagtcctgcatttaaagaggatcgggtaggtggtgtgcaatctttgggtggaactggagcactgcgcattggagcagaatttctgaggcgctggtacaatggaaacaacaacaccgctactcccatctatatttcttctccttcatgggaaaaccacaatgctgttttcatggatgctggatttaaggacatcagagcttatcgctactgggatgctgctaaaaggggccttgatctcgagggattcctgcaggatttagagaatgcccccgagttctctatctttttgttgcatgcatgtgcgcacaatcccactggaacagaccccactcccgatgagtggagaaagatagctgatgtgatgaagaggaggtctctctttcctttctttgactctgcctaccaaggatttgcctctggcagcctagacaaggatgcatgggctgtgcgcttctttgtgtctcagggtttcgagctgttctgtgctcagtcattttccaagaactttggcttgtacaatgagagagtaggaaacctaactgtcgtaggtaaagacggtgataatgttgcacgtgtcctctctcagatggagaaaattgtccgtacaacctggtccaatcccccatctcaaggagctcgtattgttgcaaccactcttaacactcctgagctatttgatgaatggagagataatgttaagaccatggcagagagagtcctgttgatgagagcagaactgaaatcacgactggaggcgcttaaaactcccgggacatggaaccatattgtcaaccagataggaatgttcagctacacaggacttaaccctaagcaagtggagtatcttataaaagagaagcacatttacttgatggccagcggacgtataaatatgtgtgggctgacaacaaagaacattgactacgtggcccagtctatttatgaagcatcaaccaaaattcagtaa

SEQ ID NO: 55173 - protein, 411 aa, Xenopus laevis
MASIFCSVPQAPPVAVFKLTADFRADSDARKVNLGVGAYRTDDSQPWVLPVVKKVEQMIANDNSLNHEYLPILGLPEFRSSASRIALGDDSPAFKEDRVGGVQSLGGTGALRIGAEFLRRWYNGNNNTATPIYISSPSWENHNAVFMDAGFKDIRAYRYWDAAKRGLDLEGFLQDLENAPEFSIFLLHACAHNPTGTDPTPDEWRKIADVMKRRSLFPFFDSAYQGFASGSLDKDAWAVRFFVSQGFELFCAQSFSKNFGLYNERVGNLTVVGKDGDNVARVLSQMEKIVRTTWSNPPSQGARIVATTLNTPELFDEWRDNVKTMAERVLLMRAELKSRLEALKTPGTWNHIVNQIGMFSYTGLNPKQVEYLIKEKHIYLMASGRINMCGLTTKNIDYVAQSIYEASTKIQ

SEQ ID NO: 55174 - DNA, 1182 bp, Drosophila melanogaster
  CDS (1)..(1182)
atgggcccacccgatgccatcttgggtgtcacggaagccttcaagaaggacaccaaccccaagaagatcaacttgggcgctggcgcctatcgcgatgacaacacccagcccttcgtgctccccagtgttcgggaggccgagaagagagtggtgagccgtagtctggacaaggagtacgccacaatcatcggcattcccgagttctacaacaaggccatcgagctggcattgggcaagggatccaagcgtttggcggccaagcacaacgtgaccgcccagtccatcagtggaactggagctctgcgcatcggagccgccttcctggccaagttctggcagggcaaccgcgagatctacatcccgtcgccatcgtggggcaaccatgtggccattttcgagcacgccggtctgccggtgaaccgataccgctactacgacaaggacacctgtgccctggactttggcggcctgatcgaggatctgaagaaaatccccgagaagagcattgttcttctgcacgcctgcgcccacaaccccactggagtggatcccactctggagcagtggcgtgagatctcggctctggtcaagaaacgcaatctgtatcccttcatcgacatggcctaccaaggcttcgccaccggagacattgaccgcgacgcccaggcggtccgcaccttcgaggccgatggccacgacttctgcctggcccagagtttcgccaagaacatgggattgtatggtgagcgcgctggcgccttcaccgtgctgtgctccgacgaggaggaggctgctcgcgtgatgtcccaagttaagatcctgatccgtggtctgtactccaatcccccggtgcacggagctcgtattgccgccgagatcctcaacaacgaggacttgcgcgcccagtggctgaaggatgtgaagctgatggccgaccgcatcatcgatgtgcgcaccaagctcaaggacaatctaattaagctgggatccagccagaactgggaccacattgtcaaccaaatcggcatgttctgcttcacgggcctgaagccggagcaggtgcagaagctgatcaaggatcacagcgtctatctcaccaacgatggacgtgtttcgatggcgggagtcaccagcaagaatgtcgagtacctggctgagagcatacacaaggttaccaagtaa

SEQ ID NO: 55175 - protein, 393 aa, Drosophila melanogaster
MGPPDAILGVTEAFKKDTNPKKINLGAGAYRDDNTQPFVLPSVREAEKRVVSRSLDKEYATIIGIPEFYNKAIELALGKGSKRLAAKHNVTAQSISGTGALRIGAAFLAKFWQGNREIYIPSPSWGNHVAIFEHAGLPVNRYRYYDKDTCALDFGGLIEDLKKIPEKSIVLLHACAHNPTGVDPTLEQWREISALVKKRNLYPFIDMAYQGFATGDIDRDAQAVRTFEADGHDFCLAQSFAKNMGLYGERAGAFTVLCSDEEEAARVMSQVKILIRGLYSNPPVHGARIAAEILNNEDLRAQWLKDVKLMADRIIDVRTKLKDNLIKLGSSQNWDHIVNQIGMFCFTGLKPEQVQKLIKDHSVYLTNDGRVSMAGVTSKNVEYLAESIHKVTK

SEQ ID NO: 55176 - DNA, 1215 bp, Brugia malayi
  CDS (1)..(1215)
atggcgtctttcttcgggaacatcgagattgcatctcctattgaagttttttatatgaacaaaatgtatcatgaggaaccagcggagtataaagttaacttaaccgttggagcatatcgtacggaagaaggtcaaccgtgggtattaccggtggtacgtgaagcagagaaacgacttgcagatgatattagccatgaatatttaccagtgcttggctatgaaccattctgtagtgcagcagtggaactagttcttgggaagaattcatcgactatcagagctggaaaagccataggtgtgcagtgtctttccggaacgggttcactaaaagctggagccgattttctcagttttgtcatgaaaatggaaacggtttatgtttccaaacctacttggggcaatcataaattgatatttgcaagagctggttttactgatatacgtgaatattattactgggattcaacaaatcgttgtattaatatgaaaaatatgttggccgatcttgagactgcacctgagaatgctgtagtggttttgcatggttgcgctcataatccaacgggtatggatccgactcgtgaccagtggaaacagattgcagaagtttttaagaggaggcatctatttcctttcttcgatcttgcttatcaaggttttgcaagtggtgatctggacgcggatgcctgggctgtacgatattttgttgagcaaggattggagatgttttgtgcgcagtcatttgctaagaattttggcctttataatgaacgagttggtaatctgacagttgtagcatcggatccattggtactagcaagtattaaatcacagatgtcattggttattcgatctaattggtctaatcctcccagtcatggggcaagaattgtgcacatgatattaacttcgccaagtatgtgcgctcagtggcatgatgctataaagacgatgtcttcgcgcataaaggatatgcgatatgcattgcgaaacaatctggaaaaacttggtactcctggaacatgggagcatattacacagcaaattggaatgttttcatttattggtcttaatacggaacaagttgatcaccttatcaagaagtataaagtgtttctgctgaagaatggacgaataaatgtttgtggattaaatccagaaaatgttgaatacgttgcgaaagcaatcaatgaaactatcaataacataaaataa

SEQ ID NO: 55177 - protein, 404 aa, Brugia malayi
MASFFGNIEIASPIEVFYMNKMYHEEPAEYKVNLTVGAYRTEEGQPWVLPVVREAEKRLADDISHEYLPVLGYEPFCSAAVELVLGKNSSTIRAGKAIGVQCLSGTGSLKAGADFLSFVMKMETVYVSKPTWGNHKLIFARAGFTDIREYYYWDSTNRCINMKNMLADLETAPENAVVVLHGCAHNPTGMDPTRDQWKQIAEVFKRRHLFPFFDLAYQGFASGDLDADAWAVRYFVEQGLEMFCAQSFAKNFGLYNERVGNLTVVASDPLVLASIKSQMSLVIRSNWSNPPSHGARIVHMILTSPSMCAQWHDAIKTMSSRIKDMRYALRNNLEKLGTPGTWEHITQQIGMFSFIGLNTEQVDHLIKKYKVFLLKNGRINVCGLNPENVEYVAKAINETINNIK

SEQ ID NO: 55178 - DNA, 1284 bp, Giardia lamblia
  CDS (1)..(1284)
atgtctgtcttctcagggtttcctgcttccccaccagatgctatcctgaatctcacggtactctacaacgccgatacctacccgaaaaaggtgaacctgggggttggcgcgtatcgtgacgagagcggtaaaccatggattctgccggccgtgaaggaggcagaggccattatatcttccgatctttcgaagtataataaggagtatcctccagtcgccggatttcctctgtttctggaggccgcccagttcctgatgttcggcaaggacagcaaggcagcccaggagggtcgcattgctagctgccagtctctctctggcaccggctctctccacatcgggtttgagttcctgcacctctggatgccaaaggcagagttttacatgccgagcacaacgtggcccaaccactacggaatatacgataaggtgttcaacaaattgaaggtgccatacaaggagtatacgtatcttcgtaaagacggagagcttgagatagacttttccaacacgaagaaggacatccagtcggctccagagaaaagcatattcctgttccacgcctgtgcccacaacccgtctgggatcgacttcactgaggctcagtggaaggagctccttccgatcatgaaggagaagaagcacattgccttttttgattcagcataccagggctttgctacgggctcctttgaggccgacgccttcgctgtgcgcatgtttgtcgatgcgggggtagaggtccttgtcgcccagagcttctccaagaacttcgggctctatggagagcgtatcggctgcctacatgttgtccatgcaggagtggaggggtccgtcgagaagaacaaggcgctttctgctgctatggtgagtggaatgactctccagatccgtaagacgtggtccatgtctgcgatccacggggcctatatcgtccaagtcatcgttcacgacaagcgccttctgcagatgttttatgacaatgtcaaggagatgagtgctcgcattcaccgaatgcgtagtctcctgcatgcctcccttgcgaagcgcaagactccaggccccggttccaaagggacctgggaccatatactgacagccatcggcatgttcactttcaccgggctcaccccagagcacgttgattatctgaaggagaagtggagtatctatcttgtgaaggcagggggacgcatgagtatgtgcgggctcactgagtctaattgtgactatgtggctgaggcgattcacgacgccgtcacgaagctcccgttcaagaaatga

SEQ ID NO: 55179 - protein, 427 aa, Giardia lamblia
MSVFSGFPASPPDAILNLTVLYNADTYPKKVNLGVGAYRDESGKPWILPAVKEAEAIISSDLSKYNKEYPPVAGFPLFLEAAQFLMFGKDSKAAQEGRIASCQSLSGTGSLHIGFEFLHLWMPKAEFYMPSTTWPNHYGIYDKVFNKLKVPYKEYTYLRKDGELEIDFSNTKKDIQSAPEKSIFLFHACAHNPSGIDFTEAQWKELLPIMKEKKHIAFFDSAYQGFATGSFEADAFAVRMFVDAGVEVLVAQSFSKNFGLYGERIGCLHVVHAGVEGSVEKNKALSAAMVSGMTLQIRKTWSMSAIHGAYIVQVIVHDKRLLQMFYDNVKEMSARIHRMRSLLHASLAKRKTPGPGSKGTWDHILTAIGMFTFTGLTPEHVDYLKEKWSIYLVKAGGRMSMCGLTESNCDYVAEAIHDAVTKLPFKK

SEQ ID NO: 55180 - DNA, 1173 bp, Trypanosoma brucei
  CDS (1)..(1173)
atggggaaaccggatcccatcctcggcctcgggcaggattttcgtatggatcccgccaaaaggaaggtgaatttgtctattggtgtgtaccgcgacgacgccgaccagccttttgtgctggaatgtgtgaaacaagccacattaggcaccaacatggactacgccccagtcacaggaattgcaagttttgtagaggaggctcaaaaactgtgttttggcccaacgtgtgcggcgcttcgggatggacgcattgcaagttgccaaacgcttggcggcacaggtgcgcttcggattggtggtgaccttctcaatcgctttgtggccaattgtaaccgcatttacggtcctgacgtcggttatccgaatcatgagagtatctttgctaaggcgggaatggaacttaccccatattcgtactatgatcctgccacaaaaggttttaaccttgcgggtatgctcgagtgcctagaccaagggcgcctgaggggctctgttaaaactcgttcaatgccagcgcaacacaatccaactggcgtcgatccaacacacgatgactggcgacaggtgtgcgatgtgataaagaggcgtaaccatattccgttcgtagacatggcttacccaagttttgctactggtcaattggattatgatgccttcgtgccacgccacctggtggatatggtgccaaacctgattgttgcgcagagtttctccaagaactttggcctgtacgggcatcgctgtggtgctcttcacctctcaacggcgagtgctgaagaggcgaagcgtttggtctcacaattggccctactgattcggcccatgtatagcaatccgcctctttatggtgcctgggtcgtaagttctattctaaaggacccgcagctgactgcactctggaagaaggaattgaagcaaatgtcatctcgcattgctgaggtgcgcaagcgtttggtttcagagctgaaagcatgcggctccgtccatgactggtctcacattgagcgccaagttggtatgatggcatacacaggcctaacaagggagcaggtggagttactgaggagcgagtaccacatatacatgacattaaatggtcgcgctgcggtgtccggacttaacagcacaaatgttgaatatgtttcacaagctattcacaacgttactaaatga

SEQ ID NO: 55181 - protein, 390 aa, Trypanosoma brucei
MGKPDPILGLGQDFRMDPAKRKVNLSIGVYRDDADQPFVLECVKQATLGTNMDYAPVTGIASFVEEAQKLCFGPTCAALRDGRIASCQTLGGTGALRIGGDLLNRFVANCNRIYGPDVGYPNHESIFAKAGMELTPYSYYDPATKGFNLAGMLECLDQGRLRGSVKTRSMPAQHNPTGVDPTHDDWRQVCDVIKRRNHIPFVDMAYPSFATGQLDYDAFVPRHLVDMVPNLIVAQSFSKNFGLYGHRCGALHLSTASAEEAKRLVSQLALLIRPMYSNPPLYGAWVVSSILKDPQLTALWKKELKQMSSRIAEVRKRLVSELKACGSVHDWSHIERQVGMMAYTGLTREQVELLRSEYHIYMTLNGRAAVSGLNSTNVEYVSQAIHNVTK

SEQ ID NO: 55182 - DNA, 1212 bp, Trypanosoma brucei
  CDS (1)..(1212)
atgtccaggccctttaaggacttagcacccgttccattggaccccgtctttggtctagcgagggctgcaaaggccgccccagaaccgaaggcggatctcgttattggtgcctaccgcgaccaaaacgggttgccgtatccattaaaagtagtgcggaaggctgagcggcgcattgtggacatgggccttgataaagagtacccacccatgactggtcttcttaactttgttgaagaagctgtaaaactcgcctacggcaatacggtgccattggagcgtatcgccgcctcgcagggtctcagcggcaccggctcgcttagccttggagccacgctcctcaggcaggttgtacctgaagatacccctgtgtatgtttcaaatcccacatggtcaaaccacgtatcaatattcggaattgtgggccacaaaaatatccgtgaataccgttactacagtcccagcacccatgagctggacttcgttggcctcattgaagatctgaacgtggcccctcaggggagtattattgtgctgcacgcatgtgcccataaccccactggtgtggatccaagcaaagatcagtgggcaaccatcgccgatgtatttgttgaacgtaaattgattcccttctttgactccgcctaccagggttttgcatccggcagtctcgacgaggacgcctacgccatccgccactttgcaaagagagggatggaaatgttacttgcacartccttttccaagaacatgggtttgtatgccgaacgtgttggtgtgatttctgctgtcgtttcggatgcttcaaggaaggaggccgtgcggagccgccttgaggtgatcgcccgttcctattactcaaccccacctgtacatggcgctcgcatcgctcacctcgtgatgagtgacaaagaactccgcgcagaatgggagcaggaactcaaggagatggtgaaccgcgttcgaagcatgcgtcaaggtgtttatgaagggctgatgaaactcggtactcccggcacttgggagcacatcatcaaccagaagggtatgttctcttatatgggactttcaaggcctcagtgcgaaaggttgtgcgagaagcgcgtttttgtgctgcctgtcggccgcgccaacctcgcagcgttaacgccctcaacaatggattttctggtcaagtcgattgacgatgttgtccgacacgtgcgtaacaagtag

SEQ ID NO: 55183 - protein, 403 aa, Trypanosoma brucei
MSRPFKDLAPVPLDPVFGLARAAKAAPEPKADLVIGAYRDQNGLPYPLKVVRKAERRIVDMGLDKEYPPMTGLLNFVEEAVKLAYGNTVPLERIAASQGLSGTGSLSLGATLLRQVVPEDTPVYVSNPTWSNHVSIFGIVGHKNIREYRYYSPSTHELDFVGLIEDLNVAPQGSIIVLHACAHNPTGVDPSKDQWATIADVFVERKLIPFFDSAYQGFASGSLDEDAYAIRHFAKRGMEMLLAQSFSKNMGLYAERVGVISAVVSDASRKEAVRSRLEVIARSYYSTPPVHGARIAHLVMSDKELRAEWEQELKEMVNRVRSMRQGVYEGLMKLGTPGTWEHIINQKGMFSYMGLSRPQCERLCEKRVFVLPVGRANLAALTPSTMDFLVKSIDDVVRHVRNK

SEQ ID NO: 55184 - DNA, 1218 bp, Crithidia fasciculata
  CDS (1)..(1218)
atgtctggatctccgaccgacaacttcgacggcctctccgcgctgccgccggactccatcttcttcacgtcgcaaaaggccaaggcggcgcagggtcccaaggccgacctcatcatcggcgcctaccgcgacgagcatggctgcccctacccgctcaagacagtgcgcaaggcggagcgcatactgctcgacatgaacctcgactacgagtacctgcccatgaccggctacaagcccttcgtggacgaggcaaccaagatcatctacgccgacagcgtggcaccggaccacctcgtagcggtgcagacgctcagcggcaccggcgccgtctacctcggtgccgccttcctcgccgaggtgtacgacccaaagaccacgcccatctaccttccgaacccgacgtggcccaaccacccgagcatcttgaagctgacgggctggaaggatatccgcacctacaactactacgaccccaagacggtagcactggacttcgaggggattaagaaggacattcaggaggcgccagagtgctcggtgttcctgctgcaccagtgcgcacacaaccccaccggcgtcgacccctcgcacgcgcagtgggaggagatcgctgatctgatgctggccaagaagcaccaggtgttcttcgactccgcctaccagggctacgcgagcggcagcctcgacgaggacgccttcgcggcgcgtctctttgtgaagaagggcgtccaattcattctcgcccagtccttctccaagaacatgggtctttacaacgagcgcaccggcaccctgtccgtcgtcctgcgcaacccggagcgtgcggcggccgtgaagacgcacctggatctgctcatccgtgccaactactcgaacccgccggcccacggtgcccgcctcgtgcacctcgtgctgagcgataaggagttgcggaaggagtgggaggccgagctggcggagatggcgaaccgcattcgcacgatgcgtcacaccgtctacgacgagctgaagcgcctcgggacgccgggcacgtgggagcacatcatcaaccagatcggcatgttctccttcctcggtctctccaaggagcagtgccagtactgccaggaccacaacgtcttcatcctgctctctggccgcgcgaacatggccgggctgacgcacgacacggcgctcatgctggccaggacaatcgatgaggcggttcgcacggtgtaa

SEQ ID NO: 55185 - protein, 405 aa, Crithidia fasciculata
MSGSPTDNFDGLSALPPDSIFFTSQKAKAAQGPKADLIIGAYRDEHGCPYPLKTVRKAERILLDMNLDYEYLPMTGYKPFVDEATKIIYADSVAPDHLVAVQTLSGTGAVYLGAAFLAEVYDPKTTPIYLPNPTWPNHPSILKLTGWKDIRTYNYYDPKTVALDFEGIKKDIQEAPECSVFLLHQCAHNPTGVDPSHAQWEEIADLMLAKKHQVFFDSAYQGYASGSLDEDAFAARLFVKKGVQFILAQSFSKNMGLYNERTGTLSVVLRNPERAAAVKTHLDLLIRANYSNPPAHGARLVHLVLSDKELRKEWEAELAEMANRIRTMRHTVYDELKRLGTPGTWEHIINQIGMFSFLGLSKEQCQYCQDHNVFILLSGRANMAGLTHDTALMLARTIDEAVRTV

SEQ ID NO: 55186 - DNA, 1224 bp, Thermococcus litoralis
  CDS (1)..(1224)
atggattacacaaaatacctagccggaagggcgaattggattaagggctcagctttggctgatgtgatgaaaaaggcttcagaactccaaaagaaaggggtaaagctaatttctctcgcagctggagatccagatccggagttaattccaagagctgttcttggggaaatagcaaaagaagttcttgaaaaggaaccaaaatccgttatgtatactccggcaaatggaatcccggagcttagggaagagctggcagcattcttgaaaaaatacgaccatttagaagtttctccagaaaacattgttattacaataggaggaacgggagcattggatcttcttggaagggttttgatagaccctggagatgtcgtgataacagagaacccatcgtacataaacacattattggcatttgaacagttgggagccaaaattgagggggttccagttgataacgatgggatgagggttgatctgttggaggagaaaataaaggagcttaaagctaaaggacagaaagttaagctgatctacaccatcccgactggtcagaatccaatgggcgtcactatgagcatggaacggagaaaggcactacttgagattgcctctaaatacgacctcctaataattgaggacactgcttataatttcatgagatatgaaggaggggatatagtccccttaaaggctttggacaatgaaggaagagttatcgtggcgggaacgctcagcaaagtccttggaacaggattcagaattggatggataatagcagagggagaaatcctcaaaaaagttctcatgcagaaacagccaattgacttctgtgctccagctatttcccaatacattgccctagaatacttaaagaggggctattttgagaagtatcacttggaaggagcactgctcggttataaagagaagagggacatcatgctgaaggctcttgaaaatcacttgccaaatgcagaatttacaaagccaatagcgggaatgtttgttatgtttttccttccagagggagcagatggcatctcatttgccaacgagctcatggaaagggagggagttgtggtagttccaggaaagcctttctacacagacgagtctggaaagaatgctataaggcttaacttctcaaggccaagcaaggaagaaattccaataggaatcaagaaacttgctaagctttataaggaaaagtttggcgagtga

SEQ ID NO: 55187 - protein, 407 aa, Thermococcus litoralis; identical to SEQ ID NO: 18867

SEQ ID NO: 55188 - DNA, 1191 bp, Aeromonas hydrophila
  CDS (1)..(1191)
atgtttgaaaaggttgttgccgccccaccggatccgatcctgggcctgaccgaagccttccgcgctgactctcgcagccacaagatcaatctgggggtcgggatctacaaggatgaaaccggtgccacccctatccttcactgcgtcaagaaagccgagcagaagctgctcaccgacgagaagaccaagaattatctcggtattgaaggcaatatcgaatacggccgcatagtgcagcaactgctgttcggacaggactccgccttgatcgccagtggccgcgccaagaccgcccaggcgccgggcggcaccggtgccctgcgcattgccgccgagttcgtggtgcgcaacgggctggccaagaccatctggatctccgatcccacctgggccaaccacgtcagcgtattccaggccgccggtttgaccgtcaagtggtacaagtactacgacgccgccaccaaggggctcgactttgccgccatgcaggcgtcgctcaatgacgtacaggctggtgagctggtgctgctgcacggctgctgccacaacccgaccggtatcgaccccaccgctgagcagtggcgcgccctggccaaacagagtgccgccgccggctggctgccgctgtttgacttcgcctatcagggctttgcccgtggcatcgaagaagatgccgagggtcttcgcatcttcgccgagtgtcacgacgagctgctggtggcgagctctttctccaaaaacttcggcctctacaacgagcgggtcggcgccttcaccctggtcagcgcgaccaaggcgatcgccgatgtggccttcacccaggtcaagaccgtcatccgtgccaactactccaacccgccgtcacacggcgctgccgtggtgacaaccatcgtcagtgacccggctctctatgtcgagtgggttgaagaagtggcggccatgcgggtgcgcattcgcgagatgcgcgagctgctggtggagaagctggcagccttgggtgtgagccaggatttcagctttatccgcgagcagaacggcatgttctccttctccggtctctccaaggatcaggttgagcagctcaagagcgagtttgccatctacatcgtcggttcaggccggatcagcgtggccgggatcacccgtgccaacatagatcccctgtgtgacgccatcgccaaggtactgtga

SEQ ID NO: 55189 - protein, 396 aa, Aeromonas hydrophila
MFEKVVAAPPDPILGLTEAFRADSRSHKINLGVGIYKDETGATPILHCVKKAEQKLLTDEKTKNYLGIEGNIEYGRIVQQLLFGQDSALIASGRAKTAQAPGGTGALRIAAEFVVRNGLAKTIWISDPTWANHVSVFQAAGLTVKWYKYYDAATKGLDFAAMQASLNDVQAGELVLLHGCCHNPTGIDPTAEQWRALAKQSAAAGWLPLFDFAYQGFARGIEEDAEGLRIFAECHDELLVASSFSKNFGLYNERVGAFTLVSATKAIADVAFTQVKTVIRANYSNPPSHGAAVVTTIVSDPALYVEWVEEVAAMRVRIREMRELLVEKLAALGVSQDFSFIREQNGMFSFSGLSKDQVEQLKSEFAIYIVGSGRISVAGITRANIDPLCDAIAKVL

SEQ ID NO: 55190 - DNA, 1293 bp, Arabidopsis thaliana
  CDS (1)..(1293)
atggctttggcgatgatgatccgaaacgcagcttcgaagcgaggaatgactccgatctccggtcatttcggtggtttgagatctatgtcttcatggtggaagagcgttgagcctgctcctaaagatccgatcctcggagttaccgaagcttttctcgctgatcctagtcctgaaaaagttaatgttggtgtgggagcatatcgtgatgataatgggaagcctgttgtcttggaatgtgtcagagaagctgagaaaaggcttgctgggagcactttcatggagtaccttcctatgggaggaagtgccaaaatggtggacctaacattgaagcttgcctatggggacaatagtgaatttatcaaagataaaagaattgctgcagttcagactctgtctggcactggagcctgccggctctttgcagacttccagaaacgtttttctcctggttcacagatctacattcctgttccaacctggtccaaccaccacaacatctggaaagatgcacaagtccctcaaaagacatatcattactatcatccagaaaccaagggcttggatttctcagcattgatggatgatgtgaagaatgctccggaagggtcattcttccttcttcatgcttgtgctcataatcctactggagtagaccctacagaggaacaatggagagagatatcacagctattcaaggctaaaaagcatttcgcattcttcgatatggcttaccaaggttttgctagtggagatccagcgagagatgccaagtccatcaggatctttcttgaagatggtcatcatattggaatttctcagtcctatgcaaaaaacatgggactctacggccagagggtgggatgtctcagtgtgctttgtgaagatccgaagcaagccgtggctgtgaaaagtcaattgcagcagctagctagaccaatgtacagcaacccacctttgcatggtgctcagctggtctcaaccattcttgaagacccagagttaaagagtctgtggctaaaagaagttaaggtcatggctgataggatcatcggcatgagaactactttgcgagaaagccttgagaagttaggatcgcctttgtcatgggagcacgttaccaaacagattggaatgttctgctacagtgggttaacaccagaacaggttgaccgcttaacaagcgaatatcacatctatatgacccgtaacggccgtatcagtatggctggtgttacaacaggaaacgtgggataccttgcgaatgctatacatgaagtcaccaagtcatcttaa

SEQ ID NO: 55191 - protein, 430 aa, Arabidopsis thaliana
MALAMMIRNAASKRGMTPISGHFGGLRSMSSWWKSVEPAPKDPILGVTEAFLADPSPEKVNVGVGAYRDDNGKPVVLECVREAEKRLAGSTFMEYLPMGGSAKMVDLTLKLAYGDNSEFIKDKRIAAVQTLSGTGACRLFADFQKRFSPGSQIYIPVPTWSNHHNIWKDAQVPQKTYHYYHPETKGLDFSALMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDPKQAVAVKSQLQQLARPMYSNPPLHGAQLVSTILEDPELKSLWLKEVKVMADRIIGMRTTLRESLEKLGSPLSWEHVTKQIGMFCYSGLTPEQVDRLTSEYHIYMTRNGRISMAGVTTGNVGYLANAIHEVTKSS

SEQ ID NO: 55192 - DNA, 1257 bp, Medicago sativa
  CDS (1)..(1257)
atggcttctcaaaacatcactccttctccaaccgcttcttctgattccgtcttcgctcatctcgttcgtgctcctgaagatcctatcctcggtgtaactgtcgcttacaacaaggatccaagcccaattaagctcaacttgggtgttggtgcttaccgaactgaggaaggtaaaccccttgtgttggatgttgtgaggcgagttgaacgccaactattgaatgacatgtcacgcaacaaggagtatattccaattgttgggctcgctgattttaacaaattgagtgctaagcttatttttggtgcagacagccctgctattcaagagaacagggttaccactgttcaaggcttatctggtactggttcgctaagagttgggggtgaatttctagctaaacactatcatcaacgcattatatacttgccaacacctacttggggcaatcatacaaaggttttcaacttggcaggtttaactgtcaaaacatatcgctactatgctccagcaacacgagggcttgactttcaaggacttcttgaggatcttggttctgccccatctggatctgttgttttgctacatgcatgtgcacataaccctactggtgttgatccaacgcttgaacaatgggagcagattagacagctgataagatcaaaatctttgttacctttctttgacagtgcttatcagggttttgccagtggaagtctagatgcagatgcacagcctgttcgtttgtttgttgctgatggtggagaattgctggtagcccagagttatgcgaagaacatgggtctttatggtgaacgtgttggtgccttgagcattgtcagcaagtcagcggatgtttcaagcagggttgagagccaactgaaacttgtgattaggcccatgtactcaagtcctcctattcatggtgcatccattgtggccgccattctcaaggacagggatttgtacaatgactggactattgagttgaaggcaatggctgatcgcattatcaatatgcgccaacaactttttgatgctttacgtgctagaggtacaccaggtgattggagtcacattatcaagcaaattggaatgtttactttcacagggttgaatcctgagcaagtttccatcttgactaaagagtaccatatatacctgacatctgatgggaggattagcatggctggtttgagctccaaaacagtcccacatctggctcatgcaatacatgcagttgtaacccgagttgcttaa

SEQ ID NO: 55193 - protein, 418 aa, Medicago sativa
MASQNITPSPTASSDSVFAHLVRAPEDPILGVTVAYNKDPSPIKLNLGVGAYRTEEGKPLVLDVVRRVERQLLNDMSRNKEYIPIVGLADFNKLSAKLIFGADSPAIQENRVTTVQGLSGTGSLRVGGEFLAKHYHQRIIYLPTPTWGNHTKVFNLAGLTVKTYRYYAPATRGLDFQGLLEDLGSAPSGSVVLLHACAHNPTGVDPTLEQWEQIRQLIRSKSLLPFFDSAYQGFASGSLDADAQPVRLFVADGGELLVAQSYAKNMGLYGERVGALSIVSKSADVSSRVESQLKLVIRPMYSSPPIHGASIVAAILKDRDLYNDWTIELKAMADRIINMRQQLFDALRARGTPGDWSHIIKQIGMFTFTGLNPEQVSILTKEYHIYLTSDGRISMAGLSSKTVPHLAHAIHAVVTRVA

SEQ ID NO: 55194 - DNA, 1535 bp, Arabidopsis thaliana
  CDS (96)..(1313)
tgtgaacaagattaaaaagacgacttctcttttaacttattcctcctctgcttcttcaagatccattgtctgcaatttcaatcccttgtctcgtcatggattccgtcttctctaacgttgctcgtgctcccgaagatcctattctcggtgtaactgttgcttacaacaatgatcctagtcctgttaagatcaatttgggtgtcggtgcctaccgaactgaggaagggaagcctcttgttcttgatgtggtgcgtaaggcagagcaacagctagtgaacgatccgtctcgggtcaaggaatacattcccattgttggtatttccgattttaacaagttaagcgccaagctcatcttaggtgctgacagtcctgcgattacagaaagtagagttactacagtccagtgcttgtctggtactggttcgttgagagttggggctgagtttctcaaaacacactaccaccaaagtgtcatttacattccaaaaccaacttgggggaaccatcccaaagttttcaacttggcaggcttgtctgtggagtatttccgctactatgatcctgcaacccgtggtcttgacttcaaaggcttgctcgaggatcttggcgctgcaccatctggagctattgtcttacttcatgcatgtgcacacaatcccactggagttgacccaacctctgaacagtgggaacagattcgacagctgatgagatctaaaagcttattacccttttttgatagtgcatatcagggttttgctagtggtagccttgacacagatgcacaatctgtccgtacatttgttgctgatggcggtgaatgcttgatagctcaaagttacgccaaaaatatgggactttatggggagcgtgttggtgcccttagcattgtctgcaagtcagcagatgtggctagtaaggttgagagccaggtgaagcttgttgtgcggcccatgtattcgagcccccctattcatggagcatcaattgttgccaccattctaaaaagcagtgatatgtacaacaactggaccatcgagctgaaagaaatggctgaccgtataaagagcatgcgccaacagttatttgaagctatacaagctagaggtacacctggtgactggagtcatattatcaaacagattgggatgtttacatttactggattgaacaaggagcaagttgaattcatgaccaaagagttccacatttacatgacctctgatgggagaataagcatggcaggtctaagttcgaagacagtgcctcaccttgccgatgctatgcatgctgcagtgacccgcctcggctaaactagcgaccatacatttttttgctgtttctacaaataaaatgggacaaaaaaaaagaacaccgtttttgttggcttatatactatggtttttttctgatggtaccatatgtttcctcatgtcttttgactaaagatggttgaaccaaaaccaaagtgaggattgtgacattgagatctaccgtttctaagaaaatattggttactttaatttgccaccaac

SEQ ID NO: 55195 - protein, 405 aa, Arabidopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 55196 - DNA, 1350 bp, Arabidopsis thaliana
  CDS (1)..(1350)
atgaaaactactcatttctcttcctcttcttcttccgatcgcaggatcggtgctctgctccgtcatctcaattccggctcagattcggacaacctgagctctctttatgcatctccgacatcgggaggcaccggtggttctgttttctctcatcttgttcaagctccagaggatcctattcttggggtgacagttgcatacaacaaagatcctagcccagttaagctgaatttaggagttggtgcttaccgaactgaggagggaaaacctttggttcttaatgttgtgaggaaagctgagcagcagcttatcaatgacagaacaagaatcaaggagtatcttcccattgttggattggttgagttcaacaagttaagcgctaagctcatactaggcgctgacagtcctgctattcgggagaatcggattaccaccgtggagtgtttgtctggtactggttctctgagagttggaggagagtttttggctaaacattatcatcagaaaacaatttacatcactcagccaacatggggaaatcatccaaagattttcacgctcgctggtttgacagtgaaaacttaccgatactacgatccagcgacgcgtgggttgaactttcaaggtttattagaagaccttggtgctgccgcacctggttctatagtgcttctccatgcctgtgcccataaccctactggtgttgatccaaccattcaacaatgggagcaaatcaggaagttgatgcgatcaaagggattgatgcccttcttcgatagtgcttatcagggctttgcaagtggaagtcttgatacagatgcgaaacctattaggatgtttgttgctgatggcggagaatgcctcgttgctcaaagttatgcgaagaacatgggactctatggagaacgagttggagctctcagcattgtatgcaaatcagcagatgttgcggggagagttgaaagccaactgaaactagtgataaggccaatgtactcgagtcctccaatccatggtgcatcaatcgtggctgtaatcctccgtgacaagaatttgttcaacgaatggactctggaactgaaggccatggctgatcgtatcatcagcatgaggaaacagcttttcgaggcattacgtactcgaggcactcctggagactggagtcacatcataaagcagattggtatgtttaccttcacagggttaaacccagctcaagtctccttcatgactaaagagtaccacatctacatgacatctgacgggaggataagcatggctggtctgagttcgaagactgtacctcaccttgcagacgctatccatgctgttgtcaccaaagccgtctga

SEQ ID NO: 55197 - protein, 449 aa, Arabidopsis thaliana
MKTTHFSSSSSSDRRIGALLRHLNSGSDSDNLSSLYASPTSGGTGGSVFSHLVQAPEDPILGVTVAYNKDPSPVKLNLGVGAYRTEEGKPLVLNVVRKAEQQLINDRTRIKEYLPIVGLVEFNKLSAKLILGADSPAIRENRITTVECLSGTGSLRVGGEFLAKHYHQKTIYITQPTWGNHPKIFTLAGLTVKTYRYYDPATRGLNFQGLLEDLGAAAPGSIVLLHACAHNPTGVDPTIQQWEQIRKLMRSKGLMPFFDSAYQGFASGSLDTDAKPIRMFVADGGECLVAQSYAKNMGLYGERVGALSIVCKSADVAGRVESQLKLVIRPMYSSPPIHGASIVAVILRDKNLFNEWTLELKAMADRIISMRKQLFEALRTRGTPGDWSHIIKQIGMFTFTGLNPAQVSFMTKEYHIYMTSDGRISMAGLSSKTVPHLADAIHAVVTKAV

SEQ ID NO: 55198 - DNA, 1362 bp, Arabidopsis thaliana
  CDS (1)..(1362)
atggcttctttaatgttatctctcggttccacttctctgttaccgcgcgagattaacaaggataagctaaagcttggaacttctgcttcgaacccgttcctaaaagcaaagtcttttagcagagtgactatgacggttgcagtgaagccttctcgtttcgagggtataactatggctccaccagaccctattcttggagtcagtgaagcattcaaagctgacactaacgggatgaaactcaatcttggtgttggtgcttatcgtactgaggaactccagccttatgtgcttaatgttgttaaaaaggcggagaatttgatgttggagagaggagataacaaagagtatcttccaattgaggggttggcagcattcaacaaggctactgctgagttgctatttggagctggtcatcctgttattaaggaacaaagagtagcaacaattcagggtctttcgggaacaggttcactgcgattagcagcggctcttatagagcgttatttccctggagcaaaagttgtgatctcatcaccaacctggggtaatcacaagaatatcttcaatgatgccaaagttccgtggtccgaataccgctactatgatccaaaaacaattggtttggattttgagggaatgatagcagatataaaggaagctccagaaggatccttcatcttgcttcacggatgtgctcacaacccaactggaattgacccaacaccagaacagtgggtaaaaattgctgatgtcattcaggaaaagaaccatatcccatttttcgatgttgcataccagggctttgctagtggaagccttgatgaagatgcagcatctgtgagattatttgctgagcggggaatggagttttttgttgctcagtcatatagtaaaaatttaggtttgtatgcagaaagaattggggcaatcaatgtcgtgtgctcctcagctgatgctgctacaagggtcaagagccagttgaaaaggattgctcggcctatgtactcgaatccaccagttcatggggcgagaatcgtggccaatgtagtgggtgatgtaactatgttcagtgaatggaaagcagagatggaaatgatggcaggaagaataaagacggttagacaagagctgtatgatagcctcgtttcaaaagacaagagcgggaaggactggtccttcattctgaagcaaattggcatgttctctttcaccggcctaaacaaagctcagagcgataacatgacggacaaatggcacgtgtatatgactaaagacgggaggatatcattggccggattatctctggccaaatgcgagtatcttgctgatgcgatcatcgactcataccataacgtaagctga

SEQ ID NO: 55199 - protein, 453 aa, Arabidopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 55200 - DNA, 1227 bp, Caenorhabditis elegans
  CDS (1)..(1227)
atgtccttctttgacggaatcccagttgctccaccaatcgaggtgttccacaagaacaagatgtacctcgatgagacggctcccgtcaaagttaacctgacaattggagcctaccgcacagaggagggacagccatgggtgcttccagtcgttcatgagactgaagtcgaaatcgccaacgacacctcgctcaatcacgagtatcttccagttctcggtcacgagggtttccgcaaggctgccaccgagcttgtcctcggagccgaatcgccagctatcaaggaggaaagatcgtttggagtacagtgtctctctggaaccggagctcttcgtgctggagccgagtttcttgcttcagtgtgtaacatgaagaccgtctacgtgagcaacccaacatggggaaatcacaagcttgtcttcaagaaggctggtttcaccaccgtcgccgactacaccttctgggactatgataacaaacgtgtgcacattgagaagttcctctccgatcttgagtcagccccagagaagtctgtcatcattcttcacggatgtgctcacaacccaactggaatggacccaactcaggagcaatggaagttggttgccgaggtgatcaagagaaagaacctcttcaccttctttgacattgcttaccaaggattcgcatctggtgatccagctgcggacgcctgggcgatccgctactttgtagaccagggaatggagatggttgtgtcccaatcatttgccaagaactttggactttacaacgagcgtgtcggaaaccttactgtcgtcgtcaacaatccagctgtcattgccggattccagtctcaaatgtcgttggttatccgtgccaactggtccaatccaccagcacatggagcaagaattgtgcacaaggtgctcaccaccccagctcgccgtgaacaatggaaccagtctattcaagcgatgtcttctcgtatcaagcagatgagagccgccttattgcgccatttgatggatcttggcactcctggaacttgggatcacatcattcaacaaattggaatgttcagctacaccggacttacttctgcccaagtggatcacctgattgccaatcacaaagtattcctgctcagagacggccgcatcaacatttgtggtcttaacacgaaaaacgtggaatatgtcgccaaggcgattgatgagactgtgcgtgccgtgaagagcaacatctaa

SEQ ID NO: 55201 - protein, 408 aa, Caenorhabditis elegans
MSFFDGIPVAPPIEVFHKNKMYLDETAPVKVNLTIGAYRTEEGQPWVLPVVHETEVEIANDTSLNHEYLPVLGHEGFRKAATELVLGAESPAIKEERSFGVQCLSGTGALRAGAEFLASVCNMKTVYVSNPTWGNHKLVFKKAGFTTVADYTFWDYDNKRVHIEKFLSDLESAPEKSVIILHGCAHNPTGMDPTQEQWKLVAEVIKRKNLFTFFDIAYQGFASGDPAADAWAIRYFVDQGMEMVVSQSFAKNFGLYNERVGNLTVVVNNPAVIAGFQSQMSLVIRANWSNPPAHGARIVHKVLTTPARREQWNQSIQAMSSRIKQMRAALLRHLMDLGTPGTWDHIIQQIGMFSYTGLTSAQVDHLIANHKVFLLRDGRINICGLNTKNVEYVAKAIDETVRAVKSNI

SEQ ID NO: 55202 - DNA, 1218 bp, Daucus carota
  CDS (1)..(1218)
atgtcttccgtcttcgctaacgtcgttcgcgctcctgaggatcctatcttaggggtcactgttgcttatcacaaagatcaaagtcctaataagttgaatttgggtgttggtgcttatcgaactgaggaaggaaaacctcttgttcttaatgttgtgaagaaagcagagcagatgcttgtaaatgatcagtctcgagtaaaagagtatcttcctattgttggactggcagactttaacaaattgagtgccaagctgattttcggcgctgatagtcctgccattcaagagaatagagtcgcaactgtccagtgcttatctggtactggctcactgagggttgggggtgaattcctggccagacattatcatgaacatacagtgtatatcccccagccaacttggggaaaccatccaaaaattttcactttagcaggcttatcggtgaagacataccgctattataatccagaaacgcgtggattggattttgaaggcatgctagaggatcttggttctgctccattgggagcaatagtgcttcttcatgcatgtgctcacaatccaaccggtgttgatccaaccattgagcagtgggagcagatcagacagctgatgagatcgaaaagcttgttacctttctttgacagtgcatatcagggttttgctagcggcagccttgacgccgatgcacagtctgttcgcatctttgttgcagatggtggtgaatgccttgcagctcagagttatgcaaagaatatgggactctatggggaacgcgttggtgccctgagcattgtttgcaagactgcagatgtggcaagcaaggttgagagccaattgaaactagttatcaggcctatgtattccagtccacctcttcatggtgcatctattgtggctgcgattctcaaagatggtgacctctataatgaatggacactggagctgaaagcaatggctgaccgaatcatcagcatgcgacaggagctctttaatgctttacaagcaaaaggaacaccaggtgactggagtcacattgtcaagcaaattggaatgtttacattcactgggttaaactctgagcaagtcaccttcatgaccaatgagtatcatatatatttgacatctgatgggcggatcagcatggcaggtcttagttcccgaacagttcctcatcttgcagatgctattcatgctgcagttactggcaaggcctag

SEQ ID NO: 55203 - protein, 405 aa, Daucus carota
MSSVFANVVRAPEDPILGVTVAYHKDQSPNKLNLGVGAYRTEEGKPLVLNVVKKAEQMLVNDQSRVKEYLPIVGLADFNKLSAKLIFGADSPAIQENRVATVQCLSGTGSLRVGGEFLARHYHEHTVYIPQPTWGNHPKIFTLAGLSVKTYRYYNPETRGLDFEGMLEDLGSAPLGAIVLLHACAHNPTGVDPTIEQWEQIRQLMRSKSLLPFFDSAYQGFASGSLDADAQSVRIFVADGGECLAAQSYAKNMGLYGERVGALSIVCKTADVASKVESQLKLVIRPMYSSPPLHGASIVAAILKDGDLYNEWTLELKAMADRIISMRQELFNALQAKGTPGDWSHIVKQIGMFTFTGLNSEQVTFMTNEYHIYLTSDGRISMAGLSSRTVPHLADAIHAAVTGKA

SEQ ID NO: 55204 - DNA, 1257 bp, Saccharomyces cerevisiae; identical to SEQ ID NO: 54834
  CDS (1)..(1257)

SEQ ID NO: 55205 - protein, 418 aa, Saccharomyces cerevisiae; identical to SEQ ID NO: 54835

SEQ ID NO: 55206 - DNA, 1293 bp, Bos taurus
  CDS (1)..(1293)
atggccctgctgcactctggccgcttcctgtccggagtcgccgcggctttccacccaggcctcgctgccgcggcttctgccagagccagctcctggtgggctcatgtggagatggggcccccagatcccatcctgggagtaacagaagcctttaagagagacaccaacagcaaaaagatgaacctgggagttggtgcctaccgggatgataatggaaagccttacgtgcttccaagtgtccggaaggcggaggcccagattgctgcaaaaaatttggataaagaatacctgcccattgcggggctggctgaattttgtaaggcatctgcagaactagccctgggtgagaacaatgaagtgttgaaaagtggccggtatgtcaccgtgcagaccatttctggaaccggggccttaaggatcggagccagttttctgcaaagattttttaagttcagccgggatgtcttcctgcccaaaccaacctgggggaatcatacacccatcttcagggatgctggcatgcagctccagagttatcggtactatgaccccaagacgtgcggctttgacttcacaggcgctattgaggacatttcaaaaataccagcgcagagtgtcattctcctgcacgcctgtgcccacaaccccacgggagtggaccctcgtcctgagcagtggaaggagatggcgacagtggtgaagaaaaacaatctctttgcattctttgacatggcctaccaaggctttgccagtggcgatggtaacaaggatgcctgggctgtgcgccacttcatcgaacagggcattaatgtttgtctctgccagtcctatgccaagaacatgggcttatacggtgagcgtgtgggagccttcactgtggtctgcaaagatgccgaggaagccaaaagagttgagtcccagttgaagatcctgatccgtcccatgtattccaacccccctatcaatggggcccggattgcctccactattctcaccagcccggatttgcggaaacaatggttgcacgaagtgaagggcatggccgaccgcatcatcagcatgcggacacagctggtgtccaacctcaagaaggagggctcctcccacaactggcagcacatcattgaccagatcggcatgttttgttacacaggcctaaagcctgaacaggtggagcggctgaccaaggagttctccatctacatgacaaaggatggccgcatctctgtggcaggggtcacctcaggcaacgtggcataccttgctcacgccattcaccaggtcaccaagtaa

SEQ ID NO: 55207 - protein, 430 aa, Bos taurus
MALLHSGRFLSGVAAAFHPGLAAAASARASSWWAHVEMGPPDPILGVTEAFKRDTNSKKMNLGVGAYRDDNGKPYVLPSVRKAEAQIAAKNLDKEYLPIAGLAEFCKASAELALGENNEVLKSGRYVTVQTISGTGALRIGASFLQRFFKFSRDVFLPKPTWGNHTPIFRDAGMQLQSYRYYDPKTCGFDFTGAIEDISKIPAQSVILLHACAHNPTGVDPRPEQWKEMATVVKKNNLFAFFDMAYQGFASGDGNKDAWAVRHFIEQGINVCLCQSYAKNMGLYGERVGAFTVVCKDAEEAKRVESQLKILIRPMYSNPPINGARIASTILTSPDLRKQWLHEVKGMADRIISMRTQLVSNLKKEGSSHNWQHIIDQIGMFCYTGLKPEQVERLTKEFSIYMTKDGRISVAGVTSGNVAYLAHAIHQVTK

SEQ ID NO: 55208 - DNA, 2411 bp, Mus musculus
  CDS (99)..(1391)
tcactgtcctcaccttttaggagcccgcgcctcggttccagcggacgcttccccagatctcggctctaccaccatccactgccgtcttaccgcccaccatggccctcctgcactccagccgcatcctctccgggatggctgctgcctttcacccaggcctagctgctgcagcctctgccagagccagctcctggtggacccatgttgaaatgggacctccagatcccatcctgggcgttaccgaagccttcaagagagataccaacagcaagaagatgaacctgggagttggtgcctaccgggatgataacggaaaaccttacgtgctccccagtgtccggaaggcagaggcccagattgctgcaaaaaatttggacaaagaatacctgcccattgggggactggctgaattctgtaaggcttctgcagaactggccctgggcgagaacaatgaagtgttgaaaagcggccggttcgtcactgtgcagaccatttccgggactggagccttaagggtcggggccagttttctgcaaaggttttttaagttcagccgagatgtctttctgcccaaaccatcctggggaaatcacacgcccatcttcagggatgccggcatgcagctccaaggttatcgctactatgaccccaagacttgcggttttgacttctctggagccctagaagacatatcaaaaatcccagagcagagtgtcctcctcctgcatgcctgcgctcacaaccccaccggcgtggacccgcgtcccgagcagtggaaggagatagcgtccgtggtgaagaaaaagaatctcttcgcattctttgacatggcctaccaaggctttgccagcggtgatggtgataaggatgcctgggccgtgcggcacttcatcgagcagggcatcaatgtctgcctctgccaatcgtatgccaagaacatgggcctgtacggtgagcgtgtgggagccttcacggtggtctgcaaagatgcagaagaagccaaaagggtggagtcacagctgaagatcttgatccgtcccctgtattccaacccacctctcaatggggcccggatcgcagcaaccatcctgacttctccagacttgcggaagcaatggttgcaagaggtgaaaggcatggctgaccgcatcatcagcatgaggacccagctggtctccaacctgaagaaagagggctcttcccacaactggcagcacatcaccgaccagatcggcatgttctgtttcaccggcctaaagccagagcaggtagagcggctgaccaaggagttctcggtctacatgacaaaggatggccgaatctccgtggcaggggtcacctctggcaatgtgggctaccttgcccatgccattcaccaggtcaccaagtaattcccaggtgcaaaggaacagagaccactttcccgacagcctttgcgctcgtgagcgtcacgtgcagggtgagggagggtgggtggtggtgaatagatccggtttccaaccacggtgcataactcagcgactgaactcgctcctcggaagagaggtagggcagaggcttcctcggctggtatctggaacttcgtcggctctaaaccaaactccctcatccttttgtctccagcttttctgaaagtttacacacgcaagaaaaatcacagcaccaaacacctgtcagccatggcactggaataggtcagacgctttacctaaagcctcaggtggtatcaggggctcccccgtggaccccagtagagcctcccctaatagaggctataagagaaaaataactagttctgtcattaacagttgtcctcaagttcgtcctcttggtgtggagcaaactgtgtcagcagaccacattacagaaattatgctttacaaaaaccaacaggtctgttgccacttcaacagggacagtagaagatgtagtgtcgtgtccgcctgccccttgtcattgctgttctagagcctagagtctcatcccgttctactgcaaacatccgcctcagcctatggggggagttacataagaatggagagcataggttttctgctcctgcatagcctcctctctcatcaaagagccgtggagagagagagaccctgcccttgatttcagagtcctcttcagtcattgattgattggctcctactgggatggggcctctgcccagctggacctcttcatccatcctggctgcacagcctgtctcttcacatgagtcagacgtgcagggtaggatcagaaggagatactctggggtttgtgtgctgccagcccggctcagactccgcccttgggaaagataaccaccatctgctctaatcatgtagacgtactgccgcctggtttctctgttacaataaaattactatagacccaaaaaaaaaaaaaaaaaaaaaaaaaaa

SEQ ID NO: 55209 - protein, 430 aa, Mus musculus
MALLHSSRILSGMAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENNEVLKSGRFVTVQTISGTGALRVGASFLQRFFKFSRDVFLPKPSWGNHTPIFRDAGMQLQGYRYYDPKTCGFDFSGALEDISKIPEQSVLLLHACAHNPTGVDPRPEQWKEIASVVKKKNLFAFFDMAYQGFASGDGDKDAWAVRHFIEQGINVCLCQSYAKNMGLYGERVGAFTVVCKDAEEAKRVESQLKILIRPLYSNPPLNGARIAATILTSPDLRKQWLQEVKGMADRIISMRTQLVSNLKKEGSSHNWQHITDQIGMFCFTGLKPEQVERLTKEFSVYMTKDGRISVAGVTSGNVGYLAHAIHQVTK

SEQ ID NO: 55210 - DNA, 1293 bp, Sus scrofa
  CDS (1)..(1293)
atggccctgctgcactccggccgcgtcctgtccggagtcgcctccgccttccacccaggcctcgctgctgcagcatctgccagagccagctcctggtgggctcatgtggagatggggcccccagatcccatcctgggagtcacagaagcctttaagagagacaccaacagcaaaaagatgaatctgggagttggtgcctaccgggatgataacggaaagccttacgtgctccctagtgtccgaaaggcagaggcgcagattgctgcaaaaaatttggacaaagaatacctgcccattggaggactggcggaattttgtaaggcatctgcagaactagccctgggtgagaacaatgaggtgttgaaaagtggccggtatgtcaccgtgcagaccatttctgggaccggggccctgcggatcggagccaattttctgcaaagattttttaagttcagccgagatgtcttcctgccgaaaccatcctggggaaatcacacccccatcttcagggacgctggcatgcagctgcatagttaccgatactatgaccccaagacctgcggctttgacttcacaggtgctcttgaggacatttcaaaaataccagctcagagtgtaattctcctgcacgcctgtgcccacaatcccacaggagtggaccctcgtcctgagcagtggaaggagatggccacactggtgaagaaaaacaatctctttgcattctttgacatggcctaccaaggctttgccagtggcgatggtaacaaggatgcttgggcagtgcgccacttcatcgaacagggcatcaatgtttgtctctgccagtcctatgccaagaacatgggcttatacggtgagcgtgtgggagccttcactgtggtctgcaaagatgctgaggaagccaaaagggtggagtcacagttgaagatcttgatccgtcctatgtattccaaccctcctgtcaacggggcccggattgcctcgaccatcctgaccagcccggatctgcggcaacaatggttgcaggaagtcaagggcatggccgaccgcatcattagcatgaggacccagctggtctccaacctcaagaaggagggctcctcccacaactggcagcacatcgttgaccagatcggcatgttttgtttcacaggcataaagcctgaacaggtggagcggctgaccaaggagttctccatctacatgacaaaggatggccgcatctctgtggcaggggtcacctctggcaatgtgggctaccttgcccatgccattcaccaggtcaccaagtaa

SEQ ID NO: 55211 - protein, 430 aa, Sus scrofa
MALLHSGRVLSGVASAFHPGLAAAASARASSWWAHVEMGPPDPILGVTEAFKRDTNSKKMNLGVGAYRDDNGKPYVLPSVRKAEAQIAAKNLDKEYLPIGGLAEFCKASAELALGENNEVLKSGRYVTVQTISGTGALRIGANFLQRFFKFSRDVFLPKPSWGNHTPIFRDAGMQLHSYRYYDPKTCGFDFTGALEDISKIPAQSVILLHACAHNPTGVDPRPEQWKEMATLVKKNNLFAFFDMAYQGFASGDGNKDAWAVRHFIEQGINVCLCQSYAKNMGLYGERVGAFTVVCKDAEEAKRVESQLKILIRPMYSNPPVNGARIASTILTSPDLRQQWLQEVKGMADRIISMRTQLVSNLKKEGSSHNWQHIVDQIGMFCFTGIKPEQVERLTKEFSIYMTKDGRISVAGVTSGNVGYLAHAIHQVTK

SEQ ID NO: 55212 - DNA, 1293 bp, Rattus norvegicus
  CDS (1)..(1293)
atggccctcctgcactccggtcgcgtcctctccgggatggctgctgcctttcacccaggccttgcagccgcagcctctgccagagccagctcctggtggacccatgttgaaatgggacctccagatcccatcctgggagtgaccgaagccttcaagagagataccaacagcaagaagatgaacctgggagttggtgcctaccgggacgataacggaaagccttacgtgctccccagtgttcggaaggcagaggcccagattgctgggaaaaatttggacaaagaatacctacccatcgggggactggctgatttttgtaaggcttctgcagaactggccctgggcgagaacagcgaagtgttgaaaagcggccggtttgtaactgtgcagaccatttccgggactggagccttgagggtcggagccagctttctgcaaagattttttaagttcagccgagatgtctttctgcccaaaccatcctggggaaaccacacgcccatcttcagggatgccggcatgcagctgcaaggttatcgatactatgaccccaagacttgcggctttgacttctctggagccttagaagacatatcaaaaatcccagagcagagtgttctccttctgcacgcctgcgctcacaaccccacgggcgtggacccgcgtccagagcagtggaaggaaatggcggcggtggtgaagaaaaagaatctcttcgcattctttgacatggcctaccaaggctttgccagcggcgatggtgataaggacgcctgggccgtgcggcacttcatcgagcagggcatcaatgtctgcctctgccaatcctatgccaagaacatgggcctgtacggtgagcgtgtgggagccttcactgtggtctgcaaagatgcagaagaagccaaaagggtggagtcacagctgaagatcctgatccgccccttgtattccaacccgcctctcaatggagcccggatcgccgcaaccatcctgacttctccagacttgcggaagcaatggttgcaggaggtgaaaggcatggctgaccgcatcatcagcatgaggacccagttggtctccaacctgaagaaagagggctcgtcccacaactggcagcacatcaccgaccagatcggcatgttctgcttcaccggcctaaagcctgagcaggtggagcggctgaccaaggagttctcagtctacatgacaaaggatggtcgaatctctgtggccggggtcacctctggcaatgtgggctacctggcccacgccattcaccaggtcaccaagtaa

SEQ ID NO: 55213 - protein, 430 aa, Rattus norvegicus
MALLHSGRVLSGMAAAFHPGLAAAASARASSWWTHVEMGPPDPILGVTEAFKRDTNSKKMNLGVGAYRDDNGKPYVLPSVRKAEAQIAGKNLDKEYLPIGGLADFCKASAELALGENSEVLKSGRFVTVQTISGTGALRVGASFLQRFFKFSRDVFLPKPSWGNHTPIFRDAGMQLQGYRYYDPKTCGFDFSGALEDISKIPEQSVLLLHACAHNPTGVDPRPEQWKEMAAVVKKKNLFAFFDMAYQGFASGDGDKDAWAVRHFIEQGINVCLCQSYAKNMGLYGERVGAFTVVCKDAEEAKRVESQLKILIRPLYSNPPLNGARIAATILTSPDLRKQWLQEVKGMADRIISMRTQLVSNLKKEGSSHNWQHITDQIGMFCFTGLKPEQVERLTKEFSVYMTKDGRISVAGVTSGNVGYLAHAIHQVTK

SEQ ID NO: 55214 - DNA, 1356 bp, Saccharomyces cerevisiae
  CDS (1)..(1356)
atgttgaggacgaggcttactaattgcagtctatggaggccctactacacgtcatcgcttagtagagtaccaagagcacctccagataaagtcttggggttatctgaacacttcaaaaaggcaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattcattcgtctatttaacaggtgatggtagattgtcgcttagcggagtcaatgattcgaacgttgattacttatgtgaatctcttgaagcagtctcgaaaatggacaaactcgcataa

SEQ ID NO: 55215 - protein, 451 aa, Saccharomyces cerevisiae
MLRTRLTNCSLWRPYYTSSLSRVPRAPPDKVLGLSEHFKKAKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNSFVYLTGDGRLSLSGVNDSNVDYLCESLEAVSKMDKLA

SEQ ID NO: 55216 - DNA, 1191 bp, Escherichia coli
  CDS (1)..(1191)
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa
